United States Patent 6,812,339 (POLYMORPHISMS IN KNOWN GENES ASSOCIATED WITH HUMAN DISEASE, METHODS OF DETECTION AND USES THEREOF) - sequence listing, part 97

SEQ ID NO: 108872 - DNA, 601 bp, Human
ttggaaggatgaggcagggaccgaggtgggcagaggagactgggcatgggtccccacttctgctccaacagagcgacagagaagcccctgaggtgggtgcgggtgactgcgggtctgcctcattggtgtcccacccacattcgtgtcctggctctgctcctccctcgctgagcgtcctgggcaagtcctgagactgaacctcagtccacctgtctgaaatgggacttttggccctggcatccttgtgactttcaacccctctggggttgtcagaggatttgccgctatgttgcccgagatrgggttagagacagcctgttgggtggccagcgttccttgtgtggctcttatcagagtcctgagagaagaggccagggtggaaattggccctggagtgtgggctcctgccgaagcctcttcctgtggccagtgccatgctgaaggctggctgtggtgtcacgtgagccctcccagccacattcaggctcaaagagactgtgctgagcatatggtgacaaggaagggatcccagcccagggtcctggccaggccctgccagcaccaggctgcacaggtgaggggtggcttgccctggggtgct

SEQ ID NO: 108873 - DNA, 601 bp, Human
tccccaccctcataggggctggaagtcaaaaggcgcctggtggagccttgtggtctgttcaaaaaacggtaaataaacagcctgggcttctgatctgctggactcaacctggcacctctcccatcgctgctgggtgctgcctcccagctgcacccttccctgcctgtcccctaccgccttcctggagcgcttatccccttccagggagaggtggcccactttagagctctgaaacctgctctggtggggtgaagtgacttgagccaggccaagccggtggctgggccctctgtggcagacyggaagtgtcctcccatttcatggatggccaagtcagtgcccagagaggggtagagacctgtccagggccacacagcccaggaggggcggagctcgactttgaacccaggctgcctggctccacagtctggattcttcttacccattcaacaaatacttaatgagcacacactgtctggcaggcactgttctaggtgctgaggatctagcagtgaccaggccaggtgcagaagtcttggcgtgtcacaggactagaccttcatcagaggccgttttgctgggagtgggaaggggtgtgtat

SEQ ID NO: 108874 - DNA, 601 bp, Human
aataaacagcctgggcttctgatctgctggactcaacctggcacctctcccatcgctgctgggtgctgcctcccagctgcacccttccctgcctgtcccctaccgccttcctggagcgcttatccccttccagggagaggtggcccactttagagctctgaaacctgctctggtggggtgaagtgacttgagccaggccaagccggtggctgggccctctgtggcagactggaagtgtcctcccatttcatggatggccaagtcagtgcccagagaggggtagagacctgtccagggccayacagcccaggaggggcggagctcgactttgaacccaggctgcctggctccacagtctggattcttcttacccattcaacaaatacttaatgagcacacactgtctggcaggcactgttctaggtgctgaggatctagcagtgaccaggccaggtgcagaagtcttggcgtgtcacaggactagaccttcatcagaggccgttttgctgggagtgggaaggggtgtgtatttgggagggaggggcgcaagccatcacacctgcccatggccaggtaggcagggcctatgggagggtttcct

SEQ ID NO: 108875 - DNA, 601 bp, Human
acttgggaggctgaggtgggaagttcactagggtccgggagttcaaggctgcagtgaggtatgattgtgccactgcactccagactgggcaatataggaagatgccatctctaaaaaaaaaaaattagccaagcatggtgacatatacctgtagtcatagctactcaggaggccgagactgaggtttgcctgtaccctggagtttgaggctgcagtaagctgtgattgtgctgctgatgcagcctgggcacagagtgagatcctgcctctaaaataaataaggccgggcgcggtggctcaygcctgtaatcccagcactttgggctgctgaggcaggcggatcacctgaggccaggagttcgagaccagcctggccaaaatggcaaaaccccatctctactaaaaatacaaagaaattagccgggtgtggtgctgggcgcctgtaatcccagctacttggggggctgaggcaggagtaagctgagattgcgccactacactccagcctgggtgacaaagcaagactccatctcaaaaaaaaaaaaagttaataaactacttaattgtgcatctcctgtgtgccagccctactctatgcttt

SEQ ID NO: 108876 - DNA, 601 bp, Human
ggagtttgaggctgcagtaagctgtgattgtgctgctgatgcagcctgggcacagagtgagatcctgcctctaaaataaataaggccgggcgcggtggctcatgcctgtaatcccagcactttgggctgctgaggcaggcggatcacctgaggccaggagttcgagaccagcctggccaaaatggcaaaaccccatctctactaaaaatacaaagaaattagccgggtgtggtgctgggcgcctgtaatcccagctacttggggggctgaggcaggagtaagctgagattgcgccactacrctccagcctgggtgacaaagcaagactccatctcaaaaaaaaaaaaagttaataaactacttaattgtgcatctcctgtgtgccagccctactctatgctttggggatggaatgttggaggatcccaccttggggagctgtgtgtgagctccccacacagctcagatgggggtatggggtctgtatgtgagccagaacaaaatgcagctaagtgacatttagcatgtgttagttccacagagaaaaatgaggcatggggggtggaggtgggagaggtgtgaatgggggtgagagaagtct

SEQ ID NO: 108877 - DNA, 601 bp, Human
acccaccaccacgcctggctaatttttgtaattttagtagagatggggttgcaccatgttggccaagcaggtctcgaactcctgacctcaaacgatccacccacctcggcctctgaaagtgtttggattacaggcgtgagccattatgcccagcaatatatcttatatataaggtgattgaaaatatatgttttcaaaaagaaaacatattttcagtcagcttccttaggttgaacgtaatttatatttaactagtcccctgttgctgggctttaaaattctttgagatctgaatttttcrtcttattgagaaactaacagggttgtaacaattctgtgggcaaattttaatggaatgtccaccctgtacttttgtatctgaatcttcacgaacatgttctccttgacttgtgaccttttcctgagatttcagttagatatagttaatcgcttaagtctttttttttttttttgagacggagtctcactctgttgccaggctggagtgcagtggcgctatctcagctcactgcagcctccgcctcccaggttcaagcgattctgcctcagcctcctgagtagctgggactacaggcaccct

SEQ ID NO: 108878 - DNA, 601 bp, Human
tgaaaatatatgttttcaaaaagaaaacatattttcagtcagcttccttaggttgaacgtaatttatatttaactagtcccctgttgctgggctttaaaattctttgagatctgaatttttcgtcttattgagaaactaacagggttgtaacaattctgtgggcaaattttaatggaatgtccaccctgtacttttgtatctgaatcttcacgaacatgttctccttgacttgtgaccttttcctgagatttcagttagatatagttaatcgcttaagtctttttttttttttttgagackgagtctcactctgttgccaggctggagtgcagtggcgctatctcagctcactgcagcctccgcctcccaggttcaagcgattctgcctcagcctcctgagtagctgggactacaggcaccctccacctcgcctggctaattttttgtattttagtagagacggggttttaccgtgttggccaggatggtcttgatctgctgacctcataatctgcccgcctcagcctcccaaagtgctgggattataggcgtgacccactacaactggccaatcgcataaatcttaaacatataccttga

SEQ ID NO: 108879 - DNA, 601 bp, Human
cacacccggccagggtttttttttgtctttttttttttgtattttgtattgtttttgtttttgttttgagatggagtctcactctgtcacccaggctggagtgcagtgatgcgatctcggctcactacaatctccgcctcccgggttcaagccattctcgtgtcttagcctcccgagtggctgggattacatgcttgcgcccccacacccggttaatttttgtatcttaagtaaaggcggggtttcaccatgttggccaggctggtctcaaactcctgacctcaggtgacccacccacctyggcttcccaaagtgctgggattataggcgtgagccactgtgcctgacctgagacactgcgtctctgatgtgcaagatgccaagtgtccctgcccctcaggtccctacctgtgagctaggtggcctggggctctggtagggccagggccaaggctacttgtggcgttcatgaggttaataccctgggacagcctggtgtccactgtgactactgtgacggaaagacaaggggccatgctaagaggtgactttggggtctgtcacctgcatgggggcgcccgctcgctgtttccctcgttca

SEQ ID NO: 108880 - DNA, 601 bp, Human
gtctttttttttttgtattttgtattgtttttgtttttgttttgagatggagtctcactctgtcacccaggctggagtgcagtgatgcgatctcggctcactacaatctccgcctcccgggttcaagccattctcgtgtcttagcctcccgagtggctgggattacatgcttgcgcccccacacccggttaatttttgtatcttaagtaaaggcggggtttcaccatgttggccaggctggtctcaaactcctgacctcaggtgacccacccaccttggcttcccaaagtgctgggattayaggcgtgagccactgtgcctgacctgagacactgcgtctctgatgtgcaagatgccaagtgtccctgcccctcaggtccctacctgtgagctaggtggcctggggctctggtagggccagggccaaggctacttgtggcgttcatgaggttaataccctgggacagcctggtgtccactgtgactactgtgacggaaagacaaggggccatgctaagaggtgactttggggtctgtcacctgcatgggggcgcccgctcgctgtttccctcgttcagttcactccgcctcccaattgatg

SEQ ID NO: 108881 - DNA, 601 bp, Human
cttgttccctcagtccccctgctcagagaaccctctccaattatcccagcccccaacccctctcacccctgcagtatgtcttcctcgcacccacccccgtcagaatgttggcgccagtgtcaccagcacctccccaagtgctcaggagccagtgagaaaggttcgctccttttcatgcaagccatgagctgtgatgttgtccaagtctcgtatcctgtttgtgcctcaggctcctcatcagccgaatgggaggctgacggaaagggattagagctcaggcatcagcttgaactggggcacrtggcgtgacaggcctagtgcctggcaggcaggtccctcgggctctttgtcatcctcaggagtgtggctcgaagacaggtagcatcccaggcctggagagctgactgtgctgcctgtggctgcagagacaggatgcagaggccagggctcgtcccccagagccttgcaagtgtctgtagggcgctcccctctgtcttgcctcctcccactctctggctcttctctatccagcctgccctcaggttgtgaccatccacctcccaaactgccctggaatctgcctacggcctgtccactgccc

SEQ ID NO: 108882 - DNA, 601 bp, Human
gctcctcatcagccgaatgggaggctgacggaaagggattagagctcaggcatcagcttgaactggggcacatggcgtgacaggcctagtgcctggcaggcaggtccctcgggctctttgtcatcctcaggagtgtggctcgaagacaggtagcatcccaggcctggagagctgactgtgctgcctgtggctgcagagacaggatgcagaggccagggctcgtcccccagagccttgcaagtgtctgtagggcgctcccctctgtcttgcctcctcccactctctggctcttctctatccrgcctgccctcaggttgtgaccatccacctcccaaactgccctggaatctgcctacggcctgtccactgccctccgtacccctgcctgccatctctctggtttcgcccctgatgtcactcacatgaaccacagcggtcacccccacctgcctcctgctcctgccctctcctctgccctgcatcagccagaggggggtttaaaagcttacatttgttaataatctggctaaagcttaacatttattgtaatccatccctaaatcccagctggtggcattgctctaacagtgatgaccagcct

SEQ ID NO: 108883 - DNA, 601 bp, Human
acatggcgtgacaggcctagtgcctggcaggcaggtccctcgggctctttgtcatcctcaggagtgtggctcgaagacaggtagcatcccaggcctggagagctgactgtgctgcctgtggctgcagagacaggatgcagaggccagggctcgtcccccagagccttgcaagtgtctgtagggcgctcccctctgtcttgcctcctcccactctctggctcttctctatccagcctgccctcaggttgtgaccatccacctcccaaactgccctggaatctgcctacggcctgtccactgscctccgtacccctgcctgccatctctctggtttcgcccctgatgtcactcacatgaaccacagcggtcacccccacctgcctcctgctcctgccctctcctctgccctgcatcagccagaggggggtttaaaagcttacatttgttaataatctggctaaagcttaacatttattgtaatccatccctaaatcccagctggtggcattgctctaacagtgatgaccagcctcctcatcataatccccagcactgccaccctcaaccccccagcgctgaccactggaggctgcttctaaaa

SEQ ID NO: 108884 - DNA, 601 bp, Human
gcccctgatgtcactcacatgaaccacagcggtcacccccacctgcctcctgctcctgccctctcctctgccctgcatcagccagaggggggtttaaaagcttacatttgttaataatctggctaaagcttaacatttattgtaatccatccctaaatcccagctggtggcattgctctaacagtgatgaccagcctcctcatcataatccccagcactgccaccctcaaccccccagcgctgaccactggaggctgcttctaaaacttcagccctgctctgccagcagcgcccctggggkgtcttcgtagccctgttgcccatcacgatcccttttctcatgcagtccaggctgcaagcccccgccgagggcttgggctgacttgttgtgtagtcagtgctgtgtctctgcacccagccagaagtggtgggacagccccccggctgacgggctagaacccatcatccagggtgtgtggaaagagcacatctcccccccgacgccagccactgggtaatacattcccaggaatttccagtgcccagccccagctgagaaacaggtcttctggaaccctccagcaccctcatcaggggttcc

SEQ ID NO: 108885 - DNA, 601 bp, Human
tctgcacccagccagaagtggtgggacagccccccggctgacgggctagaacccatcatccagggtgtgtggaaagagcacatctcccccccgacgccagccactgggtaatacattcccaggaatttccagtgcccagccccagctgagaaacaggtcttctggaaccctccagcaccctcatcaggggttcccagcatgggtagggccacctgccagctgggaatgattgtagtgctagtgacactcactcagggacccaggatgctgtctcgttctgtacagggcacagctgtacagwaccaattgccctgtgtcctgtacaaattttcaacgatccaaacatctaggtgcaaaacctgtttgaaattctctgtgttggccaggcacggtggctcacacctgtaaacccagcactttgggaggccaaggcgggcagatcacctgaggttgagttcgagaccactctggccaacatagtgaaaccctgtctctactaaaaatacaaaaaaattagccaggcatggtagcgcgtgcatgtaatcccagctactcaggaggctgaggcaggagaatcgcttgaacccgaggcagaggttgc

SEQ ID NO: 108886 - DNA, 601 bp, Human
ggaacttgggtcctgggctgtcattggacattgaattcacgtgttccacatgtgtgaggaaattgaaaaacggctcagtgaacacttacacacccacactgcaagccctcagctgtgaccagaatgccaggtgccatgtgtgctttcttttttcttttttttgagacagagtctcactctgtcacccaggctggagtacagtgatgctatcttggctcactgcaacctccacctcccaggttccagcgattctcctgcctcagcctcccaagtagctgggattacaggtgtgaccctccayggccagctttttttttttttttgtatttttagtagagacagggtttcaccctgttggccaggctggtcttgaactcctgacctcaagtgaccctctcacttcggcctccctaagtgctgggattacgggcatgagccaccacaccggccccatgtgtgcttttcatgtgttatagataacccgattttgctgaacgctttcaaagtcagtagcagacgtggtgacacatccatccttcacgccccagtgcacctccccatgcaataaagacgcctgtctacaaagtcccagcaccatgcc

SEQ ID NO: 108887 - DNA, 601 bp, Human
gagaacgagtcattcccgcatgtcatccacgtcccagtttctactcagcatgtcgccagttgtcccccagatatctggctggttttatagctgctctgctcaatccaatgctatactcttttgtaatctcttcttctcttttcattaaagcagcctccccataatcactttttttattttttttaagagacagggtctcactctgttccccaggccgtgcagtggtgtagtcatagctcactgcggcctcgacctcctgggcccaagcaatcctctccaatcagcctctcgggtagctagsattacaggtgcacacaccaccacacccagctgatttttttttttttttttttttttttttttttttggtagagatgggggttatgttacccaggcaggtcttgaagtcctggcctcaagcaatcctcctgcgtcagcttcccacagtgctgggattataggcatgaaccatcacaccagccctctaccattgctttttattttttattttatttatttatttattttttgagacaaagtcttgctctgtcgccaggctggaatgcagtggcgtgatctcggctcactgcaacatccgcct

SEQ ID NO: 108888 - DNA, 601 bp, Human
ccctcgggcctccttgggaaggatcttgggtcagaagctagacccgggagaggtaagggtctccgtgccccttccctgctaatctgcaacatcagctctgggcgttcaacactcagtttgtgttaatgtcttcttgcggcccttttaaatactctcacactgggaaggcagctgacacacacacccccattctacagatggggaaactgaggcttagccatgctgcctgcctttccaatgggccccagatctgggacctgcatccaggtagatctgacctcaacgccagctctcagcttgkcctcccaagactcctcactttcgtcctctggccccgcccaacctggcgagaaggcgtgtctccagtgagagacagcagccgatgggcccaccacctcttctttatgagctctgctatttcgtacgccaccgatgggccaatgggctgccacctctgggttcaggcgtccaatcagctgtgccaggaatgggcagccccaaagtcctgagagtcactatagaaatcagtgttggtagttttctgtttctcattgagcaggatggggacagatgtgcaaactgcatttttattttattttat

SEQ ID NO: 108889 - DNA, 601 bp, Human
tttgctgggggaacggtgagaagatccagggcagagccccagtgtgcaaagcactgggaccctagcccagcccctgagggttccctgagactaacagctgagccgtgtttgtgctcctgatgggatttgatcgcagtcatatgggagccccggcactgggttctgtgtcattgcattttggggaaactgaggtgctgagagaagggtaggaacccggagctgggtgtcgctaggctgtgaaaccacgaggcaccccgaaaactctcctccctctctccctctcctcacctccccaaaccckgctgtcttttctgttgggctgaaggcaggtcttcccagcaggacctgggcatttcaaaattcttaagtagtgccagcgggcacgtgaccagtgtgctttgaagatagggagggccattctctgaccaagggccttcggtcactctggggctccacaagctcctttgaaacaggaggctccgaagacctccagggtctccaggccagaggtgactgtggcctctggcaaggggctgcttcttcatgtcccaggccccctgaccctgagaaggtggcagcttgcacctgtggctcccttctg

SEQ ID NO: 108890 - DNA, 601 bp, Human
acctccccaaacccggctgtcttttctgttgggctgaaggcaggtcttcccagcaggacctgggcatttcaaaattcttaagtagtgccagcgggcacgtgaccagtgtgctttgaagatagggagggccattctctgaccaagggccttcggtcactctggggctccacaagctcctttgaaacaggaggctccgaagacctccagggtctccaggccagaggtgactgtggcctctggcaaggggctgcttcttcatgtcccaggccccctgaccctgagaaggtggcagcttgcaccygtggctcccttctggggacacctcaaagggcctgaggtgcaggggattgactgtttagcacagtggggccccagttgggggttcctgggagtgatgtcctcctaggttagagcacagattcttttttcatggattttaattaagcagctgctgtatacgagatgctagggggaactgtgatcacaccaagtctctgctctctcagagctccagcttcagtaggggacacaggcttgggagggaggcagaacctctctctagaaaaacccgcaagtacaaccagtgggcccacagttagga

SEQ ID NO: 108891 - DNA, 601 bp, Human
gtctcctcctggtggacgttgaggccattttcatttttttactcttaaaaacgacagggcagtgcacatcttcgcatctccggggtgggtcaggtctctgacctctttgccagtgtgacttattacccctttctttctttgtttttctttttgagacagtgtcttgctctgtcgccaggctggaatgcagtggtgtgatcatagatcatagctcactgcaacctccagctcctggctcaaatgatcctcccacttcagccgatattaatccattttcatgctgctgataaagacgtatttsagaccgggcaatttacaaaagaaagaggtttaatggagttacagttccacacagctgggctggggaagccccacaatcatggcagaaggcaaggaggagcaagtcacatcttatacggatggcagctggcaaagagagtgagagagcttctgcagggaaactcctgtttttaaaaccatcagatctcgtgagacttattctctatcacgagaatagcacgggaaagacccacccccatgattcattgatctcccactgggtccctgctacaacacaagggaattatgggagctacaagat

SEQ ID NO: 108892 - DNA, 601 bp, Human
tccgtgatgaacatgccttatatttgctttgtcctcaatctgtgattcgggactggatttctcttgtttcctggtgggacccacactgcttgtcaattacttattttgttccccttcatcccagtcttgctgtgactttcagatacccccgggtcttatatacactcagggttatacccagaaaacatttctcctgggggatttgtctctaggtagggggccctcttgaatagtcagggggagaaagaaagactcaagaccagctctgaggaggcggcaggggtgccccttccctctacctgtgggctccttggggaagaaggacaagtgagtgccatgagaaatacccctggggattttgtggagctggaatgtgctggtggaccatgaatccacaaggacttgggcatcgaactcccttgactgggacccacagcaagggaggctctgcagcatcaccttaatcaaatggactcaccctctctgggtgatgtatcctggtgcttcctcttctgttcatcagtcaatcaacaaataaatggctgggcgtggaggcatatgcctgtaatcccagaaactttggtcattggttatgtctacc

SEQ ID NO: 108893 - DNA, 601 bp, Human
gctgggcgtggaggcatatgcctgtaatcccagaaactttggtcattggttatgtctacctgtttatttttgggggagggggattcataatatgtcatgacgtatattaacagtttgcaaagtgccacatgggaacgtaatcttcaggatctggaaagaggctcagtctattcagtctataggaacccccgcctcccccaagacccttgtcatgagaacgaatctttcactcccaaattcctagagtgacgatgattgggtcattattttcttttttattttattttattttattttatttatttttttatttttttgagatggagtcttctctgtctcccaggctagagtgcagtggcgcaatctcggctcactacaacctccgcctcccgggttcaagcaattatcctgcctcagcctcctgagtagctgagactacaggcatgtgccaccatgccaggctaattttttgtatttttagtagagacagggtttcaccatgttagtgaggatggtctgaatctcctgaccttgtgatctgcccacctctgcctcccaaagtgctgggattacaggcgtgagctactgtgcccagcctggg

SEQ ID NO: 108894 - DNA, 601 bp, Human
gctcactacaacctccgcctcccgggttcaagcaattatcctgcctcagcctcctgagtagctgagactacaggcatgtgccaccatgccaggctaattttttgtatttttagtagagacagggtttcaccatgttagtgaggatggtctgaatctcctgaccttgtgatctgcccacctctgcctcccaaagtgctgggattacaggcgtgagctactgtgcccagcctgggtcattactttcattcaacaaagcatttctccccgcagtccatgcgcaccctgcccacagctctttctsattttcagcatctctcttccctttctagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacggtaggcagcacgggtggggacccatcactgaccgtttctggtcgttcatggacagtgctatgggtgagcctgtgtacttccactcatgggtatcatgtgcccattcacaaacagttgatatt

SEQ ID NO: 108895 - DNA, 601 bp, Human; identical to SEQ ID NO: 31478

SEQ ID NO: 108896 - DNA, 601 bp, Human; identical to SEQ ID NO: 31479

SEQ ID NO: 108897 - DNA, 601 bp, Human; identical to SEQ ID NO: 31480

SEQ ID NO: 108898 - DNA, 601 bp, Human; identical to SEQ ID NO: 31481

SEQ ID NO: 108899 - DNA, 601 bp, Human; identical to SEQ ID NO: 31482

SEQ ID NO: 108900 - DNA, 601 bp, Human; identical to SEQ ID NO: 31483

SEQ ID NO: 108901 - DNA, 601 bp, Human; identical to SEQ ID NO: 31484

SEQ ID NO: 108902 - DNA, 601 bp, Human; identical to SEQ ID NO: 31485

SEQ ID NO: 108903 - DNA, 601 bp, Human; identical to SEQ ID NO: 31486

SEQ ID NO: 108904 - DNA, 601 bp, Human; identical to SEQ ID NO: 31487

SEQ ID NO: 108905 - DNA, 601 bp, Human; identical to SEQ ID NO: 31488

SEQ ID NO: 108906 - DNA, 601 bp, Human; identical to SEQ ID NO: 31489

SEQ ID NO: 108907 - DNA, 601 bp, Human; identical to SEQ ID NO: 31490

SEQ ID NO: 108908 - DNA, 601 bp, Human; identical to SEQ ID NO: 31491

SEQ ID NO: 108909 - DNA, 601 bp, Human; identical to SEQ ID NO: 31492

SEQ ID NO: 108910 - DNA, 601 bp, Human; identical to SEQ ID NO: 31493

SEQ ID NO: 108911 - DNA, 601 bp, Human; identical to SEQ ID NO: 31494

SEQ ID NO: 108912 - DNA, 601 bp, Human; identical to SEQ ID NO: 31495

SEQ ID NO: 108913 - DNA, 601 bp, Human; identical to SEQ ID NO: 31496

SEQ ID NO: 108914 - DNA, 601 bp, Human; identical to SEQ ID NO: 31497

SEQ ID NO: 108915 - DNA, 601 bp, Human; identical to SEQ ID NO: 31498

SEQ ID NO: 108916 - DNA, 601 bp, Human; identical to SEQ ID NO: 31499

SEQ ID NO: 108917 - DNA, 601 bp, Human; identical to SEQ ID NO: 67939

SEQ ID NO: 108918 - DNA, 601 bp, Human; identical to SEQ ID NO: 67940

SEQ ID NO: 108919 - DNA, 601 bp, Human; identical to SEQ ID NO: 67941

SEQ ID NO: 108920 - DNA, 601 bp, Human; identical to SEQ ID NO: 67942

SEQ ID NO: 108921 - DNA, 601 bp, Human; identical to SEQ ID NO: 67943

SEQ ID NO: 108922 - DNA, 601 bp, Human; identical to SEQ ID NO: 67944

SEQ ID NO: 108923 - DNA, 601 bp, Human; identical to SEQ ID NO: 67945

SEQ ID NO: 108924 - DNA, 601 bp, Human; identical to SEQ ID NO: 67946

SEQ ID NO: 108925 - DNA, 601 bp, Human; identical to SEQ ID NO: 67947

SEQ ID NO: 108926 - DNA, 601 bp, Human; identical to SEQ ID NO: 67948

SEQ ID NO: 108927 - DNA, 601 bp, Human; identical to SEQ ID NO: 67949

SEQ ID NO: 108928 - DNA, 601 bp, Human; identical to SEQ ID NO: 67939

SEQ ID NO: 108929 - DNA, 601 bp, Human; identical to SEQ ID NO: 67940

SEQ ID NO: 108930 - DNA, 601 bp, Human; identical to SEQ ID NO: 67941

SEQ ID NO: 108931 - DNA, 601 bp, Human; identical to SEQ ID NO: 67942

SEQ ID NO: 108932 - DNA, 601 bp, Human; identical to SEQ ID NO: 67943

SEQ ID NO: 108933 - DNA, 601 bp, Human; identical to SEQ ID NO: 67944

SEQ ID NO: 108934 - DNA, 601 bp, Human; identical to SEQ ID NO: 67945

SEQ ID NO: 108935 - DNA, 601 bp, Human; identical to SEQ ID NO: 67946

SEQ ID NO: 108936 - DNA, 601 bp, Human; identical to SEQ ID NO: 67947

SEQ ID NO: 108937 - DNA, 601 bp, Human; identical to SEQ ID NO: 67948

SEQ ID NO: 108938 - DNA, 601 bp, Human; identical to SEQ ID NO: 67949

SEQ ID NO: 108939 - DNA, 601 bp, Human; identical to SEQ ID NO: 67939

SEQ ID NO: 108940 - DNA, 601 bp, Human; identical to SEQ ID NO: 67940

SEQ ID NO: 108941 - DNA, 601 bp, Human; identical to SEQ ID NO: 67941

SEQ ID NO: 108942 - DNA, 601 bp, Human; identical to SEQ ID NO: 67942

SEQ ID NO: 108943 - DNA, 601 bp, Human; identical to SEQ ID NO: 67943

SEQ ID NO: 108944 - DNA, 601 bp, Human; identical to SEQ ID NO: 67944

SEQ ID NO: 108945 - DNA, 601 bp, Human; identical to SEQ ID NO: 67945

SEQ ID NO: 108946 - DNA, 601 bp, Human; identical to SEQ ID NO: 67946

SEQ ID NO: 108947 - DNA, 601 bp, Human; identical to SEQ ID NO: 67947

SEQ ID NO: 108948 - DNA, 601 bp, Human; identical to SEQ ID NO: 67948

SEQ ID NO: 108949 - DNA, 601 bp, Human; identical to SEQ ID NO: 67949

SEQ ID NO: 108950 - DNA, 601 bp, Human; identical to SEQ ID NO: 67939

SEQ ID NO: 108951 - DNA, 601 bp, Human; identical to SEQ ID NO: 67940

SEQ ID NO: 108952 - DNA, 601 bp, Human; identical to SEQ ID NO: 67941

SEQ ID NO: 108953 - DNA, 601 bp, Human; identical to SEQ ID NO: 67942

SEQ ID NO: 108954 - DNA, 601 bp, Human; identical to SEQ ID NO: 67943

SEQ ID NO: 108955 - DNA, 601 bp, Human; identical to SEQ ID NO: 67944

SEQ ID NO: 108956 - DNA, 601 bp, Human; identical to SEQ ID NO: 67945

SEQ ID NO: 108957 - DNA, 601 bp, Human; identical to SEQ ID NO: 67946

SEQ ID NO: 108958 - DNA, 601 bp, Human; identical to SEQ ID NO: 67947

SEQ ID NO: 108959 - DNA, 601 bp, Human; identical to SEQ ID NO: 67948

SEQ ID NO: 108960 - DNA, 601 bp, Human; identical to SEQ ID NO: 67949

SEQ ID NO: 108961 - DNA, 601 bp, Human; identical to SEQ ID NO: 67939

SEQ ID NO: 108962 - DNA, 601 bp, Human; identical to SEQ ID NO: 67940

SEQ ID NO: 108963 - DNA, 601 bp, Human; identical to SEQ ID NO: 67941

SEQ ID NO: 108964 - DNA, 601 bp, Human; identical to SEQ ID NO: 67942

SEQ ID NO: 108965 - DNA, 601 bp, Human; identical to SEQ ID NO: 67943

SEQ ID NO: 108966 - DNA, 601 bp, Human; identical to SEQ ID NO: 67944

SEQ ID NO: 108967 - DNA, 601 bp, Human; identical to SEQ ID NO: 67945

SEQ ID NO: 108968 - DNA, 601 bp, Human; identical to SEQ ID NO: 67946

SEQ ID NO: 108969 - DNA, 601 bp, Human; identical to SEQ ID NO: 67947

SEQ ID NO: 108970 - DNA, 601 bp, Human; identical to SEQ ID NO: 67948

SEQ ID NO: 108971 - DNA, 601 bp, Human; identical to SEQ ID NO: 67949

SEQ ID NO: 108972 - DNA, 601 bp, Human; identical to SEQ ID NO: 67939

SEQ ID NO: 108973 - DNA, 601 bp, Human; identical to SEQ ID NO: 67940

SEQ ID NO: 108974 - DNA, 601 bp, Human; identical to SEQ ID NO: 67941

SEQ ID NO: 108975 - DNA, 601 bp, Human; identical to SEQ ID NO: 67942

SEQ ID NO: 108976 - DNA, 601 bp, Human; identical to SEQ ID NO: 67943

SEQ ID NO: 108977 - DNA, 601 bp, Human; identical to SEQ ID NO: 67944

SEQ ID NO: 108978 - DNA, 601 bp, Human; identical to SEQ ID NO: 67945

SEQ ID NO: 108979 - DNA, 601 bp, Human; identical to SEQ ID NO: 67946

SEQ ID NO: 108980 - DNA, 601 bp, Human; identical to SEQ ID NO: 67947

SEQ ID NO: 108981 - DNA, 601 bp, Human; identical to SEQ ID NO: 67948

SEQ ID NO: 108982 - DNA, 601 bp, Human; identical to SEQ ID NO: 67949

SEQ ID NO: 108983 - DNA, 601 bp, Human; identical to SEQ ID NO: 67939

SEQ ID NO: 108984 - DNA, 601 bp, Human; identical to SEQ ID NO: 67940

SEQ ID NO: 108985 - DNA, 601 bp, Human; identical to SEQ ID NO: 67941

SEQ ID NO: 108986 - DNA, 601 bp, Human; identical to SEQ ID NO: 67942

SEQ ID NO: 108987 - DNA, 601 bp, Human; identical to SEQ ID NO: 67943

SEQ ID NO: 108988 - DNA, 601 bp, Human; identical to SEQ ID NO: 67944

SEQ ID NO: 108989 - DNA, 601 bp, Human; identical to SEQ ID NO: 67945

SEQ ID NO: 108990 - DNA, 601 bp, Human; identical to SEQ ID NO: 67946

SEQ ID NO: 108991 - DNA, 601 bp, Human; identical to SEQ ID NO: 67947

SEQ ID NO: 108992 - DNA, 601 bp, Human; identical to SEQ ID NO: 67948

SEQ ID NO: 108993 - DNA, 601 bp, Human; identical to SEQ ID NO: 67949

SEQ ID NO: 108994 - DNA, 601 bp, Human; identical to SEQ ID NO: 67939

SEQ ID NO: 108995 - DNA, 601 bp, Human; identical to SEQ ID NO: 67940

SEQ ID NO: 108996 - DNA, 601 bp, Human; identical to SEQ ID NO: 67941

SEQ ID NO: 108997 - DNA, 601 bp, Human; identical to SEQ ID NO: 67942

SEQ ID NO: 108998 - DNA, 601 bp, Human; identical to SEQ ID NO: 67943

SEQ ID NO: 108999 - DNA, 601 bp, Human; identical to SEQ ID NO: 67944

SEQ ID NO: 109000 - DNA, 601 bp, Human; identical to SEQ ID NO: 67945

SEQ ID NO: 109001 - DNA, 601 bp, Human; identical to SEQ ID NO: 67946

SEQ ID NO: 109002 - DNA, 601 bp, Human; identical to SEQ ID NO: 67947

SEQ ID NO: 109003 - DNA, 601 bp, Human; identical to SEQ ID NO: 67948

SEQ ID NO: 109004 - DNA, 601 bp, Human; identical to SEQ ID NO: 67949

SEQ ID NO: 109005 - DNA, 601 bp, Human; identical to SEQ ID NO: 67939

SEQ ID NO: 109006 - DNA, 601 bp, Human; identical to SEQ ID NO: 67940

SEQ ID NO: 109007 - DNA, 601 bp, Human; identical to SEQ ID NO: 67941

SEQ ID NO: 109008 - DNA, 601 bp, Human; identical to SEQ ID NO: 67942

SEQ ID NO: 109009 - DNA, 601 bp, Human; identical to SEQ ID NO: 67943

SEQ ID NO: 109010 - DNA, 601 bp, Human; identical to SEQ ID NO: 67944

SEQ ID NO: 109011 - DNA, 601 bp, Human; identical to SEQ ID NO: 67945

SEQ ID NO: 109012 - DNA, 601 bp, Human; identical to SEQ ID NO: 67946

SEQ ID NO: 109013 - DNA, 601 bp, Human; identical to SEQ ID NO: 67947

SEQ ID NO: 109014 - DNA, 601 bp, Human; identical to SEQ ID NO: 67948

SEQ ID NO: 109015 - DNA, 601 bp, Human; identical to SEQ ID NO: 67949

SEQ ID NO: 109016 - DNA, 601 bp, Human; identical to SEQ ID NO: 67939

SEQ ID NO: 109017 - DNA, 601 bp, Human; identical to SEQ ID NO: 67940

SEQ ID NO: 109018 - DNA, 601 bp, Human; identical to SEQ ID NO: 67941

SEQ ID NO: 109019 - DNA, 601 bp, Human; identical to SEQ ID NO: 67942

SEQ ID NO: 109020 - DNA, 601 bp, Human; identical to SEQ ID NO: 67943

SEQ ID NO: 109021 - DNA, 601 bp, Human; identical to SEQ ID NO: 67944

SEQ ID NO: 109022 - DNA, 601 bp, Human; identical to SEQ ID NO: 67945

SEQ ID NO: 109023 - DNA, 601 bp, Human; identical to SEQ ID NO: 67946

SEQ ID NO: 109024 - DNA, 601 bp, Human; identical to SEQ ID NO: 67947

SEQ ID NO: 109025 - DNA, 601 bp, Human; identical to SEQ ID NO: 67948

SEQ ID NO: 109026 - DNA, 601 bp, Human; identical to SEQ ID NO: 67949

SEQ ID NO: 109027 - DNA, 601 bp, Human; identical to SEQ ID NO: 67939

SEQ ID NO: 109028 - DNA, 601 bp, Human; identical to SEQ ID NO: 67940

SEQ ID NO: 109029 - DNA, 601 bp, Human; identical to SEQ ID NO: 67941

SEQ ID NO: 109030 - DNA, 601 bp, Human; identical to SEQ ID NO: 67942

SEQ ID NO: 109031 - DNA, 601 bp, Human; identical to SEQ ID NO: 67943

SEQ ID NO: 109032 - DNA, 601 bp, Human; identical to SEQ ID NO: 67944

SEQ ID NO: 109033 - DNA, 601 bp, Human; identical to SEQ ID NO: 67945

SEQ ID NO: 109034 - DNA, 601 bp, Human; identical to SEQ ID NO: 67946

SEQ ID NO: 109035 - DNA, 601 bp, Human; identical to SEQ ID NO: 67947

SEQ ID NO: 109036 - DNA, 601 bp, Human; identical to SEQ ID NO: 67948

SEQ ID NO: 109037 - DNA, 601 bp, Human; identical to SEQ ID NO: 67949

SEQ ID NO: 109038 - DNA, 601 bp, Human; identical to SEQ ID NO: 67939

SEQ ID NO: 109039 - DNA, 601 bp, Human; identical to SEQ ID NO: 67940

SEQ ID NO: 109040 - DNA, 601 bp, Human; identical to SEQ ID NO: 67941

SEQ ID NO: 109041 - DNA, 601 bp, Human; identical to SEQ ID NO: 67942

SEQ ID NO: 109042 - DNA, 601 bp, Human; identical to SEQ ID NO: 67943

SEQ ID NO: 109043 - DNA, 601 bp, Human; identical to SEQ ID NO: 67944

SEQ ID NO: 109044 - DNA, 601 bp, Human; identical to SEQ ID NO: 67945

SEQ ID NO: 109045 - DNA, 601 bp, Human; identical to SEQ ID NO: 67946

SEQ ID NO: 109046 - DNA, 601 bp, Human; identical to SEQ ID NO: 67947

SEQ ID NO: 109047 - DNA, 601 bp, Human; identical to SEQ ID NO: 67948

SEQ ID NO: 109048 - DNA, 601 bp, Human; identical to SEQ ID NO: 67949

SEQ ID NO: 109049 - DNA, 601 bp, Human; identical to SEQ ID NO: 67939

SEQ ID NO: 109050 - DNA, 601 bp, Human; identical to SEQ ID NO: 67940

SEQ ID NO: 109051 - DNA, 601 bp, Human; identical to SEQ ID NO: 67941

SEQ ID NO: 109052 - DNA, 601 bp, Human; identical to SEQ ID NO: 67942

SEQ ID NO: 109053 - DNA, 601 bp, Human; identical to SEQ ID NO: 67943

SEQ ID NO: 109054 - DNA, 601 bp, Human; identical to SEQ ID NO: 67944

SEQ ID NO: 109055 - DNA, 601 bp, Human; identical to SEQ ID NO: 67945

SEQ ID NO: 109056 - DNA, 601 bp, Human; identical to SEQ ID NO: 67946

SEQ ID NO: 109057 - DNA, 601 bp, Human; identical to SEQ ID NO: 67947

SEQ ID NO: 109058 - DNA, 601 bp, Human; identical to SEQ ID NO: 67948

SEQ ID NO: 109059 - DNA, 601 bp, Human; identical to SEQ ID NO: 67949

SEQ ID NO: 109060 - DNA, 601 bp, Human; identical to SEQ ID NO: 67939

SEQ ID NO: 109061 - DNA, 601 bp, Human; identical to SEQ ID NO: 67940

SEQ ID NO: 109062 - DNA, 601 bp, Human; identical to SEQ ID NO: 67941

SEQ ID NO: 109063 - DNA, 601 bp, Human; identical to SEQ ID NO: 67942

SEQ ID NO: 109064 - DNA, 601 bp, Human; identical to SEQ ID NO: 67943

SEQ ID NO: 109065 - DNA, 601 bp, Human; identical to SEQ ID NO: 67944

SEQ ID NO: 109066 - DNA, 601 bp, Human; identical to SEQ ID NO: 67945

SEQ ID NO: 109067 - DNA, 601 bp, Human; identical to SEQ ID NO: 67946

SEQ ID NO: 109068 - DNA, 601 bp, Human; identical to SEQ ID NO: 67947

SEQ ID NO: 109069 - DNA, 601 bp, Human; identical to SEQ ID NO: 67948

SEQ ID NO: 109070 - DNA, 601 bp, Human; identical to SEQ ID NO: 67949

SEQ ID NO: 109071 - DNA, 601 bp, Human; identical to SEQ ID NO: 67939

SEQ ID NO: 109072 - DNA, 601 bp, Human; identical to SEQ ID NO: 67940

SEQ ID NO: 109073 - DNA, 601 bp, Human; identical to SEQ ID NO: 67941

SEQ ID NO: 109074 - DNA, 601 bp, Human; identical to SEQ ID NO: 67942

SEQ ID NO: 109075 - DNA, 601 bp, Human; identical to SEQ ID NO: 67943

SEQ ID NO: 109076 - DNA, 601 bp, Human; identical to SEQ ID NO: 67944

SEQ ID NO: 109077 - DNA, 601 bp, Human; identical to SEQ ID NO: 67945

SEQ ID NO: 109078 - DNA, 601 bp, Human; identical to SEQ ID NO: 67946

SEQ ID NO: 109079 - DNA, 601 bp, Human; identical to SEQ ID NO: 67947

SEQ ID NO: 109080 - DNA, 601 bp, Human; identical to SEQ ID NO: 67948

SEQ ID NO: 109081 - DNA, 601 bp, Human; identical to SEQ ID NO: 67949

SEQ ID NO: 109082 - DNA, 601 bp, Human; identical to SEQ ID NO: 67939

SEQ ID NO: 109083 - DNA, 601 bp, Human; identical to SEQ ID NO: 67940

SEQ ID NO: 109084 - DNA, 601 bp, Human; identical to SEQ ID NO: 67941

SEQ ID NO: 109085 - DNA, 601 bp, Human; identical to SEQ ID NO: 67942

SEQ ID NO: 109086 - DNA, 601 bp, Human; identical to SEQ ID NO: 67943

SEQ ID NO: 109087 - DNA, 601 bp, Human; identical to SEQ ID NO: 67944

SEQ ID NO: 109088 - DNA, 601 bp, Human; identical to SEQ ID NO: 67945

SEQ ID NO: 109089 - DNA, 601 bp, Human; identical to SEQ ID NO: 67946

SEQ ID NO: 109090 - DNA, 601 bp, Human; identical to SEQ ID NO: 67947

SEQ ID NO: 109091 - DNA, 601 bp, Human; identical to SEQ ID NO: 67948

SEQ ID NO: 109092 - DNA, 601 bp, Human; identical to SEQ ID NO: 67949

SEQ ID NO: 109093 - DNA, 601 bp, Human; identical to SEQ ID NO: 67939

SEQ ID NO: 109094 - DNA, 601 bp, Human; identical to SEQ ID NO: 67940

SEQ ID NO: 109095 - DNA, 601 bp, Human; identical to SEQ ID NO: 67941

SEQ ID NO: 109096 - DNA, 601 bp, Human; identical to SEQ ID NO: 67942

SEQ ID NO: 109097 - DNA, 601 bp, Human; identical to SEQ ID NO: 67943

SEQ ID NO: 109098 - DNA, 601 bp, Human; identical to SEQ ID NO: 67944

SEQ ID NO: 109099 - DNA, 601 bp, Human; identical to SEQ ID NO: 67945

SEQ ID NO: 109100 - DNA, 601 bp, Human; identical to SEQ ID NO: 67946

SEQ ID NO: 109101 - DNA, 601 bp, Human; identical to SEQ ID NO: 67947

SEQ ID NO: 109102 - DNA, 601 bp, Human; identical to SEQ ID NO: 67948

SEQ ID NO: 109103 - DNA, 601 bp, Human; identical to SEQ ID NO: 67949

SEQ ID NO: 109104 - DNA, 601 bp, Human; identical to SEQ ID NO: 67939

SEQ ID NO: 109105 - DNA, 601 bp, Human; identical to SEQ ID NO: 67940

SEQ ID NO: 109106 - DNA, 601 bp, Human; identical to SEQ ID NO: 67941

SEQ ID NO: 109107 - DNA, 601 bp, Human; identical to SEQ ID NO: 67942

SEQ ID NO: 109108 - DNA, 601 bp, Human; identical to SEQ ID NO: 67943

SEQ ID NO: 109109 - DNA, 601 bp, Human; identical to SEQ ID NO: 67944

SEQ ID NO: 109110 - DNA, 601 bp, Human; identical to SEQ ID NO: 67945

SEQ ID NO: 109111 - DNA, 601 bp, Human; identical to SEQ ID NO: 67946

SEQ ID NO: 109112 - DNA, 601 bp, Human; identical to SEQ ID NO: 67947

SEQ ID NO: 109113 - DNA, 601 bp, Human; identical to SEQ ID NO: 67948

SEQ ID NO: 109114 - DNA, 601 bp, Human; identical to SEQ ID NO: 67949

SEQ ID NO: 109115 - DNA, 601 bp, Human; identical to SEQ ID NO: 67939

SEQ ID NO: 109116 - DNA, 601 bp, Human; identical to SEQ ID NO: 67940

SEQ ID NO: 109117 - DNA, 601 bp, Human; identical to SEQ ID NO: 67941

SEQ ID NO: 109118 - DNA, 601 bp, Human; identical to SEQ ID NO: 67942

SEQ ID NO: 109119 - DNA, 601 bp, Human; identical to SEQ ID NO: 67943

SEQ ID NO: 109120 - DNA, 601 bp, Human; identical to SEQ ID NO: 67944

SEQ ID NO: 109121 - DNA, 601 bp, Human; identical to SEQ ID NO: 67945

SEQ ID NO: 109122 - DNA, 601 bp, Human; identical to SEQ ID NO: 67946

SEQ ID NO: 109123 - DNA, 601 bp, Human; identical to SEQ ID NO: 67947

SEQ ID NO: 109124 - DNA, 601 bp, Human; identical to SEQ ID NO: 67948

SEQ ID NO: 109125 - DNA, 601 bp, Human; identical to SEQ ID NO: 67949

SEQ ID NO: 109126 - DNA, 601 bp, Human; identical to SEQ ID NO: 67939

SEQ ID NO: 109127 - DNA, 601 bp, Human; identical to SEQ ID NO: 67940

SEQ ID NO: 109128 - DNA, 601 bp, Human; identical to SEQ ID NO: 67941

SEQ ID NO: 109129 - DNA, 601 bp, Human; identical to SEQ ID NO: 67942

SEQ ID NO: 109130 - DNA, 601 bp, Human; identical to SEQ ID NO: 67943

SEQ ID NO: 109131 - DNA, 601 bp, Human; identical to SEQ ID NO: 67944

SEQ ID NO: 109132 - DNA, 601 bp, Human; identical to SEQ ID NO: 67945

SEQ ID NO: 109133 - DNA, 601 bp, Human; identical to SEQ ID NO: 67946

SEQ ID NO: 109134 - DNA, 601 bp, Human; identical to SEQ ID NO: 67947

SEQ ID NO: 109135 - DNA, 601 bp, Human; identical to SEQ ID NO: 67948

SEQ ID NO: 109136 - DNA, 601 bp, Human; identical to SEQ ID NO: 67949

SEQ ID NO: 109137 - DNA, 601 bp, Human
gcccattagaaggggagcaaccagagtgcagactctgtcttgctcatctttgtgtgaaaatggtgtgtttagggcagtgccttccaaagcaggtgcttagtaaatatatgtttgggtgaattggtgccttctttcctctacctgtagaatggacacaatatttgctacctttttcctatgcttggaaataaatgaaattctgataataacagagaaagagtccaaagtagtagatttaagtgttccttaaatcccaccttctattccattaagtttctgcttatagagaggttctatagaytgctgaacaaattaaatgcagatactagatgtgatggggtttaaataatcttacatctgcaggcaggagacggaggacagatgacatgatggacaccagccacatttccatcactgcgctcaccgtcctctcttcctgtcacctcccatgctcccctatcccctccattagcaggcatctttcccagttttctccccctacccctacactccttgctttcttccctccatcaggccatactaaagtgttttcagacaagattggacacattcacagtggtatggccattcaactgttttc

SEQ ID NO: 109138 - DNA, 601 bp, Human
cttcatctgcccactcacagcccattagaaggggagcaaccagagtgcagactctgtcttgctcatctttgtgtgaaaatggtgtgtttagggcagtgccttccaaagcaggtgcttagtaaatatatgtttgggtgaattggtgccttctttcctctacctgtagaatggacacaatatttgctacctttttcctatgcttggaaataaatgaaattctgataataacagagaaagagtccaaagtagtagatttaagtgttccttaaatcccaccttctattccattaagtttctgctkatagagaggttctatagactgctgaacaaattaaatgcagatactagatgtgatggggtttaaataatcttacatctgcaggcaggagacggaggacagatgacatgatggacaccagccacatttccatcactgcgctcaccgtcctctcttcctgtcacctcccatgctcccctatcccctccattagcaggcatctttcccagttttctccccctacccctacactccttgctttcttccctccatcaggccatactaaagtgttttcagacaagattggacacattcacagtggta

SEQ ID NO: 109139 - DNA, 601 bp, Human
cccctgactctaccaccctctccccgtgctccttctctcctttcacagttacctgtgtgtgtcttcatctgcccactcacagcccattagaaggggagcaaccagagtgcagactctgtcttgctcatctttgtgtgaaaatggtgtgtttagggcagtgccttccaaagcaggtgcttagtaaatatatgtttgggtgaattggtgccttctttcctctacctgtagaatggacacaatatttgctacctttttcctatgcttggaaataaatgaaattctgataataacagagaaagartccaaagtagtagatttaagtgttccttaaatcccaccttctattccattaagtttctgcttatagagaggttctatagactgctgaacaaattaaatgcagatactagatgtgatggggtttaaataatcttacatctgcaggcaggagacggaggacagatgacatgatggacaccagccacatttccatcactgcgctcaccgtcctctcttcctgtcacctcccatgctcccctatcccctccattagcaggcatctttcccagttttctccccctacccctacactccttgcttt

SEQ ID NO: 109140 - DNA, 601 bp, Human
tgccagtgcacacgcttcccctgactctaccaccctctccccgtgctccttctctcctttcacagttacctgtgtgtgtcttcatctgcccactcacagcccattagaaggggagcaaccagagtgcagactctgtcttgctcatctttgtgtgaaaatggtgtgtttagggcagtgccttccaaagcaggtgcttagtaaatatatgtttgggtgaattggtgccttctttcctctacctgtagaatggacacaatatttgctacctttttcctatgcttggaaataaatgaaattctgmtaataacagagaaagagtccaaagtagtagatttaagtgttccttaaatcccaccttctattccattaagtttctgcttatagagaggttctatagactgctgaacaaattaaatgcagatactagatgtgatggggtttaaataatcttacatctgcaggcaggagacggaggacagatgacatgatggacaccagccacatttccatcactgcgctcaccgtcctctcttcctgtcacctcccatgctcccctatcccctccattagcaggcatctttcccagttttctccccctacc

SEQ ID NO: 109141 - DNA, 601 bp, Human
cccctgcagtgagttcagtatcatgtggtctgggagaaagcctcctaaatcctgggaatttcccccacccccggccctgggtttcctctgcagggctaaagccagtaacggcatctgcatcagagtcggcttttagaatgccagtgcacacgcttcccctgactctaccaccctctccccgtgctccttctctcctttcacagttacctgtgtgtgtcttcatctgcccactcacagcccattagaaggggagcaaccagagtgcagactctgtcttgctcatctttgtgtgaaaatggtstgtttagggcagtgccttccaaagcaggtgcttagtaaatatatgtttgggtgaattggtgccttctttcctctacctgtagaatggacacaatatttgctacctttttcctatgcttggaaataaatgaaattctgataataacagagaaagagtccaaagtagtagatttaagtgttccttaaatcccaccttctattccattaagtttctgcttatagagaggttctatagactgctgaacaaattaaatgcagatactagatgtgatggggtttaaataatcttacatctgcaggc

SEQ ID NO: 109142 - DNA, 601 bp, Human
agagaaattaatctgccatttctccaatgttatcaggcccctgcagtgagttcagtatcatgtggtctgggagaaagcctcctaaatcctgggaatttcccccacccccggccctgggtttcctctgcagggctaaagccagtaacggcatctgcatcagagtcggcttttagaatgccagtgcacacgcttcccctgactctaccaccctctccccgtgctccttctctcctttcacagttacctgtgtgtgtcttcatctgcccactcacagcccattagaaggggagcaaccagagtrcagactctgtcttgctcatctttgtgtgaaaatggtgtgtttagggcagtgccttccaaagcaggtgcttagtaaatatatgtttgggtgaattggtgccttctttcctctacctgtagaatggacacaatatttgctacctttttcctatgcttggaaataaatgaaattctgataataacagagaaagagtccaaagtagtagatttaagtgttccttaaatcccaccttctattccattaagtttctgcttatagagaggttctatagactgctgaacaaattaaatgcagatacta

SEQ ID NO: 109143 - DNA, 601 bp, Human
ttctccattctatcatctcatcctattgcattcatctaaagcttatcacaaagagaaattaatctgccatttctccaatgttatcaggcccctgcagtgagttcagtatcatgtggtctgggagaaagcctcctaaatcctgggaatttcccccacccccggccctgggtttcctctgcagggctaaagccagtaacggcatctgcatcagagtcggcttttagaatgccagtgcacacgcttcccctgactctaccaccctctccccgtgctccttctctcctttcacagttacctgtgkgtgtcttcatctgcccactcacagcccattagaaggggagcaaccagagtgcagactctgtcttgctcatctttgtgtgaaaatggtgtgtttagggcagtgccttccaaagcaggtgcttagtaaatatatgtttgggtgaattggtgccttctttcctctacctgtagaatggacacaatatttgctacctttttcctatgcttggaaataaatgaaattctgataataacagagaaagagtccaaagtagtagatttaagtgttccttaaatcccaccttctattccattaagtttc

SEQ ID NO: 109144 - DNA, 601 bp, Human
acacttccatctactctctttccctgtgccttggggctcctccctatgccaccatcctcatgaaaaaatggaaaaagtcacattaaccaccacagactggagatctaaaaacttagggagctgcaaggtcaatcttgcattgaactccaaagtgatattcacttttacccacggccaatttgtcccagtgatgactaattctctgatgttccagatatccagagatcacactgggcaggggtctgttcttggcagtctgcatgctgctactgactcaaatcctccctaaacccctcaccaygtgatagaacagggtttacttggctttatgtcctgggtccattttgctggatatattttctccattctatcatctcatcctattgcattcatctaaagcttatcacaaagagaaattaatctgccatttctccaatgttatcaggcccctgcagtgagttcagtatcatgtggtctgggagaaagcctcctaaatcctgggaatttcccccacccccggccctgggtttcctctgcagggctaaagccagtaacggcatctgcatcagagtcggcttttagaatgccagtgcacacgctt

SEQ ID NO: 109145 - DNA, 601 bp, Human
ggcagaaccagactctgtattaaatgaaaagtacccacctctcttctctccatccctcgtttctgcttctaatctgaaaggacaaacttctactgagacaacagagttttctggccctataagttgtcacaggcctccaggcatcgtaagagaccatcgtgaggaaggggatcctagtgctcagaacacttccatctactctctttccctgtgccttggggctcctccctatgccaccatcctcatgaaaaaatggaaaaagtcacattaaccaccacagactggagatctaaaaacttarggagctgcaaggtcaatcttgcattgaactccaaagtgatattcacttttacccacggccaatttgtcccagtgatgactaattctctgatgttccagatatccagagatcacactgggcaggggtctgttcttggcagtctgcatgctgctactgactcaaatcctccctaaacccctcaccacgtgatagaacagggtttacttggctttatgtcctgggtccattttgctggatatattttctccattctatcatctcatcctattgcattcatctaaagcttatcacaaagagaaa

SEQ ID NO: 109146 - DNA, 601 bp, Human
ggtgcctacataatcaaccccaaataaaaaccctggccgcctgggctcaggtgaccttccctggtaggcatgtcaaaagaagtgtcatgacttgcttctagggggaattacgtgcatcctgtatgactccaggtggaagggactcttggaagcttgtgcctggtctccgggagatgtcaccccatccacctctccctttgctgagtttgctgtttactttttgctgtaacaaattatagccataactatatgctaagttctgtgaatcttcctagcaaatggttgaacctgggggtggtcytgggggccaccaacctacccttatcattctcttccatagcaccttcttcttgaccttcttagcgttaccacagtttgtaattaaactgtgcatctttttcactaagttccatgagattaactacatgtgtcggttaccactatatactacacaaatattcaataaagctgataaataaaaataagggaaaagcagctcagctattaataaaagataacctgctggagagtgaatataacagagttttccgggcaccactcctttttagattctggaatccctgagagtcactcaaattaa

SEQ ID NO: 109147 - DNA, 601 bp, Human
ttggatttttaccattccctgataagaacagttcactgtgcctaaattgttcacgcaaacaataatttatgttgagcatctgctttccttctgggagtttggaattttggtttgtgctaggctaagggtgcctacataatcaaccccaaataaaaaccctggccgcctgggctcaggtgaccttccctggtaggcatgtcaaaagaagtgtcatgacttgcttctagggggaattacgtgcatcctgtatgactccaggtggaagggactcttggaagcttgtgcctggtctccgggagaygtcaccccatccacctctccctttgctgagtttgctgtttactttttgctgtaacaaattatagccataactatatgctaagttctgtgaatcttcctagcaaatggttgaacctgggggtggtcttgggggccaccaacctacccttatcattctcttccatagcaccttcttcttgaccttcttagcgttaccacagtttgtaattaaactgtgcatctttttcactaagttccatgagattaactacatgtgtcggttaccactatatactacacaaatattcaataaagctgataa

SEQ ID NO: 109148 - DNA, 601 bp, Human
agggggaaagctagcattgtggttagtgggcaggaaagaggaggaggaagttgcatttcaagagtagatcacacctattttgtcctccaacttagcaacatctatacacttttgatgtgcatactctttgaaccatcatcaatctgcttctaaaattttacccaacagacataattgtacagaagtatgcaaagatatacataaaggatattcattgctacattatttgaaatagcaaattatcagcagttgtttaaaaaagagaaatagatgtgtactcgtgtggaaagacaaccaagayacaatggtaactgaaaaattaaattacagaggactacgtgtctataatgtacttattttaatcttaaaaagatgtaccaacatgcagaatagggtatattctgacccatcaaaagatgggtcaaggagtgggaaagaagacttattttatatatttctacaatactttaattttttatgagcttacatttaatttctaataaaaacccagtacctgcaatctaaaacaatattcttgtatagaaaagagctaacacagcaggcctgcatctgctatccttagaaaggctgcttgacccct

SEQ ID NO: 109149 - DNA, 601 bp, Human
agagttctcaagccctcctccagctagggtctggttagccagagcccttcttggttaatctcagtgctgccagccaacatcaccacatctcagggttgttgctgggatggggacaggggtggcaaaaaggtcactggctctttagacgttttagctggtgagggggaaagctagcattgtggttagtgggcaggaaagaggaggaggaagttgcatttcaagagtagatcacacctattttgtcctccaacttagcaacatctatacacttttgatgtgcatactctttgaaccatcatcratctgcttctaaaattttacccaacagacataattgtacagaagtatgcaaagatatacataaaggatattcattgctacattatttgaaatagcaaattatcagcagttgtttaaaaaagagaaatagatgtgtactcgtgtggaaagacaaccaagatacaatggtaactgaaaaattaaattacagaggactacgtgtctataatgtacttattttaatcttaaaaagatgtaccaacatgcagaatagggtatattctgacccatcaaaagatgggtcaaggagtgggaaagaaga

SEQ ID NO: 109150 - DNA, 601 bp, Human
agcgttacaattttaatgtaatgacatagaaccttgtatctttctaggttttcatttttctttaatatggagttagaaacatatgcctcatagggctactatgaaaactaaaaattttaaagaaaatagactcatcactcagtaaatgatgagctttaaagatactaaaatgacagatgctgccagacatgcccatctgcccaaatggtgtagagcatacttagaatcactctttgatttgcagctgcagtctgtgtatagcccatctgcaggtttatggtgatacagcaacaatctttgytttctgtcttttgagacgtctgaaacaggctaggaggggctcagggtagagagttctcaagccctcctccagctagggtctggttagccagagcccttcttggttaatctcagtgctgccagccaacatcaccacatctcagggttgttgctgggatggggacaggggtggcaaaaaggtcactggctctttagacgttttagctggtgagggggaaagctagcattgtggttagtgggcaggaaagaggaggaggaagttgcatttcaagagtagatcacacctattttgtcctccaac

SEQ ID NO: 109151 - DNA, 601 bp, Human
ttacttaagtctctatttacagctccgatagctgagaaagcaattagctacattacaaccgctcagacaatggaactggcttcactaattacattctcattaacaccctgttatttcactgctcgtagtgggagttcttcgaacatccctttggttggtagagtatatgggtgtcttctatcccctactgcttaattattcatgatgacttgttaatttcttatcaaggatgtcacccaacagaaaaaaaaagtctctcataaaataaaagtactttaggtaaaattatgaatttacaaayaggatttgagatttagctgtgctaaatgaaaaccaataaaaaattaagcgttacaattttaatgtaatgacatagaaccttgtatctttctaggttttcatttttctttaatatggagttagaaacatatgcctcatagggctactatgaaaactaaaaattttaaagaaaatagactcatcactcagtaaatgatgagctttaaagatactaaaatgacagatgctgccagacatgcccatctgcccaaatggtgtagagcatacttagaatcactctttgatttgcagctgcagtctg

SEQ ID NO: 109152 - DNA, 601 bp, Human
ctaggttttaattgtaggtccctgtcattgagactgcacttggaagtggtaggatctctgagattcagaggtggatgagtttgttggaaaattaattctgggaaggaggtgtagggttcatgaactcagggtaagtagctttgggccaaggtggtctctggaccacattcatctcaagatcccttatgctgggatagagtggaaagatggcactgggatgcctgtcccatagcccagaaatactgcccagtacaccctcactgcccagcacatgctggcacaaacacgtgacccacagctygtccctctgacctacatgtagtggtggccaggaataggcaatcttcagaggaaaaacattctccttttaaagttttctttttctcctggttgataaattattccttttcacaataaataaaaactggaaaactggaaaaaaaaaaaaaggaaaacctccatcctttagtatttaaagaaaatgactctgttaataacttgaagtcatgttttaaagaggcatctctttacttaagtctctatttacagctccgatagctgagaaagcaattagctacattacaaccgctcagacaatgga

SEQ ID NO: 109153 - DNA, 601 bp, Human
ggactctcctgtatcataagggagacgatattgttttgtcaactaaaaagttatcctacatagtaccctgcttggtttaagtattggtagaagcttttcaaataccagcacatcttaaacaggaagcaaagtacatttgagaacattttatagtatgtttattatctcaagctcctattcagaaaataagttaaaaaattaaaagtaaacataagatttttaaaaagcaaacttatttggtcaaaacaaggtgtgtgtatataaccttttaaaaacacatcagtgtggaaagcaatggacrtgtgtacttgtcattccttgacaagctgaagtcaagccataagcagcaggagggagaaggggagtgaacacctgggccttgtgtgagctgttcctgcgactcctgtgctgtaatttgggtaccaacatgaccaaggttcagtctggtgaatttgtattttattttaaaatctaggttttaattgtaggtccctgtcattgagactgcacttggaagtggtaggatctctgagattcagaggtggatgagtttgttggaaaattaattctgggaaggaggtgtagggttcatgaactcagg

SEQ ID NO: 109154 - DNA, 601 bp, Human
actggtgtctcttccccagaatcttttctttaaaaagaaatctatggctgtaaacataataaacacattttcctttcaatcaattctttttacatgactaatggtaccctttggagggaaaaatctctgacatttagatgaatattttaaaagggttttaaataggctttggaggaaaagtctcagtacttcattttttttggaagacaacatggactctcctgtatcataagggagacgatattgttttgtcaactaaaaagttatcctacatagtaccctgcttggtttaagtattggyagaagcttttcaaataccagcacatcttaaacaggaagcaaagtacatttgagaacattttatagtatgtttattatctcaagctcctattcagaaaataagttaaaaaattaaaagtaaacataagatttttaaaaagcaaacttatttggtcaaaacaaggtgtgtgtatataaccttttaaaaacacatcagtgtggaaagcaatggacgtgtgtacttgtcattccttgacaagctgaagtcaagccataagcagcaggagggagaaggggagtgaacacctgggccttgtgtgag

SEQ ID NO: 109155 - DNA, 601 bp, Human
acataaagttaaaataagacatagtataagaacagtttgactggtgtctcttccccagaatcttttctttaaaaagaaatctatggctgtaaacataataaacacattttcctttcaatcaattctttttacatgactaatggtaccctttggagggaaaaatctctgacatttagatgaatattttaaaagggttttaaataggctttggaggaaaagtctcagtacttcattttttttggaagacaacatggactctcctgtatcataagggagacgatattgttttgtcaactaaaargttatcctacatagtaccctgcttggtttaagtattggtagaagcttttcaaataccagcacatcttaaacaggaagcaaagtacatttgagaacattttatagtatgtttattatctcaagctcctattcagaaaataagttaaaaaattaaaagtaaacataagatttttaaaaagcaaacttatttggtcaaaacaaggtgtgtgtatataaccttttaaaaacacatcagtgtggaaagcaatggacgtgtgtacttgtcattccttgacaagctgaagtcaagccataagcagca

SEQ ID NO: 109156 - DNA, 601 bp, Human
gaaatcacacctactcgtttgtgtttataagaatataaaagatatttcctctgaaacagacacataaagttaaaataagacatagtataagaacagtttgactggtgtctcttccccagaatcttttctttaaaaagaaatctatggctgtaaacataataaacacattttcctttcaatcaattctttttacatgactaatggtaccctttggagggaaaaatctctgacatttagatgaatattttaaaagggttttaaataggctttggaggaaaagtctcagtacttcattttttttggaagacaacatggactctcctgtatcataagggagacgatattgttttgtcaactaaaaagttatcctacatagtaccctgcttggtttaagtattggtagaagcttttcaaataccagcacatcttaaacaggaagcaaagtacatttgagaacattttatagtatgtttattatctcaagctcctattcagaaaataagttaaaaaattaaaagtaaacataagatttttaaaaagcaaacttatttggtcaaaacaaggtgtgtgtatataaccttttaaaaacacatcagtgtgg

SEQ ID NO: 109157 - DNA, 601 bp, Human
ttagcattaggtatacctcctaatgctatctacatacataacaaacctgcacgttgtgcacatgtaccctaaaacttaaagtataataataataaaataaaataaaaagtcaattacagctgacacatagctgttaccttggaaatcacacctactcgtttgtgtttataagaatataaaagatatttcctctgaaacagacacataaagttaaaataagacatagtataagaacagtttgactggtgtctcttccccagaatcttttctttaaaaagaaatctatggctgtaaacataayaaacacattttcctttcaatcaattctttttacatgactaatggtaccctttggagggaaaaatctctgacatttagatgaatattttaaaagggttttaaataggctttggaggaaaagtctcagtacttcattttttttggaagacaacatggactctcctgtatcataagggagacgatattgttttgtcaactaaaaagttatcctacatagtaccctgcttggtttaagtattggtagaagcttttcaaataccagcacatcttaaacaggaagcaaagtacatttgagaacatt

SEQ ID NO: 109158 - DNA, 601 bp, Human
aatcaaaaagggactaagaagcatgaaaaaactttgtaaaggccatttggcagtttaaaaaaagtcaatatgcaggtttgttacatatgtatacatatgtatacatgtgccatgttggtgtgctgcacccattaactcgtcatttagcattaggtatacctcctaatgctatctacatacataacaaacctgcacgttgtgcacatgtaccctaaaacttaaagtataataataataaaataaaataaaaagtcaattacagctgacacatagctgttaccttggaaatcacacctactcrtttgtgtttataagaatataaaagatatttcctctgaaacagacacataaagttaaaataagacatagtataagaacagtttgactggtgtctcttccccagaatcttttctttaaaaagaaatctatggctgtaaacataataaacacattttcctttcaatcaattctttttacatgactaatggtaccctttggagggaaaaatctctgacatttagatgaatattttaaaagggttttaaataggctttggaggaaaagtctcagtacttcattttttttggaagacaacatggac

SEQ ID NO: 109159 - DNA, 601 bp, Human
agctagcacctccagacaaaccaatattttcctgtcacttgtttaaaacctgtacatagggactggctttggtattctctgctattcattcctatatatagcttttaaaagcctggggcaaatcaaaaagggactaagaagcatgaaaaaactttgtaaaggccatttggcagtttaaaaaaagtcaatatgcaggtttgttacatatgtatacatatgtatacatgtgccatgttggtgtgctgcacccattaactcgtcatttagcattaggtatacctcctaatgctatctacatacrtaacaaacctgcacgttgtgcacatgtaccctaaaacttaaagtataataataataaaataaaataaaaagtcaattacagctgacacatagctgttaccttggaaatcacacctactcgtttgtgtttataagaatataaaagatatttcctctgaaacagacacataaagttaaaataagacatagtataagaacagtttgactggtgtctcttccccagaatcttttctttaaaaagaaatctatggctgtaaacataataaacacattttcctttcaatcaattctttttacatga

SEQ ID NO: 109160 - DNA, 601 bp, Human
agctgactgagcagtaagagagctgccacaatttaccttagggcagccacccgggcatttctcacaatttgtccccttcgaactcaaacactcaagctagcacctccagacaaaccaatattttcctgtcacttgtttaaaacctgtacatagggactggctttggtattctctgctattcattcctatatatagcttttaaaagcctggggcaaatcaaaaagggactaagaagcatgaaaaaactttgtaaaggccatttggcagtttaaaaaaagtcaatatgcaggtttgttacatmtgtatacatatgtatacatgtgccatgttggtgtgctgcacccattaactcgtcatttagcattaggtatacctcctaatgctatctacatacataacaaacctgcacgttgtgcacatgtaccctaaaacttaaagtataataataataaaataaaataaaaagtcaattacagctgacacatagctgttaccttggaaatcacacctactcgtttgtgtttataagaatataaaagatatttcctctgaaacagacacataaagttaaaataagacatagtataagaacagtttgact

SEQ ID NO: 109161 - DNA, 601 bp, Human
taagcagtctgtttataagctgactgagcagtaagagagctgccacaatttaccttagggcagccacccgggcatttctcacaatttgtccccttcgaactcaaacactcaagctagcacctccagacaaaccaatattttcctgtcacttgtttaaaacctgtacatagggactggctttggtattctctgctattcattcctatatatagcttttaaaagcctggggcaaatcaaaaagggactaagaagcatgaaaaaactttgtaaaggccatttggcagtttaaaaaaagtcaatrtgcaggtttgttacatatgtatacatatgtatacatgtgccatgttggtgtgctgcacccattaactcgtcatttagcattaggtatacctcctaatgctatctacatacataacaaacctgcacgttgtgcacatgtaccctaaaacttaaagtataataataataaaataaaataaaaagtcaattacagctgacacatagctgttaccttggaaatcacacctactcgtttgtgtttataagaatataaaagatatttcctctgaaacagacacataaagttaaaataagacatagt

SEQ ID NO: 109162 - DNA, 601 bp, Human
ttaagcagtctgtttataagctgactgagcagtaagagagctgccacaatttaccttagggcagccacccgggcatttctcacaatttgtccccttcgaactcaaacactcaagctagcacctccagacaaaccaatattttcctgtcacttgtttaaaacctgtacatagggactggctttggtattctctgctattcattcctatatatagcttttaaaagcctggggcaaatcaaaaagggactaagaagcatgaaaaaactttgtaaaggccatttggcagtttaaaaaaagtcaayatgcaggtttgttacatatgtatacatatgtatacatgtgccatgttggtgtgctgcacccattaactcgtcatttagcattaggtatacctcctaatgctatctacatacataacaaacctgcacgttgtgcacatgtaccctaaaacttaaagtataataataataaaataaaataaaaagtcaattacagctgacacatagctgttaccttggaaatcacacctactcgtttgtgtttataagaatataaaagatatttcctctgaaacagacacataaagttaaaataagacatag

SEQ ID NO: 109163 - DNA, 601 bp, Human
gacccaggcaagaaatacaaattactggttccatccacacccatcccttaagaagattgggctacgtaaggatacctcacctgagaagtgtcccaactatacacaagcccagagtcacaatgaaaagtagtcaccaagctctttttttttttttttttttttgagacggagtctcactctgtcacccaggctggagtgcaatggcacgatctcagctcactgcaaactccacctcccaggttcacgccattctcctgcctcagcctcccgagtagctgggactacagccgcccgccaccaygcctggctaattttttgtatttttagtagagatggggtttcgccatgttagccaggatggtctcgatctcctgaccttgtgatccgcctgccttggcctcccaaagtgctgggattacaggcgtgagccaccgcacccagccgtagtcaccaagctcttacttgacaaaggacccatacaaaggatcacatttctgagtgaaaataagtttttaaatttttattttttaattgacgcataataactgtacatacatggggtacctagttttgacatatatagtgtatagtaatcagatca

SEQ ID NO: 109164 - DNA, 601 bp, Human
gacatccgcaaaagacccaggcaagaaatacaaattactggttccatccacacccatcccttaagaagattgggctacgtaaggatacctcacctgagaagtgtcccaactatacacaagcccagagtcacaatgaaaagtagtcaccaagctctttttttttttttttttttttgagacggagtctcactctgtcacccaggctggagtgcaatggcacgatctcagctcactgcaaactccacctcccaggttcacgccattctcctgcctcagcctcccgagtagctgggactacagscgcccgccaccacgcctggctaattttttgtatttttagtagagatggggtttcgccatgttagccaggatggtctcgatctcctgaccttgtgatccgcctgccttggcctcccaaagtgctgggattacaggcgtgagccaccgcacccagccgtagtcaccaagctcttacttgacaaaggacccatacaaaggatcacatttctgagtgaaaataagtttttaaatttttattttttaattgacgcataataactgtacatacatggggtacctagttttgacatatatagtgtat

SEQ ID NO: 109165 - DNA, 601 bp, Human
tgcttccattacaaaggctatctatgcttttaattttatacattaaacagggactttgtaacttaagaacagaaagtaaaaactgtccaaggcagatttgtacctaagctggcactgtgctataatctggatacaaacataatcaaggtttagtctgaagaatttgtatgttatttgaaaagctaggttttcgtttaagttcctgctgttgagactgcatttggaagtggcaggatctgggatttagagggagatgactgtgttggaatattagttctcaaaaggaggtacagtatgcttygtattctattcaaaatttgttttataaactcaaatgaacataagagatctagtttgatgacaggactgaaagactaagagataccatgttcaacgctgggctgtagacatccgcaaaagacccaggcaagaaatacaaattactggttccatccacacccatcccttaagaagattgggctacgtaaggatacctcacctgagaagtgtcccaactatacacaagcccagagtcacaatgaaaagtagtcaccaagctctttttttttttttttttttttgagacggagtctcactctgt

SEQ ID NO: 109166 - DNA, 601 bp, Human
atcacctcgagcaaggcatccacagacagacaccgccttccacgccgctcctcctcagacctccctccaccagatggcctcctccccatgctgctgaaatgtaccttgaaagcaactccagtgcttgtcaagtccaatggctagaagtggtgtgctttcatttttgatcctacccgacctcttcaaaggcctctgtgccactggcccacgcctccttgtaaaggtcccttcctgacacttagcagttctgcttcctccaatcttctccctgcccggcacccttcccagaacctcccacggrgctttttcctgcacttccgtcctttgcattgccattttccagagcctcatcctcaccacttacctcagtccctggggacagtctcccctaggccatggctccaaccatccctcccagatcctgccactccagtctggatcttttcctgttactatgattcacaattccagctcgctcttctttcctctaggtgttccactgggaactccgaattcaatacagcccaaaccaccttcacccactgacttcctaggttaggctagaatcctgtcctcaccctacttcctatatctcaatcaa

SEQ ID NO: 109167 - DNA, 601 bp, Human
tctctcttctcactttaccatcgatcacctcgagcaaggcatccacagacagacaccgccttccacgccgctcctcctcagacctccctccaccagatggcctcctccccatgctgctgaaatgtaccttgaaagcaactccagtgcttgtcaagtccaatggctagaagtggtgtgctttcatttttgatcctacccgacctcttcaaaggcctctgtgccactggcccacgcctccttgtaaaggtcccttcctgacacttagcagttctgcttcctccaatcttctccctgcccggcrcccttcccagaacctcccacggagctttttcctgcacttccgtcctttgcattgccattttccagagcctcatcctcaccacttacctcagtccctggggacagtctcccctaggccatggctccaaccatccctcccagatcctgccactccagtctggatcttttcctgttactatgattcacaattccagctcgctcttctttcctctaggtgttccactgggaactccgaattcaatacagcccaaaccaccttcacccactgacttcctaggttaggctagaatcctgtcctcac

SEQ ID NO: 109168 - DNA, 601 bp, Human
tgattcctttaagtcactccctgacctggattcctgcattttcttatacttgaatcactccatcccctggcttctatccaccaagcatacagctacgttcaagcttctctgttgcttcaaacccctccctgttcagcctgtctctcttctcactttaccatcgatcacctcgagcaaggcatccacagacagacaccgccttccacgccgctcctcctcagacctccctccaccagatggcctcctccccatgctgctgaaatgtaccttgaaagcaactccagtgcttgtcaagtccaayggctagaagtggtgtgctttcatttttgatcctacccgacctcttcaaaggcctctgtgccactggcccacgcctccttgtaaaggtcccttcctgacacttagcagttctgcttcctccaatcttctccctgcccggcacccttcccagaacctcccacggagctttttcctgcacttccgtcctttgcattgccattttccagagcctcatcctcaccacttacctcagtccctggggacagtctcccctaggccatggctccaaccatccctcccagatcctgccactccagtctgg

SEQ ID NO: 109169 - DNA, 601 bp, Human
gcttactagattttaacttgctcatctatataaatggaagagctgaccagatgattcctttaagtcactccctgacctggattcctgcattttcttatacttgaatcactccatcccctggcttctatccaccaagcatacagctacgttcaagcttctctgttgcttcaaacccctccctgttcagcctgtctctcttctcactttaccatcgatcacctcgagcaaggcatccacagacagacaccgccttccacgccgctcctcctcagacctccctccaccagatggcctcctcccyatgctgctgaaatgtaccttgaaagcaactccagtgcttgtcaagtccaatggctagaagtggtgtgctttcatttttgatcctacccgacctcttcaaaggcctctgtgccactggcccacgcctccttgtaaaggtcccttcctgacacttagcagttctgcttcctccaatcttctccctgcccggcacccttcccagaacctcccacggagctttttcctgcacttccgtcctttgcattgccattttccagagcctcatcctcaccacttacctcagtccctggggacagtctcc

SEQ ID NO: 109170 - DNA, 601 bp, Human
cacagagaacggcaatgactagaaccagcaatggcagttctttctaaacagatccctggctacagcataaggaagagcccactgcacatgaagccctgtcctgggtgcctagaggagtcaagggagaccagggagaccagaagagcttacaacctagcagtgagctcagaagtaatgaggtatagcaggaagggcatggggctgggtcaggagacctgaactttagatatgaccctgcaacttgatagccgtgtggcccatggcaaacctctcaggcttactagattttaacttgctcatytatataaatggaagagctgaccagatgattcctttaagtcactccctgacctggattcctgcattttcttatacttgaatcactccatcccctggcttctatccaccaagcatacagctacgttcaagcttctctgttgcttcaaacccctccctgttcagcctgtctctcttctcactttaccatcgatcacctcgagcaaggcatccacagacagacaccgccttccacgccgctcctcctcagacctccctccaccagatggcctcctccccatgctgctgaaatgtaccttgaaag

SEQ ID NO: 109171 - DNA, 601 bp, Human
agacagcctgtctccagagtccaagcaacaatgcaccacagagaacggcaatgactagaaccagcaatggcagttctttctaaacagatccctggctacagcataaggaagagcccactgcacatgaagccctgtcctgggtgcctagaggagtcaagggagaccagggagaccagaagagcttacaacctagcagtgagctcagaagtaatgaggtatagcaggaagggcatggggctgggtcaggagacctgaactttagatatgaccctgcaacttgatagccgtgtggcccatggcwaacctctcaggcttactagattttaacttgctcatctatataaatggaagagctgaccagatgattcctttaagtcactccctgacctggattcctgcattttcttatacttgaatcactccatcccctggcttctatccaccaagcatacagctacgttcaagcttctctgttgcttcaaacccctccctgttcagcctgtctctcttctcactttaccatcgatcacctcgagcaaggcatccacagacagacaccgccttccacgccgctcctcctcagacctccctccaccagatg

SEQ ID NO: 109172 - DNA, 601 bp, Human
aaaatccatatgccaacatcataaaaaaccgatatttgtattaggtactcaattccatgtgcagtcaaagcagagaaagtaaatactaggtcactgactgtcaagaaactagattgactagtttgtgcattcattcattcatccacacattatccatcaacacttactgacgctcaaatatgcaacaaatgttgtgctagggactggtaaaacaaaagtgttatagaagaagcctagcctcttctatatcatggagtttatggtctagcatggaaggtgaatgctaatgaaaataacccayaattaaaaacataatgacaagaagatgaatatcctaaaggaaatcaacaacaaagatgcgactaaatcgggggtctgggatgtgggaaatgaagacaggattctcttagggagggaagtctgaactgtaggacattggatggggaggacagcatgttatggggtggaagtaatggcacctatgaaggagctctgtgcattcggggggctaagataaagctggtcaacgtacaatgtacacagtgagaaggaagcaagagggactagctcatgtaggcctcagttaagaatttttattttt

SEQ ID NO: 109173 - DNA, 601 bp, Human
ttcatgcatggcatttcaaagtcataaatattgtctttttagatggcaaggtaactagtgagctgtcagaaataaaaacacaatttaagatctgtggctaaaatccatatgccaacatcataaaaaaccgatatttgtattaggtactcaattccatgtgcagtcaaagcagagaaagtaaatactaggtcactgactgtcaagaaactagattgactagtttgtgcattcattcattcatccacacattatccatcaacacttactgacgctcaaatatgcaacaaatgttgtgctaggractggtaaaacaaaagtgttatagaagaagcctagcctcttctatatcatggagtttatggtctagcatggaaggtgaatgctaatgaaaataacccataattaaaaacataatgacaagaagatgaatatcctaaaggaaatcaacaacaaagatgcgactaaatcgggggtctgggatgtgggaaatgaagacaggattctcttagggagggaagtctgaactgtaggacattggatggggaggacagcatgttatggggtggaagtaatggcacctatgaaggagctctgtgcattc

SEQ ID NO: 109174 - DNA, 601 bp, Human
gacacaccaaccattagaagcatccaatttccattttccaccagagtgacttgcatgcaaataaaagttgcagttccttagttccctggcctgggttctaagttcagtctaaaagcaccaaccaatgatcttaaggccatctctggtgagcagcccaagcccattctcactgctggctattctgtggctacaataggctgctgacaccatgattagcactagagaatgctaccatatttctgagcaaagcacacctcaaatccctgcttgagggcatggaagggataatcctattcacaayatgcagagtctaaatagctccatggaaggagataaagagacaaatccctgctaaggatactgatgatattgttgtcaggcaggtaccctggagggttccccagtgagatcactaaggatgcccccaagtgttagctgccaacaggtgacaattctgttcctattctcagcttctcagcatctttgaaataaattttcctccctctcgatacaaacaaatggaagaacattccatgctcatgggtaggaagaatcaatatcgtgaaaatggccatactgcccaaggtaatttagagattca

SEQ ID NO: 109175 - DNA, 601 bp, Human
acctgcacatacatacaaggttacaatgcctaatgcttaaaacagcacctaatgctggtgaaaattatgggctaatcttctacatcaagcattttaaactaaaaacatacaaaaaaattagttcctcttacctcattcttagttattacaaagttcatacatcttagtagcttcagttttagagtcaagagaaattaacacaagtcagtgttttgttttacacagcacaggagctagtctaatgggttataaagccatgaaacaactgtgtttcatgtgcacctacatggacaatcatgckggaatcaacacgtgtcagtttcacttttccctcacactcctcatttctcacagacacaccaaccattagaagcatccaatttccattttccaccagagtgacttgcatgcaaataaaagttgcagttccttagttccctggcctgggttctaagttcagtctaaaagcaccaaccaatgatcttaaggccatctctggtgagcagcccaagcccattctcactgctggctattctgtggctacaataggctgctgacaccatgattagcactagagaatgctaccatatttctgagcaaa

SEQ ID NO: 109176 - DNA, 601 bp, Human
gaccatcagcaactacccaggtcacgtccaaggagaaactggagagatgcagacactttgctcagtgaacccccctcagtctgacgactctggtatttttcacatattaaagtaacccatatcacttctaggccttttggataagatcaagcataaagcaacttgtatgaattccacggatccaagggtttgttttcagcaagacttaagcctcaccttatgcaggaacacttcactatcacagtggattagaatgagtgtgcccacctgcacatacatacaaggttacaatgcctaatgyttaaaacagcacctaatgctggtgaaaattatgggctaatcttctacatcaagcattttaaactaaaaacatacaaaaaaattagttcctcttacctcattcttagttattacaaagttcatacatcttagtagcttcagttttagagtcaagagaaattaacacaagtcagtgttttgttttacacagcacaggagctagtctaatgggttataaagccatgaaacaactgtgtttcatgtgcacctacatggacaatcatgctggaatcaacacgtgtcagtttcacttttccctcac

SEQ ID NO: 109177 - DNA, 601 bp, Human
gacctcacttaaggcaggcataagaccatcagcaactacccaggtcacgtccaaggagaaactggagagatgcagacactttgctcagtgaacccccctcagtctgacgactctggtatttttcacatattaaagtaacccatatcacttctaggccttttggataagatcaagcataaagcaacttgtatgaattccacggatccaagggtttgttttcagcaagacttaagcctcaccttatgcaggaacacttcactatcacagtggattagaatgagtgtgcccacctgcacatacrtacaaggttacaatgcctaatgcttaaaacagcacctaatgctggtgaaaattatgggctaatcttctacatcaagcattttaaactaaaaacatacaaaaaaattagttcctcttacctcattcttagttattacaaagttcatacatcttagtagcttcagttttagagtcaagagaaattaacacaagtcagtgttttgttttacacagcacaggagctagtctaatgggttataaagccatgaaacaactgtgtttcatgtgcacctacatggacaatcatgctggaatcaacacg

SEQ ID NO: 109178 - DNA, 601 bp, Human
agtatttactgagtacctacaaaggctttcatatcaacagcatcatgccaagagcttggaaagaaagaatcatgtaagaataggttcaaaattcacaaaataattcactattctaggtgaattcaaaaagtcctagaagcatatcaaaacaaggcaatgagtatgagctttttcacattacagtctacagtgggccctggctcatctcccttctgcagtcagagatacctgacagtacagagtcatggtatcacatcagcacattacagtgtccagatagagtagcaagatggtgctggtrgcatactagaactgttctcagaacctgtcagattcaggtgacttcgcacactcaaaggcagtttctgcaaccttattaggtacctttgtgctggagttccagggtgatatgatgggggttataaaacacatgatgaccatcccatttccatggggcttcttgcaacctgacctcacttaaggcaggcataagaccatcagcaactacccaggtcacgtccaaggagaaactggagagatgcagacactttgctcagtgaacccccctcagtctgacgactctggtatttttcacatatta

SEQ ID NO: 109179 - DNA, 601 bp, Human
taaattaagttccagcctagtggagtatttactgagtacctacaaaggctttcatatcaacagcatcatgccaagagcttggaaagaaagaatcatgtaagaataggttcaaaattcacaaaataattcactattctaggtgaattcaaaaagtcctagaagcatatcaaaacaaggcaatgagtatgagctttttcacattacagtctacagtgggccctggctcatctcccttctgcagtcagagatacctgacagtacagagtcatggtatcacatcagcacattacagtgtccagayagagtagcaagatggtgctggtagcatactagaactgttctcagaacctgtcagattcaggtgacttcgcacactcaaaggcagtttctgcaaccttattaggtacctttgtgctggagttccagggtgatatgatgggggttataaaacacatgatgaccatcccatttccatggggcttcttgcaacctgacctcacttaaggcaggcataagaccatcagcaactacccaggtcacgtccaaggagaaactggagagatgcagacactttgctcagtgaacccccctcagtctgacg

SEQ ID NO: 109180 - DNA, 601 bp, Human
aggagattcaggctaaggcaagctacctactgaagatgcagcatcatcttcatgtatggctacaggtcccatatagcagtgacagctcatgctctggtgatgctctgcactgccgagaccttcaataaattaagttccagcctagtggagtatttactgagtacctacaaaggctttcatatcaacagcatcatgccaagagcttggaaagaaagaatcatgtaagaataggttcaaaattcacaaaataattcactattctaggtgaattcaaaaagtcctagaagcatatcaaaacaasgcaatgagtatgagctttttcacattacagtctacagtgggccctggctcatctcccttctgcagtcagagatacctgacagtacagagtcatggtatcacatcagcacattacagtgtccagatagagtagcaagatggtgctggtagcatactagaactgttctcagaacctgtcagattcaggtgacttcgcacactcaaaggcagtttctgcaaccttattaggtacctttgtgctggagttccagggtgatatgatgggggttataaaacacatgatgaccatcccatttccatg

SEQ ID NO: 109181 - DNA, 601 bp, Human
aattaaatacataagataacacttccatgaaacatttctctagctgacatcatctcctgagacttgtaggagattcaggctaaggcaagctacctactgaagatgcagcatcatcttcatgtatggctacaggtcccatatagcagtgacagctcatgctctggtgatgctctgcactgccgagaccttcaataaattaagttccagcctagtggagtatttactgagtacctacaaaggctttcatatcaacagcatcatgccaagagcttggaaagaaagaatcatgtaagaataggtycaaaattcacaaaataattcactattctaggtgaattcaaaaagtcctagaagcatatcaaaacaaggcaatgagtatgagctttttcacattacagtctacagtgggccctggctcatctcccttctgcagtcagagatacctgacagtacagagtcatggtatcacatcagcacattacagtgtccagatagagtagcaagatggtgctggtagcatactagaactgttctcagaacctgtcagattcaggtgacttcgcacactcaaaggcagtttctgcaaccttattaggtacct

SEQ ID NO: 109182 - DNA, 601 bp, Human
cctccggatgcccaggtcagaatttgtttcaatacataaatatagccttgtcatttaaacccacaatatcaaggaagtagaaatataaaagggcttcagatatagccttgacttttgaggtacttgcaacaacaattaaatacataagataacacttccatgaaacatttctctagctgacatcatctcctgagacttgtaggagattcaggctaaggcaagctacctactgaagatgcagcatcatcttcatgtatggctacaggtcccatatagcagtgacagctcatgctctggtgaygctctgcactgccgagaccttcaataaattaagttccagcctagtggagtatttactgagtacctacaaaggctttcatatcaacagcatcatgccaagagcttggaaagaaagaatcatgtaagaataggttcaaaattcacaaaataattcactattctaggtgaattcaaaaagtcctagaagcatatcaaaacaaggcaatgagtatgagctttttcacattacagtctacagtgggccctggctcatctcccttctgcagtcagagatacctgacagtacagagtcatggtatca

SEQ ID NO: 109183 - DNA, 601 bp, Human
agaattttagatctggaacaaatgtaaaggtcaactttcacctccatgtggcaggtgaggatgtaggcgactggggagaaggaacctaccggaatcctgctccaacctctgttccctccaccaccaagcacaatggtcagcaccagctctcaaagggctgctagtcagtggctgagcctgggctagaacctcggcctccggatgcccaggtcagaatttgtttcaatacataaatatagccttgtcatttaaacccacaatatcaaggaagtagaaatataaaagggcttcagatatagcyttgacttttgaggtacttgcaacaacaattaaatacataagataacacttccatgaaacatttctctagctgacatcatctcctgagacttgtaggagattcaggctaaggcaagctacctactgaagatgcagcatcatcttcatgtatggctacaggtcccatatagcagtgacagctcatgctctggtgatgctctgcactgccgagaccttcaataaattaagttccagcctagtggagtatttactgagtacctacaaaggctttcatatcaacagcatcatgccaagagcttgg

SEQ ID NO: 109184 - DNA, 601 bp, Human
gtggcgcaatctcaactcactgcaagctctgcctcccaggttcaagcgattctcctgcctcagtgtcccgagtagctgggactgcaggcgtgcactaccatgcccagctaatttttgtatttttagtacagacagggtttcaccatgttggccaggatggtctcgatctcttgacctcgtgatccgcccgcctcggccttccaaagtgctgggattaaaggtgtgagccaccatgcccggcctacatgaatgatctttctgaaccacgtaagtacagatgcttaagaaagttgtatttttsatctgaagaaacaacatagaattttagatctggaacaaatgtaaaggtcaactttcacctccatgtggcaggtgaggatgtaggcgactggggagaaggaacctaccggaatcctgctccaacctctgttccctccaccaccaagcacaatggtcagcaccagctctcaaagggctgctagtcagtggctgagcctgggctagaacctcggcctccggatgcccaggtcagaatttgtttcaatacataaatatagccttgtcatttaaacccacaatatcaaggaagtagaaatataaa

SEQ ID NO: 109185 - DNA, 601 bp, Human
tctcaacagaagagaggctaaatgctacagcctcagatgctaggctctgctccttctcacctaccctgtgccctcttcctttaacccccacttaagtgcatggctcccctctcctgccattgtgtctgaactccctagtctagtgtctgaggactccctgatcagatcccactcacccctctcagacaataccttgcaaaaccatccaactggtcacgttgctgtctcataggcacaatgctcactactcctgcctctatacctttgcttactgtgctatttttacttgaaatacccccayccctttctcttctatacttatcctgagaggcccctctctcaaggttgagccctgcccctcccgtgaccctctcccaaagcacccatcactcctgtctgtgtctccccacaggctctgtggtgtcctgggacaccctcaccccctcaaggtctgtgttgaatcctgagctctacacttgctgagacttcccttcctcctgagaacaagggctgaggagaggactgaatgagagaatccatgtaagcatgtagaaaagtgcccagcatatagggctcagacattatctagttttattacttt

SEQ ID NO: 109186 - DNA, 601 bp, Human
aagttcagtctgacaggaacacagtcctgtcatcatcccttggggaagtcaatgctggggctagaataaagtattacaaggcttttaccacactcctgcaggggttgggggaaaaggagggagggaaaaggaacatacaggccccattcactaaccttgagcaattccaatctcaacagaagagaggctaaatgctacagcctcagatgctaggctctgctccttctcacctaccctgtgccctcttcctttaacccccacttaagtgcatggctcccctctcctgccattgtgtctgaamtccctagtctagtgtctgaggactccctgatcagatcccactcacccctctcagacaataccttgcaaaaccatccaactggtcacgttgctgtctcataggcacaatgctcactactcctgcctctatacctttgcttactgtgctatttttacttgaaatacccccacccctttctcttctatacttatcctgagaggcccctctctcaaggttgagccctgcccctcccgtgaccctctcccaaagcacccatcactcctgtctgtgtctccccacaggctctgtggtgtcctggga

SEQ ID NO: 109187 - DNA, 601 bp, Human
aagttaacttccctgatacctgttttctcatcagaatagggataagcctatgcctgttatatggggttgttatgaatactaaataagaggttaatatcttcatctgtaacaaggtgaagatgcaggccttggatgaggcgctggtgacagagtcccagccatcaagaagttcagtctgacaggaacacagtcctgtcatcatcccttggggaagtcaatgctggggctagaataaagtattacaaggcttttaccacactcctgcaggggttgggggaaaaggagggagggaaaaggaacrtacaggccccattcactaaccttgagcaattccaatctcaacagaagagaggctaaatgctacagcctcagatgctaggctctgctccttctcacctaccctgtgccctcttcctttaacccccacttaagtgcatggctcccctctcctgccattgtgtctgaactccctagtctagtgtctgaggactccctgatcagatcccactcacccctctcagacaataccttgcaaaaccatccaactggtcacgttgctgtctcataggcacaatgctcactactcctgcctctatacctt

SEQ ID NO: 109188 - DNA, 601 bp, Human
cttcacctgcaaagatgcgcagaacttcatttccttgtggtgtggtaggaggtggctatgctttaatacacctaagtttaagttctatttttctacattattgcatcttgtcaagttaacttccctgatacctgttttctcatcagaatagggataagcctatgcctgttatatggggttgttatgaatactaaataagaggttaatatcttcatctgtaacaaggtgaagatgcaggccttggatgaggcgctggtgacagagtcccagccatcaagaagttcagtctgacaggaacacwgtcctgtcatcatcccttggggaagtcaatgctggggctagaataaagtattacaaggcttttaccacactcctgcaggggttgggggaaaaggagggagggaaaaggaacatacaggccccattcactaaccttgagcaattccaatctcaacagaagagaggctaaatgctacagcctcagatgctaggctctgctccttctcacctaccctgtgccctcttcctttaacccccacttaagtgcatggctcccctctcctgccattgtgtctgaactccctagtctagtgtctgagga

SEQ ID NO: 109189 - DNA, 601 bp, Human
cctgcaccttacatgtttcctctcaaagctgcttttcaacatatacctgagaacggaaaacacacgtccacgccaaaacccacacaccaacctgcacagcagcgttactcccaaaagcgccacaaggtaggaacaacccaaataccaactgatgaatggacaaacaaatgtggtacctccatacaatggattattcaacattattaataaattcaatataaagaaatgacctcctgatccatgccacaacatggacacacctcaaaaaaattataccaagtgaaagcagccagacacaaaygttcgtatagtgtgtgattccatttacatgaaatatccagggaatagaaagtaggttattggttgctaggggttgggggagaaaggggaagaggaaggggaagaaggggagaaagggagtgcctgctaagggggacaggatttctttttggagtaataaaaatattcccagacttttagtggtgatgactgcataaattggtgaacatcctgaaacccagtgaattgtgtgcttcaaaagggtgaattttgtaatgtatgaatgacaattcaattttttaaatggtaggaaaaaagttgc

SEQ ID NO: 109190 - DNA, 601 bp, Human
cctaaacctgagggcctgggaccctgacatccgatgcccgggtatcctggaaataatttgttatactaaatgtccagaatggcaaactcataggaacaaatgttaggtggtggctgccagggacttgacaagcattctcttctcttctctccagagacacaatgggcagaacagccacagagaccccacagcaggagaagttgcttttagtctcctgatccacagcttccttaagcctcctctctaacctataaattccaggccctcttgcctcccacactaggtgtctttggccctgtgrcacagccccaccacaggtgttaacatacttatggaggctacggtcggccccttccctcctccctctgttagttccttgtggtgaaggtattggagtttccttcttctaaggacacaagatagagctggatggctgaggctactgatgtcaaggctgctgtgatggcttccctctcaccctgccgccatccttcatctacagagaggccagccctgcacatgcacctcggcccatagcttttggtccggggctgacctggtggccaacggttttcttgtgctccttgttggagactttcat

SEQ ID NO: 109191 - DNA, 601 bp, Human
ggcggtagttattgttactattatattattaatccagaaggatggaagaaatttcagagacctggggtaagattccagctctgacactgctatcttgctgtgaccaaaatcaagtccttcctatttaagggttccttgaattacatgggggacagactaccccctaatgtgcctaactcccagtgctgtggatcaaataagatgaaaggtgggcaaatactgtaggagagatttggtcactgtgcaccggaagcctgctcttcctaaacctgagggcctgggaccctgacatccgatgccygggtatcctggaaataatttgttatactaaatgtccagaatggcaaactcataggaacaaatgttaggtggtggctgccagggacttgacaagcattctcttctcttctctccagagacacaatgggcagaacagccacagagaccccacagcaggagaagttgcttttagtctcctgatccacagcttccttaagcctcctctctaacctataaattccaggccctcttgcctcccacactaggtgtctttggccctgtggcacagccccaccacaggtgttaacatacttatggaggc

SEQ ID NO: 109192 - DNA, 601 bp, Human
ggacatagtgaggtgtcgtggcattcagggtctccatgagcagatgcagggaggtacggaactagagagacaaaagccagtgcttggttagttttaacaagtcgtggatgtgtgataaagaaaaactcatatatgggtggcggtagttattgttactattatattattaatccagaaggatggaagaaatttcagagacctggggtaagattccagctctgacactgctatcttgctgtgaccaaaatcaagtccttcctatttaagggttccttgaattacatgggggacagactacccsctaatgtgcctaactcccagtgctgtggatcaaataagatgaaaggtgggcaaatactgtaggagagatttggtcactgtgcaccggaagcctgctcttcctaaacctgagggcctgggaccctgacatccgatgcccgggtatcctggaaataatttgttatactaaatgtccagaatggcaaactcataggaacaaatgttaggtggtggctgccagggacttgacaagcattctcttctcttctctccagagacacaatgggcagaacagccacagagaccccacagcaggagaagt

SEQ ID NO: 109193 - DNA, 601 bp, Human
gtagaaacaaaagttggatcagagtaggttgaggagtgaggaaaaggggagcaaatgtggataattctggaagcttagcagcagacgggaatgtgagaaacaggaccatgttcatgtcctatcgtccaacacatcatgtgaggtcttgattcttcaacacaagaaaagcctttcctgaccactccagcaacctttccaagcctgaatttaacacttgctgtgagatgtactcatggctacatttaacgttctctattttattcaagcatgcacattcctgaccaccactatacggggaacrgcattttttctcttaagacctcctggacagcagactggtggcactcagcaagtgtctgtcagtctgtctgcagcaagtaagatgtctggggagtgtaagtccaggtggtcatcatgctgaaggccacagacccccaggcaaggcctgggccaccctgttccacctgaacctctaaggctgggctggacaggctaatgcccagcaggcacttactgaaaggggagcttctcatcgttgggcttgatgcagcggacatagtgaggtgtcgtggcattcagggtctccatgagcagatgcagg

SEQ ID NO: 109194 - DNA, 601 bp, Human
gatcattaagagttctacagattagggtgaggtcagccacatgagcatggacagaaccggaacaaagtttcaaggtcagggtagaaacaaaagttggatcagagtaggttgaggagtgaggaaaaggggagcaaatgtggataattctggaagcttagcagcagacgggaatgtgagaaacaggaccatgttcatgtcctatcgtccaacacatcatgtgaggtcttgattcttcaacacaagaaaagcctttcctgaccactccagcaacctttccaagcctgaatttaacacttgctgygagatgtactcatggctacatttaacgttctctattttattcaagcatgcacattcctgaccaccactatacggggaacggcattttttctcttaagacctcctggacagcagactggtggcactcagcaagtgtctgtcagtctgtctgcagcaagtaagatgtctggggagtgtaagtccaggtggtcatcatgctgaaggccacagacccccaggcaaggcctgggccaccctgttccacctgaacctctaaggctgggctggacaggctaatgcccagcaggcacttactgaaagg

SEQ ID NO: 109195 - DNA, 601 bp, Human
tgtgctgaaggcaaggtggataatgaagctgtagtaggcttgcacaaacacttgtctggaatttagtagaaaccaagatgtacaaagatcattaagagttctacagattagggtgaggtcagccacatgagcatggacagaaccggaacaaagtttcaaggtcagggtagaaacaaaagttggatcagagtaggttgaggagtgaggaaaaggggagcaaatgtggataattctggaagcttagcagcagacgggaatgtgagaaacaggaccatgttcatgtcctatcgtccaacacatmatgtgaggtcttgattcttcaacacaagaaaagcctttcctgaccactccagcaacctttccaagcctgaatttaacacttgctgtgagatgtactcatggctacatttaacgttctctattttattcaagcatgcacattcctgaccaccactatacggggaacggcattttttctcttaagacctcctggacagcagactggtggcactcagcaagtgtctgtcagtctgtctgcagcaagtaagatgtctggggagtgtaagtccaggtggtcatcatgctgaaggccacagacccc

SEQ ID NO: 109196 - DNA, 601 bp, Human
gaggaatcattcttggggggtggcaggagatgaagagtgtggtctcagatgtgctgaaggcaaggtggataatgaagctgtagtaggcttgcacaaacacttgtctggaatttagtagaaaccaagatgtacaaagatcattaagagttctacagattagggtgaggtcagccacatgagcatggacagaaccggaacaaagtttcaaggtcagggtagaaacaaaagttggatcagagtaggttgaggagtgaggaaaaggggagcaaatgtggataattctggaagcttagcagcagaygggaatgtgagaaacaggaccatgttcatgtcctatcgtccaacacatcatgtgaggtcttgattcttcaacacaagaaaagcctttcctgaccactccagcaacctttccaagcctgaatttaacacttgctgtgagatgtactcatggctacatttaacgttctctattttattcaagcatgcacattcctgaccaccactatacggggaacggcattttttctcttaagacctcctggacagcagactggtggcactcagcaagtgtctgtcagtctgtctgcagcaagtaagatgt

SEQ ID NO: 109197 - DNA, 601 bp, Human
tgaggaacgtgcatggagacttcatgggactttgacgtcagttagacactgggaagtgaaggagacggaagaatcaagggttaaaccatgctgtatggtggccactagcacctcggggtatccaaaataaattaaaatgaaataaaattcagaattcagttcctcactcacaccagacaggtttcaagcactcgatagccatgcgtgacaagcagctcccacactggataaggcagatgacagcacatacccatcatcacagggattccccctgcacagcaggttagagagacttctagtmtgggagatcaggtctcatgggtggatgagataacaggaaatgttatgcctcttactacaacaaagaccaatgaaagaggaatcattcttggggggtggcaggagatgaagagtgtggtctcagatgtgctgaaggcaaggtggataatgaagctgtagtaggcttgcacaaacacttgtctggaatttagtagaaaccaagatgtacaaagatcattaagagttctacagattagggtgaggtcagccacatgagcatggacagaaccggaacaaagtttcaaggtcagggtagaaacaa

SEQ ID NO: 109198 - DNA, 601 bp, Human
tgttttttaaaggtttaaggtagtatttcaggcaagaaaagaggatctggaacaaggtgaataaggaagagaaaagggagaccagggtgaggaacgtgcatggagacttcatgggactttgacgtcagttagacactgggaagtgaaggagacggaagaatcaagggttaaaccatgctgtatggtggccactagcacctcggggtatccaaaataaattaaaatgaaataaaattcagaattcagttcctcactcacaccagacaggtttcaagcactcgatagccatgcgtgacaagcrgctcccacactggataaggcagatgacagcacatacccatcatcacagggattccccctgcacagcaggttagagagacttctagtctgggagatcaggtctcatgggtggatgagataacaggaaatgttatgcctcttactacaacaaagaccaatgaaagaggaatcattcttggggggtggcaggagatgaagagtgtggtctcagatgtgctgaaggcaaggtggataatgaagctgtagtaggcttgcacaaacacttgtctggaatttagtagaaaccaagatgtacaaagat

SEQ ID NO: 109199 - DNA, 601 bp, Human
gtaacattctgtctccttaaccttttccacacagagcccatctgaatggaagccaagctttattacatgacccgagtgtagaaggcagttcagatattcagtctgagagtcaaaattgtcaaagtaagttatttcacagaaagaaattatactaggcccgaaacagaaatcatggggaaggaaagatgggaataaggtgcttaaaaaatttaaaaatacacctcctctggccagagggaacagcatgcgtgaaggcccagagcagaagagactgcagagctgagtgagaggatgttttttraaggtttaaggtagtatttcaggcaagaaaagaggatctggaacaaggtgaataaggaagagaaaagggagaccagggtgaggaacgtgcatggagacttcatgggactttgacgtcagttagacactgggaagtgaaggagacggaagaatcaagggttaaaccatgctgtatggtggccactagcacctcggggtatccaaaataaattaaaatgaaataaaattcagaattcagttcctcactcacaccagacaggtttcaagcactcgatagccatgcgtgacaagcagctcccac

SEQ ID NO: 109200 - DNA, 601 bp, Human
tctaacagcctcttctcttctggagtcagccggtaaacagaagccacccaggggcaattcctaagcatgtctcagagatttggaggaagggaagagcaagcaagcagcacactgcatagaaaactggtaacattctgtctccttaaccttttccacacagagcccatctgaatggaagccaagctttattacatgacccgagtgtagaaggcagttcagatattcagtctgagagtcaaaattgtcaaagtaagttatttcacagaaagaaattatactaggcccgaaacagaaatcatgrggaaggaaagatgggaataaggtgcttaaaaaatttaaaaatacacctcctctggccagagggaacagcatgcgtgaaggcccagagcagaagagactgcagagctgagtgagaggatgttttttaaaggtttaaggtagtatttcaggcaagaaaagaggatctggaacaaggtgaataaggaagagaaaagggagaccagggtgaggaacgtgcatggagacttcatgggactttgacgtcagttagacactgggaagtgaaggagacggaagaatcaagggttaaaccatgctgtat

SEQ ID NO: 109201 - DNA, 601 bp, Human
agctcaaactagaatcccggtatcatgacatggtcagtattcctcccaccttttctttgtattgggaggaagattttggttctgaagataaggcagtgtcttagaaaagtgggacctcaggactagaaagtccccagtgtcttctctcctttgagaggggagacccagcagagtatctgtcccacagcagggccacgctctgatgagggaaaggcccaaggccacagctggtctggcccagctggtatagagccctcatctcctctcccctgggccctgcacagcactctgcccttcacamagaatctgagtctttcacacacactacgcttctaacagcctcttctcttctggagtcagccggtaaacagaagccacccaggggcaattcctaagcatgtctcagagatttggaggaagggaagagcaagcaagcagcacactgcatagaaaactggtaacattctgtctccttaaccttttccacacagagcccatctgaatggaagccaagctttattacatgacccgagtgtagaaggcagttcagatattcagtctgagagtcaaaattgtcaaagtaagttatttcacagaaaga

SEQ ID NO: 109202 - DNA, 601 bp, Human
cacatctcagaactctgagactccgagacctgggctggccttcggaaaaccagtgaccaggtcctccacgaagcgttcccaggttatgacacccgccccaggccgctgctgctctggatacttcatctctctcttgcctctgccctgtcagcactttcacagagccaccgacagccacttctgtggcattgccagttacttgtgacagacaattccttaagcataggggacatgtcttattgtcattctacctgtcctagcccagtgcctagtaagaggtatgatagatgtttcttaaatraagaaagcagaggaaaaagccttttgtataggtcatgctatcaaagcatttaatgtgggacaggagttctcaactggaggcaattttgtccccaagagaacatttggcaatgtctaaaaacatttttagctgtcacaatgatgggatgcttgtagcatctagtgggtagaggccaaggatgcttctcaacatcctatgatgcacaggacagcaccccttgccccagcaaagaattctctaactcaatatgtcagtgctgctgaggctgagcaactccgattacaggaaatgggtggagag

SEQ ID NO: 109203 - DNA, 601 bp, Human
tcacagtgctgaaactgaagttcatgctttcctctcccaataggattagcagaccctggagcctgctggatgcaaagagaggatcccactgtgttagaaccgagccctacctccacaattgcccgccatggaattgatttctccacgggctgcaagctccctacctgcttccccaggctcagcagcatcctgcagtcacatctcagaactctgagactccgagacctgggctggccttcggaaaaccagtgaccaggtcctccacgaagcgttcccaggttatgacacccgccccaggccrctgctgctctggatacttcatctctctcttgcctctgccctgtcagcactttcacagagccaccgacagccacttctgtggcattgccagttacttgtgacagacaattccttaagcataggggacatgtcttattgtcattctacctgtcctagcccagtgcctagtaagaggtatgatagatgtttcttaaatgaagaaagcagaggaaaaagccttttgtataggtcatgctatcaaagcatttaatgtgggacaggagttctcaactggaggcaattttgtccccaagagaacatt

SEQ ID NO: 109204 - DNA, 601 bp, Human
aagacatagaaggtcacagtgctgaaactgaagttcatgctttcctctcccaataggattagcagaccctggagcctgctggatgcaaagagaggatcccactgtgttagaaccgagccctacctccacaattgcccgccatggaattgatttctccacgggctgcaagctccctacctgcttccccaggctcagcagcatcctgcagtcacatctcagaactctgagactccgagacctgggctggccttcggaaaaccagtgaccaggtcctccacgaagcgttcccaggttatgacamccgccccaggccgctgctgctctggatacttcatctctctcttgcctctgccctgtcagcactttcacagagccaccgacagccacttctgtggcattgccagttacttgtgacagacaattccttaagcataggggacatgtcttattgtcattctacctgtcctagcccagtgcctagtaagaggtatgatagatgtttcttaaatgaagaaagcagaggaaaaagccttttgtataggtcatgctatcaaagcatttaatgtgggacaggagttctcaactggaggcaattttgtcc

SEQ ID NO: 109205 - DNA, 601 bp, Human
agtctctctgtacctcattttcctcatttactcaatgagagctcaacatatctgcccaactatgaagcagtggtggctgtaatgactatgttacaaaaacaaacaaacaaacaaacaaaaaaacaagaagaatgcttttagaaaaagctaagagacactatacaaagaagatattgccatcatctttccctgttcacatatcccaaggggatatgtgaggccagctggccttctgtacttcctctccccaacagtaaagaaaacccaccgtcaaatgcatctctcaatccacctcactgcwttcactattaggtgactaggaatggaaaaccagccctccttctattaaatcttggaggaccatagcaaggacaattaacatagaaaaatcaccaaagacatagaaggtcacagtgctgaaactgaagttcatgctttcctctcccaataggattagcagaccctggagcctgctggatgcaaagagaggatcccactgtgttagaaccgagccctacctccacaattgcccgccatggaattgatttctccacgggctgcaagctccctacctgcttccccaggctcagcagcatcctgc

SEQ ID NO: 109206 - DNA, 601 bp, Human
ggcaagacacagtctctctgtacctcattttcctcatttactcaatgagagctcaacatatctgcccaactatgaagcagtggtggctgtaatgactatgttacaaaaacaaacaaacaaacaaacaaaaaaacaagaagaatgcttttagaaaaagctaagagacactatacaaagaagatattgccatcatctttccctgttcacatatcccaaggggatatgtgaggccagctggccttctgtacttcctctccccaacagtaaagaaaacccaccgtcaaatgcatctctcaatccrcctcactgcattcactattaggtgactaggaatggaaaaccagccctccttctattaaatcttggaggaccatagcaaggacaattaacatagaaaaatcaccaaagacatagaaggtcacagtgctgaaactgaagttcatgctttcctctcccaataggattagcagaccctggagcctgctggatgcaaagagaggatcccactgtgttagaaccgagccctacctccacaattgcccgccatggaattgatttctccacgggctgcaagctccctacctgcttccccaggctcagc

SEQ ID NO: 109207 - DNA, 601 bp, Human
ctgctttcccatgtggtctggggcaaagaactcagtgtggcctccgctctgccactaacaggtagtgttactttgggcaagacacagtctctctgtacctcattttcctcatttactcaatgagagctcaacatatctgcccaactatgaagcagtggtggctgtaatgactatgttacaaaaacaaacaaacaaacaaacaaaaaaacaagaagaatgcttttagaaaaagctaagagacactatacaaagaagatattgccatcatctttccctgttcacatatcccaaggggatatgkgaggccagctggccttctgtacttcctctccccaacagtaaagaaaacccaccgtcaaatgcatctctcaatccacctcactgcattcactattaggtgactaggaatggaaaaccagccctccttctattaaatcttggaggaccatagcaaggacaattaacatagaaaaatcaccaaagacatagaaggtcacagtgctgaaactgaagttcatgctttcctctcccaataggattagcagaccctggagcctgctggatgcaaagagaggatcccactgtgttagaaccgagccct

SEQ ID NO: 109208 - DNA, 601 bp, Human
tttgaactcagccttaacattgttccctcttcgtgaccagctcagcaaatcccctccctttgccacaactgttctgtcctcctgtgatggcaacactgctttcccatgtggtctggggcaaagaactcagtgtggcctccgctctgccactaacaggtagtgttactttgggcaagacacagtctctctgtacctcattttcctcatttactcaatgagagctcaacatatctgcccaactatgaagcagtggtggctgtaatgactatgttacaaaaacaaacaaacaaacaaacaaaamaacaagaagaatgcttttagaaaaagctaagagacactatacaaagaagatattgccatcatctttccctgttcacatatcccaaggggatatgtgaggccagctggccttctgtacttcctctccccaacagtaaagaaaacccaccgtcaaatgcatctctcaatccacctcactgcattcactattaggtgactaggaatggaaaaccagccctccttctattaaatcttggaggaccatagcaaggacaattaacatagaaaaatcaccaaagacatagaaggtcacagtgctgaa

SEQ ID NO: 109209 - DNA, 601 bp, Human
agagtctccacacagcgtgcctggagctggtccccagaaggcacctggcacagagtttttgaactcagccttaacattgttccctcttcgtgaccagctcagcaaatcccctccctttgccacaactgttctgtcctcctgtgatggcaacactgctttcccatgtggtctggggcaaagaactcagtgtggcctccgctctgccactaacaggtagtgttactttgggcaagacacagtctctctgtacctcattttcctcatttactcaatgagagctcaacatatctgcccaactatraagcagtggtggctgtaatgactatgttacaaaaacaaacaaacaaacaaacaaaaaaacaagaagaatgcttttagaaaaagctaagagacactatacaaagaagatattgccatcatctttccctgttcacatatcccaaggggatatgtgaggccagctggccttctgtacttcctctccccaacagtaaagaaaacccaccgtcaaatgcatctctcaatccacctcactgcattcactattaggtgactaggaatggaaaaccagccctccttctattaaatcttggaggaccat

SEQ ID NO: 109210 - DNA, 601 bp, Human
tcatgcttcctgacctctggcatcccagttcggtcctgttgaagggccaggcaatggctcacttggtgctggtcccctcccctcacacagcacagcatgagtttttgagggcagggttggggacatcggttttctcttagagtctccacacagcgtgcctggagctggtccccagaaggcacctggcacagagtttttgaactcagccttaacattgttccctcttcgtgaccagctcagcaaatcccctccctttgccacaactgttctgtcctcctgtgatggcaacactgctttcccmtgtggtctggggcaaagaactcagtgtggcctccgctctgccactaacaggtagtgttactttgggcaagacacagtctctctgtacctcattttcctcatttactcaatgagagctcaacatatctgcccaactatgaagcagtggtggctgtaatgactatgttacaaaaacaaacaaacaaacaaacaaaaaaacaagaagaatgcttttagaaaaagctaagagacactatacaaagaagatattgccatcatctttccctgttcacatatcccaaggggatatgtgaggccagct

SEQ ID NO: 109211 - DNA, 601 bp, Human
ccatctgtcccctccctctctgttctggtatccccacatcatgcttcctgacctctggcatcccagttcggtcctgttgaagggccaggcaatggctcacttggtgctggtcccctcccctcacacagcacagcatgagtttttgagggcagggttggggacatcggttttctcttagagtctccacacagcgtgcctggagctggtccccagaaggcacctggcacagagtttttgaactcagccttaacattgttccctcttcgtgaccagctcagcaaatcccctccctttgccacamctgttctgtcctcctgtgatggcaacactgctttcccatgtggtctggggcaaagaactcagtgtggcctccgctctgccactaacaggtagtgttactttgggcaagacacagtctctctgtacctcattttcctcatttactcaatgagagctcaacatatctgcccaactatgaagcagtggtggctgtaatgactatgttacaaaaacaaacaaacaaacaaacaaaaaaacaagaagaatgcttttagaaaaagctaagagacactatacaaagaagatattgccatcatctttc

SEQ ID NO: 109212 - DNA, 601 bp, Human
gcatctgggacccttaggtcccacatgggctatgggaccagctggaggtcccttcttcttccaggacctcctactgtttcctcatggtattaataaaatgagcagaagctcattgagaaccccgtcattccttaaaagtactgctcctcctccccatctgtcccctccctctctgttctggtatccccacatcatgcttcctgacctctggcatcccagttcggtcctgttgaagggccaggcaatggctcacttggtgctggtcccctcccctcacacagcacagcatgagtttttgagsgcagggttggggacatcggttttctcttagagtctccacacagcgtgcctggagctggtccccagaaggcacctggcacagagtttttgaactcagccttaacattgttccctcttcgtgaccagctcagcaaatcccctccctttgccacaactgttctgtcctcctgtgatggcaacactgctttcccatgtggtctggggcaaagaactcagtgtggcctccgctctgccactaacaggtagtgttactttgggcaagacacagtctctctgtacctcattttcctcatttactcaa

SEQ ID NO: 109213 - DNA, 601 bp, Human
cagggatggcagcgtgttcaggagcatctgggacccttaggtcccacatgggctatgggaccagctggaggtcccttcttcttccaggacctcctactgtttcctcatggtattaataaaatgagcagaagctcattgagaaccccgtcattccttaaaagtactgctcctcctccccatctgtcccctccctctctgttctggtatccccacatcatgcttcctgacctctggcatcccagttcggtcctgttgaagggccaggcaatggctcacttggtgctggtcccctcccctcacrcagcacagcatgagtttttgagggcagggttggggacatcggttttctcttagagtctccacacagcgtgcctggagctggtccccagaaggcacctggcacagagtttttgaactcagccttaacattgttccctcttcgtgaccagctcagcaaatcccctccctttgccacaactgttctgtcctcctgtgatggcaacactgctttcccatgtggtctggggcaaagaactcagtgtggcctccgctctgccactaacaggtagtgttactttgggcaagacacagtctctctgta

SEQ ID NO: 109214 - DNA, 601 bp, Human
ctcactgtggcttcattgctcccctctgccctcccaagccccaccttctttccacacccatcgtctccataaaatcttcccgactcctccagctccaacagcccacggcactgagcatgtgaggcacaacggaacactgatttacacagctctgaacaaaacatttccttcagaagacttcatctttctaactagagtaaaagccccttagtgcgagggccttacaggacagcagggagtatgtgctgagcacctcactgcctgctcaccctctcactccaatgcctcctgtggttgctckgccacaagaggaagcacagttccaggatccaagggggtcttcattaccaggggcggcaatgaccagtcataagcagctgctcggctgcccatgactgcgagtgatcagaagccttcgggctgcgggctcccctgctcacaggctctcactgctaaagctgtcagccaggccctgcagcatgaaggcagagcggacacccctgtgctttggaaaaggcatcctgtggcctgcagaccacctccccaggcactctgcccctgcccacagcagctgtgttccccaagccagccaccggcttct

SEQ ID NO: 109215 - DNA, 601 bp, Human
ctcaaaaaaaaacactagtaagaaaaaaaaaagaaggcagagagcaagacatcaccattgtctagagtaagcagggagtcttcatagagaaagaattaaggcaacctagaattaatcactatttttaatttgctaagattactgccccactccatcagaagggacgaggaacaaatgctccctttccttctgactgtcctgcagctcagctggagctaagagtcatgcttcttttcctcctttcactctgggacatggtgcttgacagatggtgccctggagctgcctgggctcagtgggyacttggcactggaaaacagtgggcatttgccaagcaactgatgactgcaagatgccacctcaacccaggcaacactccacgttgcacatcagccctgggtctcatcccatgagacacccacactctcccctccaggctgtgctcactgtggcttcattgctcccctctgccctcccaagccccaccttctttccacacccatcgtctccataaaatcttcccgactcctccagctccaacagcccacggcactgagcatgtgaggcacaacggaacactgatttacacagctctgaacaa

SEQ ID NO: 109216 - DNA, 601 bp, Human
ctaataagaagggctggatgcggtgcctcatgcctgtaatcccagtactttgggaggccgaggtgggtggatcacaaggtcaggagatcgagaccatcctggctaacacggtgaaaccccatctctactaaaaatataaaaaattagctgggcgtggtggtgggtgcctgtagtcccagctactcgggaggctgaggcagaagaatggcatgaatccgggaggcagaggttgcagtgagctgagatcgtgccactgcactgcagcctgggcgacagagtgagactctgtctcaaaaaaaaacactagtaagaaaaaaaaaagaaggcagagagcaagacatcaccattgtctagagtaagcagggagtcttcatagagaaagaattaaggcaacctagaattaatcactatttttaatttgctaagattactgccccactccatcagaagggacgaggaacaaatgctccctttccttctgactgtcctgcagctcagctggagctaagagtcatgcttcttttcctcctttcactctgggacatggtgcttgacagatggtgccctggagctgcctgggctcagtgggcacttggcactg

SEQ ID NO: 109217 - DNA, 601 bp, Human
tctgaggttgttaaacacaaatcataaaaactaataagaagggctggatgcggtgcctcatgcctgtaatcccagtactttgggaggccgaggtgggtggatcacaaggtcaggagatcgagaccatcctggctaacacggtgaaaccccatctctactaaaaatataaaaaattagctgggcgtggtggtgggtgcctgtagtcccagctactcgggaggctgaggcagaagaatggcatgaatccgggaggcagaggttgcagtgagctgagatcgtgccactgcactgcagcctgggygacagagtgagactctgtctcaaaaaaaaacactagtaagaaaaaaaaaagaaggcagagagcaagacatcaccattgtctagagtaagcagggagtcttcatagagaaagaattaaggcaacctagaattaatcactatttttaatttgctaagattactgccccactccatcagaagggacgaggaacaaatgctccctttccttctgactgtcctgcagctcagctggagctaagagtcatgcttcttttcctcctttcactctgggacatggtgcttgacagatggtgccctggag

SEQ ID NO: 109218 - DNA, 601 bp, Human
aaacatatattgagtatggcagtgtagaataaaaagccagatgctgtgtgagctttctgagtatccccgcttgaagaggaaattttatacaagacagtacataacaaacatggtgaaaatgccaaaagaagccagagagcaattgtctgaggttgttaaacacaaatcataaaaactaataagaagggctggatgcggtgcctcatgcctgtaatcccagtactttgggaggccgaggtgggtggatcacaaggtcaggagatcgagaccatcctggctaacacggtgaaaccccatctcyactaaaaatataaaaaattagctgggcgtggtggtgggtgcctgtagtcccagctactcgggaggctgaggcagaagaatggcatgaatccgggaggcagaggttgcagtgagctgagatcgtgccactgcactgcagcctgggcgacagagtgagactctgtctcaaaaaaaaacactagtaagaaaaaaaaaagaaggcagagagcaagacatcaccattgtctagagtaagcagggagtcttcatagagaaagaattaaggcaacctagaattaatcactatttttaatttgctaag

SEQ ID NO: 109219 - DNA, 601 bp, Human
ttagaccaacaccaaaaatctgaaatctgaaaaggactttagagaaaagcagccaagaggatgtgactgctaaccttcccaatttttcaggctaatgtgagagtctcatttccatcagcatcctgcttgggcctcaatgtttgggaaccgttttgaaggatctgtttctggccgacggtacacagagggctccctggggaaccaaactctggctgctctagggcagccccaggaggcagctggcgggcacgttagttacctggatgggtagccagctgcactgattcgaatcgtctccaayaccccgcaggctctgagttgctgcactgctctctttgggtcaaagctgccaaaggagaaaaaaaaaaaaaaagcaagacaagagatgagtggccacatttgcaaaaaagaaacaaaaaagaatcttttcctgcagcatgtgaagtacctgctgccactgagttacagccactgagttacccttgagctcaagtcagggattaggcatagactaaaagacaccaatgtgcaggcacctgagccatctcagcatcttctgttctgtgcctgaggcttttgtgcacattctcattatcacctg

SEQ ID NO: 109220 - DNA, 601 bp, Human
gtaaaggggacaaggtaggaattgagagaaggggaaatcctccttgcaactctagctagctcatcacttagaccaacaccaaaaatctgaaatctgaaaaggactttagagaaaagcagccaagaggatgtgactgctaaccttcccaatttttcaggctaatgtgagagtctcatttccatcagcatcctgcttgggcctcaatgtttgggaaccgttttgaaggatctgtttctggccgacggtacacagagggctccctggggaaccaaactctggctgctctagggcagccccaggrggcagctggcgggcacgttagttacctggatgggtagccagctgcactgattcgaatcgtctccaataccccgcaggctctgagttgctgcactgctctctttgggtcaaagctgccaaaggagaaaaaaaaaaaaaaagcaagacaagagatgagtggccacatttgcaaaaaagaaacaaaaaagaatcttttcctgcagcatgtgaagtacctgctgccactgagttacagccactgagttacccttgagctcaagtcagggattaggcatagactaaaagacaccaatgtgcaggc

SEQ ID NO: 109221 - DNA, 601 bp, Human
ttgaaaaaatttaaaaagtagttaagatggtaaatacatatattttcctactgttagaaagggtgggggaatggtaaaggggacaaggtaggaattgagagaaggggaaatcctccttgcaactctagctagctcatcacttagaccaacaccaaaaatctgaaatctgaaaaggactttagagaaaagcagccaagaggatgtgactgctaaccttcccaatttttcaggctaatgtgagagtctcatttccatcagcatcctgcttgggcctcaatgtttgggaaccgttttgaaggayctgtttctggccgacggtacacagagggctccctggggaaccaaactctggctgctctagggcagccccaggaggcagctggcgggcacgttagttacctggatgggtagccagctgcactgattcgaatcgtctccaataccccgcaggctctgagttgctgcactgctctctttgggtcaaagctgccaaaggagaaaaaaaaaaaaaaagcaagacaagagatgagtggccacatttgcaaaaaagaaacaaaaaagaatcttttcctgcagcatgtgaagtacctgctgccactga

SEQ ID NO: 109222 - DNA, 601 bp, Human
aggcataagaacgatacaatgaactttgaggacttgggggaaaggggggtgatggtgagggataaaagactatacattaggtacagtgtatactgcttgggtgatgggtgcaccgaaatctcagaaatcaccactgaagaacttattcatgtaaccaaacaccacttgttcccccaaaaaacctattgaaaaaatttaaaaagtagttaagatggtaaatacatatattttcctactgttagaaagggtgggggaatggtaaaggggacaaggtaggaattgagagaaggggaaatcctcyttgcaactctagctagctcatcacttagaccaacaccaaaaatctgaaatctgaaaaggactttagagaaaagcagccaagaggatgtgactgctaaccttcccaatttttcaggctaatgtgagagtctcatttccatcagcatcctgcttgggcctcaatgtttgggaaccgttttgaaggatctgtttctggccgacggtacacagagggctccctggggaaccaaactctggctgctctagggcagccccaggaggcagctggcgggcacgttagttacctggatgggtagccagc

SEQ ID NO: 109223 - DNA, 601 bp, Human
caggaatggaaaacaaaagatggtacattctcactcataagtgggagctaagctatgaggacgcaaaggcataagaacgatacaatgaactttgaggacttgggggaaaggggggtgatggtgagggataaaagactatacattaggtacagtgtatactgcttgggtgatgggtgcaccgaaatctcagaaatcaccactgaagaacttattcatgtaaccaaacaccacttgttcccccaaaaaacctattgaaaaaatttaaaaagtagttaagatggtaaatacatatattttcctwctgttagaaagggtgggggaatggtaaaggggacaaggtaggaattgagagaaggggaaatcctccttgcaactctagctagctcatcacttagaccaacaccaaaaatctgaaatctgaaaaggactttagagaaaagcagccaagaggatgtgactgctaaccttcccaatttttcaggctaatgtgagagtctcatttccatcagcatcctgcttgggcctcaatgtttgggaaccgttttgaaggatctgtttctggccgacggtacacagagggctccctggggaaccaaactct

SEQ ID NO: 109224 - DNA, 601 bp, Human
cacagcaacctggatggagttagagaccattattctaagtgaagtaactcaggaatggaaaacaaaagatggtacattctcactcataagtgggagctaagctatgaggacgcaaaggcataagaacgatacaatgaactttgaggacttgggggaaaggggggtgatggtgagggataaaagactatacattaggtacagtgtatactgcttgggtgatgggtgcaccgaaatctcagaaatcaccactgaagaacttattcatgtaaccaaacaccacttgttcccccaaaaaacctaytgaaaaaatttaaaaagtagttaagatggtaaatacatatattttcctactgttagaaagggtgggggaatggtaaaggggacaaggtaggaattgagagaaggggaaatcctccttgcaactctagctagctcatcacttagaccaacaccaaaaatctgaaatctgaaaaggactttagagaaaagcagccaagaggatgtgactgctaaccttcccaatttttcaggctaatgtgagagtctcatttccatcagcatcctgcttgggcctcaatgtttgggaaccgttttgaaggat

SEQ ID NO: 109225 - DNA, 601 bp, Human
tggatcaaagacttaaatctaagacctgaaaccataaaaactctagaaggtaacattgggaaaacccttctagacattggcttgggcaacgacttcatgaccaagaacccaaaagcaaacacaatgaaaacaaagataagtagacgggacttaaactaaaaaacttctgcacagcaaaagaaataatcaccagagtaaacagacaacccacggagtgggagaaaatctttgcaatctatacatccaacaaaggactaatgtccagaatctacaaggaactcaaagtagcacgaaaaaaaaaccatcccgtcaaaaagtgggctaaggacatgagaaaataattcccaaaagaagatatacaaatggccaacaaacatgtgaaaaaatgctcaacatcactaattatcagggaaatgcaaatcaaaaccacaaggggataccaccttactcctgcaagaatggccataactgaaaaatcaaaaaatagatgttggcatggatgtggtgaaaagggaatgtttttacactgctggtgggaatgtaaactagaacaactgctatggaaaacagtgtggatattccttaaagaactaagagtaga

SEQ ID NO: 109226 - DNA, 601 bp, Human
caactcaagatggatcaaagacttaaatctaagacctgaaaccataaaaactctagaaggtaacattgggaaaacccttctagacattggcttgggcaacgacttcatgaccaagaacccaaaagcaaacacaatgaaaacaaagataagtagacgggacttaaactaaaaaacttctgcacagcaaaagaaataatcaccagagtaaacagacaacccacggagtgggagaaaatctttgcaatctatacatccaacaaaggactaatgtccagaatctacaaggaactcaaagtagcaagaaaaaaaaaccatcccgtcaaaaagtgggctaaggacatgagaaaataattcccaaaagaagatatacaaatggccaacaaacatgtgaaaaaatgctcaacatcactaattatcagggaaatgcaaatcaaaaccacaaggggataccaccttactcctgcaagaatggccataactgaaaaatcaaaaaatagatgttggcatggatgtggtgaaaagggaatgtttttacactgctggtgggaatgtaaactagaacaactgctatggaaaacagtgtggatattccttaaagaac

SEQ ID NO: 109227 - DNA, 601 bp, Human
atgttttctgtaggtatgtcctctcctggaagactggcagatacaagagccagaagcaggagtgcagccaggagcaggagtgcagccagctgcccgtggaagatggtttgaaaacaagtagctccgcagctccctaaggtcctcttctagttcttaaattggatgaagatatgtctgatctgaaccctgggcttgtaagcaggcaatgaaaggcagtctaatttgtcagactagtggtttgaactcaaaactgaactactgcacccattgcctgagccccatcccctccatcaaaaggccratgtaggagactgcagggtagactgggaaaaggagtgccaggccttcatctgaggtgacaagcttggcccacctcattaacagagttgttagctatttgtgttcagaccctaaggtcaaaaaatgagaggcaggcccaggacactctctgtccttttttctaagcagggacagatgtggttgaaaagaaaataacaacagccttcaacctagctagagcagttcatcctgaacaatgctgggacccgctgggttttgaaaagctgcccgggtgttgcagattactgacagctcttgtact

SEQ ID NO: 109228 - DNA, 601 bp, Human
ccttaagaggccaggggttgtgggcatcttgactctgctggcagctcggattcgcagcaaggtggaatgaacagtaggagaatccattttccacgtgggtctaaagactttggggaaatgcattcttttagctgctaaaaatgaggttgcctggatgaggcaaaatcacacctggtctctcagcatgctacaactaggggagtaagcagtaggaacagggcagtgagcggccagaaaagccctctgcaacttactgtgcctcctagcaccagacatcatgttgtttcctggcaggcagtckctacacccttcaaagtccagctcaagtctcaactcctcagtgaagttgcagctcctcctgcacttgcactacaaccttgcatctggttatatgttgttctgtttcaatctcatatcacttccctgctgggcagggcccatgacttgaatctttcattccctcccaggaagcaacacagggctagatgctcggtgcaggatgagatgtggaagagaaagattcccaggagagaaggacaccacaaaggccagaaactgttctcattctacatagaacccatgtgagcccctagaagcaaaa

SEQ ID NO: 109229 - DNA, 601 bp, Human
gacagctatcagctgccccttaagaggccaggggttgtgggcatcttgactctgctggcagctcggattcgcagcaaggtggaatgaacagtaggagaatccattttccacgtgggtctaaagactttggggaaatgcattcttttagctgctaaaaatgaggttgcctggatgaggcaaaatcacacctggtctctcagcatgctacaactaggggagtaagcagtaggaacagggcagtgagcggccagaaaagccctctgcaacttactgtgcctcctagcaccagacatcatgttgyttcctggcaggcagtcgctacacccttcaaagtccagctcaagtctcaactcctcagtgaagttgcagctcctcctgcacttgcactacaaccttgcatctggttatatgttgttctgtttcaatctcatatcacttccctgctgggcagggcccatgacttgaatctttcattccctcccaggaagcaacacagggctagatgctcggtgcaggatgagatgtggaagagaaagattcccaggagagaaggacaccacaaaggccagaaactgttctcattctacatagaacccatgtg

SEQ ID NO: 109230 - DNA, 601 bp, Human
ttgtaattcccttaatcaaagagggccattgaagtttcttttggaaacagctgtgcaaagttgtatggttacttgacaagctaatatgagctgaatcacttcgctgtgttgagttttcagcagccaaagagcagaatttttgtagaaaactcccaatttatccagcacccaactcaggtccctctggtcctatgaaggtctcctaaagtcacatcaacaaaataactgctcaactccacactgaagctagcacacattacacttgtatatttccttcagtagctaacaccttgttgggcasacagtatccactaaacctcacttgctttatccccagacacagtaggcatataccaatctcctggattaagcagttaggtagcattattattttaatcagtgacatcactccaaatggttaccatggttggcagatggaaaagattaagcaatggtgctgagtcaaaatattacaggtataagagcttcctgccctctcaccgctcatcctcaaagtaaatgccatcctacatgctgtggcttggttgtggtgagaggaaaaggattaggctctggattaaatggtgaggatgattcgact

SEQ ID NO: 109231 - DNA, 601 bp, Human
acacattttcattttaaatcagactcacagagagccataattctcagggaggataaaaatagaccggtatagggaagcccgagggcaggctgagggaacacccggcagctactgctgtcctgcaatgctgcattcctgctctctggcttggtggattttattaatttggggaaggggggtaagaattcctcttccagggcatcggtaggctggatgcaggaactctgccgaaaaagccctctgctcgggctcttgggagcagccctgtggataattcatcacaggcttctgcagtcctggratgacgcattttcttttcctttgccatctccttcactttggctgcttccacacgggaactgttggagatggcataaattgtaattcccttaatcaaagagggccattgaagtttcttttggaaacagctgtgcaaagttgtatggttacttgacaagctaatatgagctgaatcacttcgctgtgttgagttttcagcagccaaagagcagaatttttgtagaaaactcccaatttatccagcacccaactcaggtccctctggtcctatgaaggtctcctaaagtcacatcaacaaaat

SEQ ID NO: 109232 - DNA, 601 bp, Human
tccctttagttctccaatcttatgctatttactcttcacaggactggggagaagaaagttgaggaagaagtggaagtcttttcagaaagtgccacttttatgaagtgaaggtgggaggatgtggaggagaactcaagttcaagcagagtttttttttttttttttttttataatatcaacatttgtacattccccccaccacacacacacttttcggggtaagcagtatttgcttcacaatttctccaggacacaaagctgctgactctctggagagggagacagatgactgcacaggcaygagacctaggagctgggtgacgggtggaaaagcctctcttcctgggcagtgcatttatcacagggctttatgtgcataacaatggacatatttcttagccgctgcacagcatttcaaattgagtgacacattttcattttaaatcagactcacagagagccataattctcagggaggataaaaatagaccggtatagggaagcccgagggcaggctgagggaacacccggcagctactgctgtcctgcaatgctgcattcctgctctctggcttggtggattttattaatttggggaagg

SEQ ID NO: 109233 - DNA, 601 bp, Human
aaacttgtcaaaatgcagatgttcaggactcagtctcaggctctgacttaataggtctgagggggcccagcttctgagactgctgagtatgtccccatgactgacgtgcagccatgcgtgaaaacccgtgggtcaggctccagtccaaaggaacgaagacagatctcacacaaaagagccagacccaaaggctgtgagatcctgagataatgactcatatcattccaaaatcagttctctattattcttcctctgtgggatgtttaatagcaagggaagtaactgtgtgtctgttttaaaytcaaccatgattaaatagggagaggaagcaggccgcttctaaagcttccctttagttctccaatcttatgctatttactcttcacaggactggggagaagaaagttgaggaagaagtggaagtcttttcagaaagtgccacttttatgaagtgaaggtgggaggatgtggaggagaactcaagttcaagcagagtttttttttttttttttttttataatatcaacatttgtacattccccccaccacacacacacttttcggggtaagcagtatttgcttcacaatttctccaggacac

SEQ ID NO: 109234 - DNA, 601 bp, Human
aaatcacctggggaaacttgtcaaaatgcagatgttcaggactcagtctcaggctctgacttaataggtctgagggggcccagcttctgagactgctgagtatgtccccatgactgacgtgcagccatgcgtgaaaacccgtgggtcaggctccagtccaaaggaacgaagacagatctcacacaaaagagccagacccaaaggctgtgagatcctgagataatgactcatatcattccaaaatcagttctctattattcttcctctgtgggatgtttaatagcaagggaagtaactgtgygtctgttttaaattcaaccatgattaaatagggagaggaagcaggccgcttctaaagcttccctttagttctccaatcttatgctatttactcttcacaggactggggagaagaaagttgaggaagaagtggaagtcttttcagaaagtgccacttttatgaagtgaaggtgggaggatgtggaggagaactcaagttcaagcagagtttttttttttttttttttttataatatcaacatttgtacattccccccaccacacacacacttttcggggtaagcagtatttgcttcacaat

SEQ ID NO: 109235 - DNA, 601 bp, Human
tagacagtggtgatggttgtataactctgtatataatgaaaataactgaaattgcatactttaaaggggtgaattttatagtagataaattatatctaaattttgaaaagatgatgaaaacataagaggtttgtgggtggcctttataaagtaatacatacaagttttcagctctgaaactcacggaggggttccagtgcaaaggttgtcacatgctcacccagcactcacaccatcagaaacactccatgtttgcctttccttttatcccccaactatgtcctgggcctcctaggggaayacagactcagccccattagtggccctagatctgaagcctgcagaactttgttgcagagggaaggaaacacaattcctccccactggctccgagttggagctgagacacaaagtgaggacacaggaaaacccactccatcctatcactgcttggatgtgacgaagtggcttgtagtttacccagggggcaacacatgccttcagggtaatgattttaaggcaggatgcatttttaaatcacctggggaaacttgtcaaaatgcagatgttcaggactcagtctcaggctctgacttaatag

SEQ ID NO: 109236 - DNA, 601 bp, Human
gaccggaattctcttgtttcctgcctaagccactcccttccccttttctcacaaaggtgtccttcacacacagctgtaccacagacagggtgtgcagagaggctgaggggagaggagatgccagctcctgtgtgaaggcaaaccgtccactgagaagcaccaccatcgcttcgtggccgtgagggtggggacaccctcaggagggaccaagagagttcagtacccactatggggtctgggaaaatggctgtaaagatgtcgctccccgaaggacccagcatcaaatgtgaattctcctttmggtggatttctgtgagaaaacaaaccctcagagataaaactctcccaagaaaggctccctcacctttaagaggaaaatcttcaaagtgaagctcaagagaatttgtgattctttttccaaaaatagaactttttaaaggggctttctgatttggtggggacctttgggtgtgtgttcactgcaatcacctaaagctggaacagcccactcatgaagaccacaggctgtccagggtttcttgaggctgccatgacggaatctccccctctcacagcattttagctatttccgagtccactg

SEQ ID NO: 109237 - DNA, 601 bp, Human
atggggcgtatggagagctccaaagcttccaaagaccggaattctcttgtttcctgcctaagccactcccttccccttttctcacaaaggtgtccttcacacacagctgtaccacagacagggtgtgcagagaggctgaggggagaggagatgccagctcctgtgtgaaggcaaaccgtccactgagaagcaccaccatcgcttcgtggccgtgagggtggggacaccctcaggagggaccaagagagttcagtacccactatggggtctgggaaaatggctgtaaagatgtcgctccccraaggacccagcatcaaatgtgaattctcctttcggtggatttctgtgagaaaacaaaccctcagagataaaactctcccaagaaaggctccctcacctttaagaggaaaatcttcaaagtgaagctcaagagaatttgtgattctttttccaaaaatagaactttttaaaggggctttctgatttggtggggacctttgggtgtgtgttcactgcaatcacctaaagctggaacagcccactcatgaagaccacaggctgtccagggtttcttgaggctgccatgacggaatctccccct

SEQ ID NO: 109238 - DNA, 601 bp, Human
ttagtagccagggagttcaggagatggggcgtatggagagctccaaagcttccaaagaccggaattctcttgtttcctgcctaagccactcccttccccttttctcacaaaggtgtccttcacacacagctgtaccacagacagggtgtgcagagaggctgaggggagaggagatgccagctcctgtgtgaaggcaaaccgtccactgagaagcaccaccatcgcttcgtggccgtgagggtggggacaccctcaggagggaccaagagagttcagtacccactatggggtctgggaaaakggctgtaaagatgtcgctccccgaaggacccagcatcaaatgtgaattctcctttcggtggatttctgtgagaaaacaaaccctcagagataaaactctcccaagaaaggctccctcacctttaagaggaaaatcttcaaagtgaagctcaagagaatttgtgattctttttccaaaaatagaactttttaaaggggctttctgatttggtggggacctttgggtgtgtgttcactgcaatcacctaaagctggaacagcccactcatgaagaccacaggctgtccagggtttcttgagg

SEQ ID NO: 109239 - DNA, 601 bp, Human
aactatgatcctagacaaatgagaaggcagccacatggcagagtgggctacttgcaggccctgaaatcagctgacctttaacagagatttttcttgtccataaaaagtaagatgttaaaatgtggacactgataggtggaccacagcaaaaacctcaatcaaccggagtccagctaactatagcccttgattaaccagcctgttacccccttaccctgtttaaaaaaaaaaaaaagatggcatggcaaggtgggctagtatttaggctctctttttaaaaaggcaaatttaaagctatgcrtacatttactataatattctgcagtgtctatagctagacttgagcagctaagatgatgctgggaagatggctgcgacacatttacaaaataaaacatgaccttagatcctgatcatctggcaatgagctactccagatggatagattttccgaacagaaaacctgaaaaattaaaatttctgaggtaattatttttattaccttgttcaagtgatttttgatataatttaacctttatcgagccattaatgatcatactctgctgtaatccccaaaatgtctggcaccatggaaatgttt

SEQ ID NO: 109240 - DNA, 601 bp, Human
cccattaactggaggagagcccagtgtgggggccgactcagccagtctgatccgggtcccctccagagttccctctttgggaatcagaggtcttggtggtaatcctggagaaatccagcgaaggaacagaagagggaaactatgatcctagacaaatgagaaggcagccacatggcagagtgggctacttgcaggccctgaaatcagctgacctttaacagagatttttcttgtccataaaaagtaagatgttaaaatgtggacactgataggtggaccacagcaaaaacctcaatcaacyggagtccagctaactatagcccttgattaaccagcctgttacccccttaccctgtttaaaaaaaaaaaaaagatggcatggcaaggtgggctagtatttaggctctctttttaaaaaggcaaatttaaagctatgcgtacatttactataatattctgcagtgtctatagctagacttgagcagctaagatgatgctgggaagatggctgcgacacatttacaaaataaaacatgaccttagatcctgatcatctggcaatgagctactccagatggatagattttccgaacagaaaacc

SEQ ID NO: 109241 - DNA, 601 bp, Human
aaaataaaaaggaggaaatagaagaccccagggaaatctttagcattagtgtctctattcagtctccaggaaggataactgcactcagtgacattactcaatcagactggatcagagggcaatgtagtttagacagcgggagttagaatcagtccacctaggcaaccttgggcaatttatatcagctttctgtgcctcagtttcctcatctgtaaaatgagggtgatttctgtatattcctcataggatgagccattactggcaggtttctagtcatgagcagctcttggctagttccccmgccagctgcaccaactcatgtattcctgtgacaaccaggaattgtgctaggaacacagccacaacaggacccttgtcatttatgtgttcacagtctggtgaaatgacaagccctcaattacaacataaggggatgaacacaataaaggaagggaggaggtgagtgctgctggcccatagaagatggagtagctaacaacatctgggaggctaggaggtatttcagagctcagtttggaagaataccactttgtcaggcaggcaaaagaggggaaaaagcattgcaggcagaggaaacagc

SEQ ID NO: 109242 - DNA, 601 bp, Human
cctaacgaagcagcccccagccccaggctgcccctccaggaaggtggtctttaagtgcctggtgcctgccctgcaggccacctttgtccccacttctcatcgttctgttctaaaacgtacttagaacttgcttgggacagggtggggaactggcatgtgcccctctaagttaacacgcagctctgtcaagtcttagtttctcgatacaaagtcccaggtcactcagcatgagaagtatgggtgtccagatgtggcccaagaagaggagaaaaataaaaaggaggaaatagaagaccccagrgaaatctttagcattagtgtctctattcagtctccaggaaggataactgcactcagtgacattactcaatcagactggatcagagggcaatgtagtttagacagcgggagttagaatcagtccacctaggcaaccttgggcaatttatatcagctttctgtgcctcagtttcctcatctgtaaaatgagggtgatttctgtatattcctcataggatgagccattactggcaggtttctagtcatgagcagctcttggctagttccccagccagctgcaccaactcatgtattcctgtga

SEQ ID NO: 109243 - DNA, 601 bp, Human
taaaaagattatcctcaaatggccacacagttgtatgcataattacaggatgcaaataacccccaaataaaactatgagattgttttggacctgtaattactgtcttaattacatccattaggttaaaattagttgcccttccctgggctcacccctttggatgaggaaagacaacccagcagggttcctgtggacaagcctgggacagagcactgggagagtaacccatgatgacagagctctttgtaaatcaactgccatctcattttgctcactggcatgaagaccataatgagaaasgaaggaatgagccaagtccaaggaaaatacacacacaacattgcatttcatgttggcaaatggccctgaaaaatgctgaatcatcattcttcataggttaagccctattgggttactaggagtcgggttccacacacagggaaggctgtcctgcctgagctaaggctgagcttgcagcagagcttccagcttgagtgtcactgactgagtccccggcctgggccaggctgctcgtgaagctggcaagagtgggctctgggcctggctctcctccctgtgtctgctcagagccatgcaccc

SEQ ID NO: 109244 - DNA, 601 bp, Human
aagctttgagcaaggaaatgacctgatctgatcaacattttaaaaagattatcctcaaatggccacacagttgtatgcataattacaggatgcaaataacccccaaataaaactatgagattgttttggacctgtaattactgtcttaattacatccattaggttaaaattagttgcccttccctgggctcacccctttggatgaggaaagacaacccagcagggttcctgtggacaagcctgggacagagcactgggagagtaacccatgatgacagagctctttgtaaatcaactgccrtctcattttgctcactggcatgaagaccataatgagaaaggaaggaatgagccaagtccaaggaaaatacacacacaacattgcatttcatgttggcaaatggccctgaaaaatgctgaatcatcattcttcataggttaagccctattgggttactaggagtcgggttccacacacagggaaggctgtcctgcctgagctaaggctgagcttgcagcagagcttccagcttgagtgtcactgactgagtccccggcctgggccaggctgctcgtgaagctggcaagagtgggctctggg

SEQ ID NO: 109245 - DNA, 601 bp, Human
ccaggagaagggcagagtggatgcctatgtccagtggtgcaactgctgggtatatctgaggatcaggagagccaggatggctagctgggggaactgaaggtgattggtgggaggagccaatcaccaaaggcctcgtaggttgcagcataaaattggggtgagagccacaggcaagctttgagcaaggaaatgacctgatctgatcaacattttaaaaagattatcctcaaatggccacacagttgtatgcataattacaggatgcaaataacccccaaataaaactatgagattgttttgsacctgtaattactgtcttaattacatccattaggttaaaattagttgcccttccctgggctcacccctttggatgaggaaagacaacccagcagggttcctgtggacaagcctgggacagagcactgggagagtaacccatgatgacagagctctttgtaaatcaactgccatctcattttgctcactggcatgaagaccataatgagaaaggaaggaatgagccaagtccaaggaaaatacacacacaacattgcatttcatgttggcaaatggccctgaaaaatgctgaatcatcatt

SEQ ID NO: 109246 - DNA, 601 bp, Human
gatgcatggaatgtggccatttcctctcctctcttgcctttctgccttcccatctcacctcccagataaagccagtctaacacttcctccccttctgaagggtcttgtttgctgccaggcctataacaagtgctcaattagagactcagtgtgaaatgctaaaaaagaccttggaaatcattcagcaaagcctcaaaggagaaagtgacccactcagcccatgtgtcacctgtttgctgaaatgcatctgattccctagtctagctctctgtttggcctccaaacacaagactttgtggcrattattgtcacttctctaaggaaattcctttctggagagggcactggacttgaaccaggcctgggctcaaaacctaacaaccgagggtagggtcagagggcaggctgtcttcagcctgtcttggctgacacactcctgctgctgtagtgcctcatcagcccagtgtccgtgaggaaggaaccctgcagtagtttcttctgctcggggtcgagctgggggcaggcaggggaggctgattggcatcctgactcaacccctaggtcaacactcctgcttagacaagccactctctctccatcc

SEQ ID NO: 109247 - DNA, 601 bp, Human
tttaattgcatctgcaaagtcccttttgccatataaggtaacacactcacagatcccagggctgagggtatctttaggggtcactgatctgcctgccacagttagtatctgctgtggtctgaggacgtctgtgctccctcgggtcttcggcatgtgcagttcctcaaggaagctgtgggctctctcaaaatgctccagtacccaagcccccgacacccaggtagggagctgcagacactgacctgctcatcgatcttccgctgcagctggaccaccttgttctccatgcccacgttgagaygtttcagatgctctgctgagcgggcctcaatcctgagggccttcagctcccgcctggccttgagcatccggaaggcacactggatgacaatggctgcatcccgcagccgctggaagtgcctgcgtgccatccagccccgcacgtgcttctggatggtggtggccttgtgctccatgaggacctggcgggaaacaaggatacacatcttgtgggtttgcactgcaggacaggagtgaaggaagcatacatcactgcctgtggagggaagaggccagggcagccttggttctaggagttaca

SEQ ID NO: 109248 - DNA, 601 bp, Human
agctacttaacctctgtgtgcctcagtttcttcatccttaaaatgggaataatattaatgtttatctcctagggttctggtggggattaaatgagttaatacgtgagaagagcacagcgtgcctagtcaggtagtgcaggcaagggcacaagaaagcaagagcttatccactcctcccgtcttttctgatcaccctctacacacagggcatcctgcccagggtagctaacacctgccaccactcacagatgtttgccaagcaggaagcttaaggcaaaaagctttttttatttttttttttaaataggccatttaaatctgcttttctttgatttttcaagcacgtggattgtaaaatgctagatttatttttatcctctcaagttaactttagaaatcagcaatgccaatgcagagccccaaggctggaaagcaaggcctgggggagccagcatgtacacagggctcccagcagggtgcagcggtcaatgcctactcatccctgagactgcactctggctggaaggttaactcacaacatttgactaagcaagtcttttcttcctgtcaacagccacaatagccactgccaccttggcat

SEQ ID NO: 109249 - DNA, 601 bp, Human
ctctaaatgtgtgcttgactaaagttaggctggcagagagccgagttcacggactacatcgttttactgaatgacgtcataccacagcctatcccagggacactgcaagaaatggtctcaagaaccagcattgtatatatcaccgtaggatatggtgaaggatgtggcttgtcacgtcacagattatgaaagcccacaggaaaaacaagtcagcaccacggacagctccaaatcctcttgaactgcatggttcttttctattaagaactctcaagccactcagttttcttcctgttactgyttgcatagaaacttggtgccaaatttgcatcttttctttccaggtgggtgtacaaggccttaggatatgaatgttgggtgctagccttaccctggttttatctttgtttcctcccttactgacttcttggcagtgaggatacatttttagaaaaaagctccccaggggattctagagcacagtctggggataggaaccctactctagccagatcatggttatcagtgaatttttgagctagatgttaccttagagatctcaggcgaatccccttggaagaactaaagccccaatcatttc

SEQ ID NO: 109250 - DNA, 601 bp, Human
aggagctttcgtgagcatgtgcagagctggaagctgcctggtagcaggtggctttatggctgggtggatcctataccttatttttaagttgcagaaacaaagaagctggctctctgggtttgcagccttcactttttaggtttctttgctctttcatacagagccctcctgcctgtggacttgccagcacaaagagctgcaatctaatcgctggctttgagacaaaggaccccttcagcatcctctcttccaaggaggccctccatggggtcttggaatctctctcacccctgtcagccayggcttgccccataagactctaagactcagggaactgatgccctgacccaccctgcccaaaccatgctcctgcagatgggatactcaatcccagcccactcaggcaacacacaggtgtgaaacagcccccatgggcccagagccctaagaagctattgctggtatcaagtgctactgcaaattatgggaagaaatcagcaccgcaagagttgagggcattagctaagagtggtcagtgaggaaagtggagaggaagaaatagggctctccaaatcatcaagcaggcaacaatggtcattga

SEQ ID NO: 109251 - DNA, 601 bp, Human
gcatgctcaagtgcttgcctggcatctccctaacaaaacactaatgtaaacttacagaaatagaggaaaacaaagaacagcaacactgacattcaaagagctcaaggagctttcgtgagcatgtgcagagctggaagctgcctggtagcaggtggctttatggctgggtggatcctataccttatttttaagttgcagaaacaaagaagctggctctctgggtttgcagccttcactttttaggtttctttgctctttcatacagagccctcctgcctgtggacttgccagcacaaagagytgcaatctaatcgctggctttgagacaaaggaccccttcagcatcctctcttccaaggaggccctccatggggtcttggaatctctctcacccctgtcagccatggcttgccccataagactctaagactcagggaactgatgccctgacccaccctgcccaaaccatgctcctgcagatgggatactcaatcccagcccactcaggcaacacacaggtgtgaaacagcccccatgggcccagagccctaagaagctattgctggtatcaagtgctactgcaaattatgggaagaaatca

SEQ ID NO: 109252 - DNA, 601 bp, Human
tcctgcagcagcatccagcctgccccaattttgaagttgttactccaacaccctgaacactggatctctccctcttagatccccatccactgcgactccccattgatggacaaacactgaaaaagcgggcaacatgctatttcccttgtggcttgtagagatggtggtgggaggtggggcggtggtgggaggcagaacagcaatgacccaagtctgtggggggctctccaggggcccttgggacttccctggctggaacagttatcttggcagtggagcagggaatctctatgccctgatrctcaggtttggggcaaagctcaggaagttctatttcatggtgtaagaaataagcccaccagggtgggtgtgacaggctgagactttaagtgttcaaaggtgaggcacctccaccaaagcacagtgctgcatcatgggcaggggtgcccagaagctgccctcccctgcaggcagcatcaagatcagccccagcctctgtcacggctttcttgccaacaaggatgcgggccacagagccagccctgggcctaattctagaccataaaaacaatgctcacaggcagacaccatgtgcccctcc

SEQ ID NO: 109253 - DNA, 601 bp, Human
gaggctttctgcacatgcttgggaatggcagagtggggatgggaatctggggactccaaggtctaccgcagggcccttcctgcagcagcatccagcctgccccaattttgaagttgttactccaacaccctgaacactggatctctccctcttagatccccatccactgcgactccccattgatggacaaacactgaaaaagcgggcaacatgctatttcccttgtggcttgtagagatggtggtgggaggtggggcggtggtgggaggcagaacagcaatgacccaagtctgtggggggstctccaggggcccttgggacttccctggctggaacagttatcttggcagtggagcagggaatctctatgccctgatactcaggtttggggcaaagctcaggaagttctatttcatggtgtaagaaataagcccaccagggtgggtgtgacaggctgagactttaagtgttcaaaggtgaggcacctccaccaaagcacagtgctgcatcatgggcaggggtgcccagaagctgccctcccctgcaggcagcatcaagatcagccccagcctctgtcacggctttcttgccaacaaggatg

SEQ ID NO: 109254 - DNA, 601 bp, Human
ggcctctgctccttccagaagccaaacacaatctcatggtggcagccaggtgcaagtctagaaggggccttggagatgatctgaaccaacttttataaatatacacacagatgagggaactaaggccagtgaggctttctgcacatgcttgggaatggcagagtggggatgggaatctggggactccaaggtctaccgcagggcccttcctgcagcagcatccagcctgccccaattttgaagttgttactccaacaccctgaacactggatctctccctcttagatccccatccactgcractccccattgatggacaaacactgaaaaagcgggcaacatgctatttcccttgtggcttgtagagatggtggtgggaggtggggcggtggtgggaggcagaacagcaatgacccaagtctgtggggggctctccaggggcccttgggacttccctggctggaacagttatcttggcagtggagcagggaatctctatgccctgatactcaggtttggggcaaagctcaggaagttctatttcatggtgtaagaaataagcccaccagggtgggtgtgacaggctgagactttaagtgtt

SEQ ID NO: 109255 - DNA, 601 bp, Human
tcttactttcttcttcccttaatctccacacctggatcccacctctggcccctggagatccctggggtctgggtgaaggcaggagctgatggtgctgaggcccgaggtgggaagaagatctatgcaagcccagcacatgctggcactgtaggctctataacctccacggatgtctgtgtgttcctcagctgcatgtgaaggctcaggccaggaaaaggcagtgggaaatagaagagagaaggactcccacgtagggccaagggcctctgctccttccagaagccaaacacaatctcatggwggcagccaggtgcaagtctagaaggggccttggagatgatctgaaccaacttttataaatatacacacagatgagggaactaaggccagtgaggctttctgcacatgcttgggaatggcagagtggggatgggaatctggggactccaaggtctaccgcagggcccttcctgcagcagcatccagcctgccccaattttgaagttgttactccaacaccctgaacactggatctctccctcttagatccccatccactgcgactccccattgatggacaaacactgaaaaagcgggcaac

SEQ ID NO: 109256 - DNA, 601 bp, Human
ggccctcaaagcagcacatcaggagtgtggccttttatgggaagcctgcgtcttactttcttcttcccttaatctccacacctggatcccacctctggcccctggagatccctggggtctgggtgaaggcaggagctgatggtgctgaggcccgaggtgggaagaagatctatgcaagcccagcacatgctggcactgtaggctctataacctccacggatgtctgtgtgttcctcagctgcatgtgaaggctcaggccaggaaaaggcagtgggaaatagaagagagaaggactcccacrtagggccaagggcctctgctccttccagaagccaaacacaatctcatggtggcagccaggtgcaagtctagaaggggccttggagatgatctgaaccaacttttataaatatacacacagatgagggaactaaggccagtgaggctttctgcacatgcttgggaatggcagagtggggatgggaatctggggactccaaggtctaccgcagggcccttcctgcagcagcatccagcctgccccaattttgaagttgttactccaacaccctgaacactggatctctccctcttagatccc

SEQ ID NO: 109257 - DNA, 601 bp, Human
tatctgggcagagggtcctgtgggcagagggccctcaaagcagcacatcaggagtgtggccttttatgggaagcctgcgtcttactttcttcttcccttaatctccacacctggatcccacctctggcccctggagatccctggggtctgggtgaaggcaggagctgatggtgctgaggcccgaggtgggaagaagatctatgcaagcccagcacatgctggcactgtaggctctataacctccacggatgtctgtgtgttcctcagctgcatgtgaaggctcaggccaggaaaaggcagkgggaaatagaagagagaaggactcccacgtagggccaagggcctctgctccttccagaagccaaacacaatctcatggtggcagccaggtgcaagtctagaaggggccttggagatgatctgaaccaacttttataaatatacacacagatgagggaactaaggccagtgaggctttctgcacatgcttgggaatggcagagtggggatgggaatctggggactccaaggtctaccgcagggcccttcctgcagcagcatccagcctgccccaattttgaagttgttactccaacaccct

SEQ ID NO: 109258 - DNA, 601 bp, Human
gagtttccagttctattcttgatcctttctggctttggacctcaccttctggtttttattcatgtagaaaggtcaccatcccattcatctgctcccaagggtagacaaaccacaagtgtggtattccatgatttgtaggttacaagacttgtagacacatttaacaggagtttccaagcaccacgtgctttctcccaaagaatgaatccacttcatgtctcatggtgggcaggctggcaggtgacttatctgggcagagggtcctgtgggcagagggccctcaaagcagcacatcaggagygtggccttttatgggaagcctgcgtcttactttcttcttcccttaatctccacacctggatcccacctctggcccctggagatccctggggtctgggtgaaggcaggagctgatggtgctgaggcccgaggtgggaagaagatctatgcaagcccagcacatgctggcactgtaggctctataacctccacggatgtctgtgtgttcctcagctgcatgtgaaggctcaggccaggaaaaggcagtgggaaatagaagagagaaggactcccacgtagggccaagggcctctgctccttc

SEQ ID NO: 109259 - DNA, 601 bp, Human
tttagcaggaagcagggacgcggggctgggaagctgatgagtcaagtgctatctgttgggacagagataggtgagacctgattttgtggatctgctgggtaaacagactttgcagatgtctcatctgactgggacacacatgcagggaatgttttttctcccagggtcactagtctcaggagtttccagttctattcttgatcctttctggctttggacctcaccttctggtttttattcatgtagaaaggtcaccatcccattcatctgctcccaagggtagacaaaccacaagtgtggwattccatgatttgtaggttacaagacttgtagacacatttaacaggagtttccaagcaccacgtgctttctcccaaagaatgaatccacttcatgtctcatggtgggcaggctggcaggtgacttatctgggcagagggtcctgtgggcagagggccctcaaagcagcacatcaggagtgtggccttttatgggaagcctgcgtcttactttcttcttcccttaatctccacacctggatcccacctctggcccctggagatccctggggtctgggtgaaggcaggagctgatggtgctg

SEQ ID NO: 109260 - DNA, 601 bp, Human
tgcactccctttgatggagacttgggtgtttagagtgctgaagtccccaagttgtagcatttagcaggaagcagggacgcggggctgggaagctgatgagtcaagtgctatctgttgggacagagataggtgagacctgattttgtggatctgctgggtaaacagactttgcagatgtctcatctgactgggacacacatgcagggaatgttttttctcccagggtcactagtctcaggagtttccagttctattcttgatcctttctggctttggacctcaccttctggtttttattcaygtagaaaggtcaccatcccattcatctgctcccaagggtagacaaaccacaagtgtggtattccatgatttgtaggttacaagacttgtagacacatttaacaggagtttccaagcaccacgtgctttctcccaaagaatgaatccacttcatgtctcatggtgggcaggctggcaggtgacttatctgggcagagggtcctgtgggcagagggccctcaaagcagcacatcaggagtgtggccttttatgggaagcctgcgtcttactttcttcttcccttaatctccacacctggatc

SEQ ID NO: 109261 - DNA, 601 bp, Human
gtagcaacatttcttaaggagaggaggagggagtctgcttctctgttttgctcctccaatgaagattttcatattataaactcttatgcactccctttgatggagacttgggtgtttagagtgctgaagtccccaagttgtagcatttagcaggaagcagggacgcggggctgggaagctgatgagtcaagtgctatctgttgggacagagataggtgagacctgattttgtggatctgctgggtaaacagactttgcagatgtctcatctgactgggacacacatgcagggaatgttttytctcccagggtcactagtctcaggagtttccagttctattcttgatcctttctggctttggacctcaccttctggtttttattcatgtagaaaggtcaccatcccattcatctgctcccaagggtagacaaaccacaagtgtggtattccatgatttgtaggttacaagacttgtagacacatttaacaggagtttccaagcaccacgtgctttctcccaaagaatgaatccacttcatgtctcatggtgggcaggctggcaggtgacttatctgggcagagggtcctgtgggcagaggg

SEQ ID NO: 109262 - DNA, 601 bp, Human
cgttcccctccttgcagcgtccttaattttttgttaccaattccaagctctaattttctttaagacctaggtcagcatatcattgctagggaagagtagcaacatttcttaaggagaggaggagggagtctgcttctctgttttgctcctccaatgaagattttcatattataaactcttatgcactccctttgatggagacttgggtgtttagagtgctgaagtccccaagttgtagcatttagcaggaagcagggacgcggggctgggaagctgatgagtcaagtgctatctgttgggrcagagataggtgagacctgattttgtggatctgctgggtaaacagactttgcagatgtctcatctgactgggacacacatgcagggaatgttttttctcccagggtcactagtctcaggagtttccagttctattcttgatcctttctggctttggacctcaccttctggtttttattcatgtagaaaggtcaccatcccattcatctgctcccaagggtagacaaaccacaagtgtggtattccatgatttgtaggttacaagacttgtagacacatttaacaggagtttccaagcacc

SEQ ID NO: 109263 - DNA, 601 bp, Human
tttctgagtgtttctaagttggaatttgcttacatttggggtagggaaggggcttttgcactactctgctcctagcgttcccctccttgcagcgtccttaattttttgttaccaattccaagctctaattttctttaagacctaggtcagcatatcattgctagggaagagtagcaacatttcttaaggagaggaggagggagtctgcttctctgttttgctcctccaatgaagattttcatattataaactcttatgcactccctttgatggagacttgggtgtttagagtgctgaagtycccaagttgtagcatttagcaggaagcagggacgcggggctgggaagctgatgagtcaagtgctatctgttgggacagagataggtgagacctgattttgtggatctgctgggtaaacagactttgcagatgtctcatctgactgggacacacatgcagggaatgttttttctcccagggtcactagtctcaggagtttccagttctattcttgatcctttctggctttggacctcaccttctggtttttattcatgtagaaaggtcaccatcccattcatctgctcccaagggtagaca

SEQ ID NO: 109264 - DNA, 601 bp, Human
gagctgtcacctctgtgcctagggcagccctgggggccacctctctttcaccaaacagagcagccatgcaaaacagcacagctgtacaaaagcagccggcatagggatcgctgaagctttcaaaaagaacgaaatgtacacaatgcacaggctaaaagggaaggaggctaagggcctgggtgtggactaccccgtggaagcgccaaaacaacagatacctttagtagaaaaggatgtcatctaacctatgcgacagagctgctctggactctgtggacagagagatgaattcctgccctcrgggagacttggcctcccacaggccaaggcagggcagccacgtggcccaccaattaatatcgtcagagatggcaagcccagagttttccagcatagcagttccaatacgacactcgctgcctttgctgatggaaatatcaaactcattaaacatctactagcagtcggccccctcactgtgcttggctggtctcatcaatctcgctcaaagcagagcaggcccctgctcaagccttggaggaaaccaattgtctgattactcagcatttattgaaattgacacagtgcctttgataaatat

SEQ ID NO: 109265 - DNA, 601 bp, Human
ccaggcacctggctgtgggtggttcctcctcacccaccacagccctgcaccaagctaagccttgctctggtcccattgagcagccttcagagcagattctgaataatgagctgtcacctctgtgcctagggcagccctgggggccacctctctttcaccaaacagagcagccatgcaaaacagcacagctgtacaaaagcagccggcatagggatcgctgaagctttcaaaaagaacgaaatgtacacaatgcacaggctaaaagggaaggaggctaagggcctgggtgtggactaccccrtggaagcgccaaaacaacagatacctttagtagaaaaggatgtcatctaacctatgcgacagagctgctctggactctgtggacagagagatgaattcctgccctcggggagacttggcctcccacaggccaaggcagggcagccacgtggcccaccaattaatatcgtcagagatggcaagcccagagttttccagcatagcagttccaatacgacactcgctgcctttgctgatggaaatatcaaactcattaaacatctactagcagtcggccccctcactgtgcttggctggtctc

SEQ ID NO: 109266 - DNA, 601 bp, Human
caaggaccagggaccccctctgagagccaggcacctggctgtgggtggttcctcctcacccaccacagccctgcaccaagctaagccttgctctggtcccattgagcagccttcagagcagattctgaataatgagctgtcacctctgtgcctagggcagccctgggggccacctctctttcaccaaacagagcagccatgcaaaacagcacagctgtacaaaagcagccggcatagggatcgctgaagctttcaaaaagaacgaaatgtacacaatgcacaggctaaaagggaaggaggmtaagggcctgggtgtggactaccccgtggaagcgccaaaacaacagatacctttagtagaaaaggatgtcatctaacctatgcgacagagctgctctggactctgtggacagagagatgaattcctgccctcggggagacttggcctcccacaggccaaggcagggcagccacgtggcccaccaattaatatcgtcagagatggcaagcccagagttttccagcatagcagttccaatacgacactcgctgcctttgctgatggaaatatcaaactcattaaacatctactagcagtcgg

SEQ ID NO: 109267 - DNA, 601 bp, Human
gaatgttcagtgcctgggggcctgctagtcatctctcacaaggaccagggaccccctctgagagccaggcacctggctgtgggtggttcctcctcacccaccacagccctgcaccaagctaagccttgctctggtcccattgagcagccttcagagcagattctgaataatgagctgtcacctctgtgcctagggcagccctgggggccacctctctttcaccaaacagagcagccatgcaaaacagcacagctgtacaaaagcagccggcatagggatcgctgaagctttcaaaaagaaygaaatgtacacaatgcacaggctaaaagggaaggaggctaagggcctgggtgtggactaccccgtggaagcgccaaaacaacagatacctttagtagaaaaggatgtcatctaacctatgcgacagagctgctctggactctgtggacagagagatgaattcctgccctcggggagacttggcctcccacaggccaaggcagggcagccacgtggcccaccaattaatatcgtcagagatggcaagcccagagttttccagcatagcagttccaatacgacactcgctgcctttgctgat

SEQ ID NO: 109268 - DNA, 601 bp, Human
ggctcaacacactctgctatgagagcccccattccccaagccagatctctctacctctatttggagaaatcaaaacctttataacttgaactacccaaggcaatcaactagtggctagtggttctatgactgatgtcttgatacaatgcacaacccagccccactagtccgaatgttcagtgcctgggggcctgctagtcatctctcacaaggaccagggaccccctctgagagccaggcacctggctgtgggtggttcctcctcacccaccacagccctgcaccaagctaagccttgctstggtcccattgagcagccttcagagcagattctgaataatgagctgtcacctctgtgcctagggcagccctgggggccacctctctttcaccaaacagagcagccatgcaaaacagcacagctgtacaaaagcagccggcatagggatcgctgaagctttcaaaaagaacgaaatgtacacaatgcacaggctaaaagggaaggaggctaagggcctgggtgtggactaccccgtggaagcgccaaaacaacagatacctttagtagaaaaggatgtcatctaacctatgcgacagagct

SEQ ID NO: 109269 - DNA, 601 bp, Human
tcttggctggtcaaagtagctctgctccacacctttggggagaaggctcaacacactctgctatgagagcccccattccccaagccagatctctctacctctatttggagaaatcaaaacctttataacttgaactacccaaggcaatcaactagtggctagtggttctatgactgatgtcttgatacaatgcacaacccagccccactagtccgaatgttcagtgcctgggggcctgctagtcatctctcacaaggaccagggaccccctctgagagccaggcacctggctgtgggtggytcctcctcacccaccacagccctgcaccaagctaagccttgctctggtcccattgagcagccttcagagcagattctgaataatgagctgtcacctctgtgcctagggcagccctgggggccacctctctttcaccaaacagagcagccatgcaaaacagcacagctgtacaaaagcagccggcatagggatcgctgaagctttcaaaaagaacgaaatgtacacaatgcacaggctaaaagggaaggaggctaagggcctgggtgtggactaccccgtggaagcgccaaaacaacagat

SEQ ID NO: 109270 - DNA, 601 bp, Human
gatgggtcagtgtccccttcctaataatcctcagcctccacatgaaccatgagtcctggtgctgctgagagcacaaccccctcttggctggtcaaagtagctctgctccacacctttggggagaaggctcaacacactctgctatgagagcccccattccccaagccagatctctctacctctatttggagaaatcaaaacctttataacttgaactacccaaggcaatcaactagtggctagtggttctatgactgatgtcttgatacaatgcacaacccagccccactagtccgaatgytcagtgcctgggggcctgctagtcatctctcacaaggaccagggaccccctctgagagccaggcacctggctgtgggtggttcctcctcacccaccacagccctgcaccaagctaagccttgctctggtcccattgagcagccttcagagcagattctgaataatgagctgtcacctctgtgcctagggcagccctgggggccacctctctttcaccaaacagagcagccatgcaaaacagcacagctgtacaaaagcagccggcatagggatcgctgaagctttcaaaaagaacgaaat

SEQ ID NO: 109271 - DNA, 601 bp, Human
tccccttactcagatgtcttctcagaaagaccttctgtggccatcaaaagtgaaatcatacccctcaggcccccacaggtcaccctccatcccctttactctgcttcattgttgtttgtagcccttggggggtaattcacgttagattcctctctgtactttcttcccccatccccacacatttaagctccttaacaatgagaagggttttttcaaacaccattcaccttttgccccagtgtgtagaacagggtctaacacatacaggcattcaaacacctgctgaatgaaggaccatgakcttctgtgctttctgcagcaagacaacgtccttccagagatgggtcagtgtccccttcctaataatcctcagcctccacatgaaccatgagtcctggtgctgctgagagcacaaccccctcttggctggtcaaagtagctctgctccacacctttggggagaaggctcaacacactctgctatgagagcccccattccccaagccagatctctctacctctatttggagaaatcaaaacctttataacttgaactacccaaggcaatcaactagtggctagtggttctatgactgatgtc

SEQ ID NO: 109272 - DNA, 601 bp, Human
ttttctgagaatgttcttctaagtaagcatagtataaatttgttttttaaagtagtgattaaagcaaaagttgaaaatcaacatcccttggatagtaagacaactttgaaacaatggctaaaatatcttcaaaatggtcctgcagatgtgttttaattcctctctcacccctaagctcacagaagctgaagtgcctaggacagagttgctcatctctctggaggtttcatgggtcaaggccgcgcttgaagtcagaagatccttcctgacctggccgcactgtgctcctgctgtttgcctyctcacttactccacctgagcccagtgagcacctcattggtcctcacacccacccagcctactcatgccccaaggcctgtgcacgtgtgccacacctgtcacctgttatccccaaatcgccttggcttattttctccccttactcagatgtcttctcagaaagaccttctgtggccatcaaaagtgaaatcatacccctcaggcccccacaggtcaccctccatcccctttactctgcttcattgttgtttgtagcccttggggggtaattcacgttagattcctctctgtactttcttcc

SEQ ID NO: 109273 - DNA, 601 bp, Human
tcttgcaggcaacattactcagtgtttcttctaaaagcttatttgggacagcttatcagaatcaacactggaggaaaatcctgtatctatgaggctaatacagtacctatattaagttaagtaaatgccccagcaacatgctaaagaactgtctttactagtttgtctttggggatacaaatgtagctaggggctttgttttgtcttatgttttcaagagggatattagtactataagaagacccagcgcaaggtttctagtagcaaacatgggaaaactggttggacaatgccaatcagraaaggttcctctgccatctgtccttgatgctgtgcagttaccacatttacaggcacagccctaggtagggacaatacctttaattctgcaaaatcttgaagtgtttatttgaccattttctgagaatgttcttctaagtaagcatagtataaatttgttttttaaagtagtgattaaagcaaaagttgaaaatcaacatcccttggatagtaagacaactttgaaacaatggctaaaatatcttcaaaatggtcctgcagatgtgttttaattcctctctcacccctaagctcacagaag

SEQ ID NO: 109274 - DNA, 601 bp, Human
tcaggcaaaggggttggctttctgcccaacaggaggtcaaatcagataaagctgataaaaatatacatgcatcaaactaattataccaagttattattctttggcaatttattttgccaaagaataacatttattgcctataatatttattgcctataataattaatgcaacagatgttgtatgtcttcagaggctaaaatgtgacctggtgttgagggcaaggtacagaagaagaagcaccgaccgagagtgacgatgttttatccgtagaggcacccactcaccaagcctagttctggyccctagtatgacacagggcaaggctgtcactcatccatcacacatttcctgatacacctctataccaggagccttgccagggctgggggataccaaatgagatagactgactcatggtagttgatatggtttggacgttcatttcctccaaatctcgtgttgaaatgtgattcctaatgttggaggtggggcctggtgagaggtgactgggtcatgggggtggatccctcatgaatgctgtagcacaatccccttggtgaactcatccctcactgagttcacaatagaaggtgtaggtgg

SEQ ID NO: 109275 - DNA, 601 bp, Human
caagtaaatgataagcacagtcagggactctcggtatggagagtcaggcaaaggggttggctttctgcccaacaggaggtcaaatcagataaagctgataaaaatatacatgcatcaaactaattataccaagttattattctttggcaatttattttgccaaagaataacatttattgcctataatatttattgcctataataattaatgcaacagatgttgtatgtcttcagaggctaaaatgtgacctggtgttgagggcaaggtacagaagaagaagcaccgaccgagagtgacgaygttttatccgtagaggcacccactcaccaagcctagttctggcccctagtatgacacagggcaaggctgtcactcatccatcacacatttcctgatacacctctataccaggagccttgccagggctgggggataccaaatgagatagactgactcatggtagttgatatggtttggacgttcatttcctccaaatctcgtgttgaaatgtgattcctaatgttggaggtggggcctggtgagaggtgactgggtcatgggggtggatccctcatgaatgctgtagcacaatccccttgg

SEQ ID NO: 109276 - DNA, 601 bp, Human
ttcaatctttctttcccttcaattcaagcagactcagtttgtctcatccgtttatctgtggatgggcttccatgagttacaagaaggaggctctgacaagcatgttttcaaaagttgtccaggtaattctgaggctctagaggttgagagctgctggtcttatgtctttatatccagcagaactcctcaccccacaagtaaatgataagcacagtcagggactctcggtatggagagtcaggcaaaggggttggctttctgcccaacaggaggtcaaatcagataaagctgataaaaatawacatgcatcaaactaattataccaagttattattctttggcaatttattttgccaaagaataacatttattgcctataatatttattgcctataataattaatgcaacagatgttgtatgtcttcagaggctaaaatgtgacctggtgttgagggcaaggtacagaagaagaagcaccgaccgagagtgacgatgttttatccgtagaggcacccactcaccaagcctagttctggcccctagtatgacacagggcaaggctgtcactcatccatcacacatttcctgatacacctctat

SEQ ID NO: 109277 - DNA, 601 bp, Human
tttaaggagtttttcaatctttctttcccttcaattcaagcagactcagtttgtctcatccgtttatctgtggatgggcttccatgagttacaagaaggaggctctgacaagcatgttttcaaaagttgtccaggtaattctgaggctctagaggttgagagctgctggtcttatgtctttatatccagcagaactcctcaccccacaagtaaatgataagcacagtcagggactctcggtatggagagtcaggcaaaggggttggctttctgcccaacaggaggtcaaatcagataaagstgataaaaatatacatgcatcaaactaattataccaagttattattctttggcaatttattttgccaaagaataacatttattgcctataatatttattgcctataataattaatgcaacagatgttgtatgtcttcagaggctaaaatgtgacctggtgttgagggcaaggtacagaagaagaagcaccgaccgagagtgacgatgttttatccgtagaggcacccactcaccaagcctagttctggcccctagtatgacacagggcaaggctgtcactcatccatcacacatttcctg

SEQ ID NO: 109278 - DNA, 601 bp, Human
ctggggagctgctgatgggtctgtagtggccttacattaggtttgtcctttaagggcccatagagaaaagtaggatacacaatacaatactattaagggcttgcaaaaagatccaagcactttgttaacacccttttttttgagacaaggtctcaccctgttacccaagctggagtgctgtggtgagatctcggttcactgcagcctcgacctccccaggctctggtgatcctcccacctcagcctcctgagtagctaggactacaggtgcctgccaacatgcccggctaatttttgtatytttagtatagacggggttttgccatgttggccaggttggtcttgaactcttgggctcaagtgatttgcccaccttggcctcccaaagtagctgggtttacagatatgagccaccggcacctgaccaacacttttaacagtctagaaccccttcaaatttaaggagtttttcaatctttctttcccttcaattcaagcagactcagtttgtctcatccgtttatctgtggatgggcttccatgagttacaagaaggaggctctgacaagcatgttttcaaaagttgtccaggtaattctga

SEQ ID NO: 109279 - DNA, 601 bp, Human
tgaatttcaactggttacaatgcttaaatgccaactttccttcctctcctggctgtaaattaagctcaaggcaccaagaggtgagttaataagggaggagctgccccaccctcggcatcaggtagaaaggggcaggaaaaaatggcaacacactggagctaaggattggggtcactggctctccccaccccaggaactcagaaggcagcgactctcacttaaaggtgcctcagctactctggggagctgctgatgggtctgtagtggccttacattaggtttgtcctttaagggcccatakagaaaagtaggatacacaatacaatactattaagggcttgcaaaaagatccaagcactttgttaacacccttttttttgagacaaggtctcaccctgttacccaagctggagtgctgtggtgagatctcggttcactgcagcctcgacctccccaggctctggtgatcctcccacctcagcctcctgagtagctaggactacaggtgcctgccaacatgcccggctaatttttgtatttttagtatagacggggttttgccatgttggccaggttggtcttgaactcttgggctcaagtg

SEQ ID NO: 109280 - DNA, 601 bp, Human
catgaggtttgaatttcaactggttacaatgcttaaatgccaactttccttcctctcctggctgtaaattaagctcaaggcaccaagaggtgagttaataagggaggagctgccccaccctcggcatcaggtagaaaggggcaggaaaaaatggcaacacactggagctaaggattggggtcactggctctccccaccccaggaactcagaaggcagcgactctcacttaaaggtgcctcagctactctggggagctgctgatgggtctgtagtggccttacattaggtttgtcctttaarggcccatagagaaaagtaggatacacaatacaatactattaagggcttgcaaaaagatccaagcactttgttaacacccttttttttgagacaaggtctcaccctgttacccaagctggagtgctgtggtgagatctcggttcactgcagcctcgacctccccaggctctggtgatcctcccacctcagcctcctgagtagctaggactacaggtgcctgccaacatgcccggctaatttttgtatttttagtatagacggggttttgccatgttggccaggttggtcttgaactcttgg

SEQ ID NO: 109281 - DNA, 601 bp, Human
acgttcatttcctccaaatgcatgaggtttgaatttcaactggttacaatgcttaaatgccaactttccttcctctcctggctgtaaattaagctcaaggcaccaagaggtgagttaataagggaggagctgccccaccctcggcatcaggtagaaaggggcaggaaaaaatggcaacacactggagctaaggattggggtcactggctctccccaccccaggaactcagaaggcagcgactctcacttaaaggtgcctcagctactctggggagctgctgatgggtctgtagtggccttmcattaggtttgtcctttaagggcccatagagaaaagtaggatacacaatacaatactattaagggcttgcaaaaagatccaagcactttgttaacacccttttttttgagacaaggtctcaccctgttacccaagctggagtgctgtggtgagatctcggttcactgcagcctcgacctccccaggctctggtgatcctcccacctcagcctcctgagtagctaggactacaggtgcctgccaacatgcccggctaatttttgtatttttagtatagacggggttttgccatgttggcca

SEQ ID NO: 109282 - DNA, 601 bp, Human
cctagggatatggactaaaccagcagaagcctaaattgatatggtttggacgttcatttcctccaaatgcatgaggtttgaatttcaactggttacaatgcttaaatgccaactttccttcctctcctggctgtaaattaagctcaaggcaccaagaggtgagttaataagggaggagctgccccaccctcggcatcaggtagaaaggggcaggaaaaaatggcaacacactggagctaaggattggggtcactggctctccccaccccaggaactcagaaggcagcgactctcacttaawggtgcctcagctactctggggagctgctgatgggtctgtagtggccttacattaggtttgtcctttaagggcccatagagaaaagtaggatacacaatacaatactattaagggcttgcaaaaagatccaagcactttgttaacacccttttttttgagacaaggtctcaccctgttacccaagctggagtgctgtggtgagatctcggttcactgcagcctcgacctccccaggctctggtgatcctcccacctcagcctcctgagtagctaggactacaggtgcctgccaacatgccc

SEQ ID NO: 109283 - DNA, 601 bp, Human
ccccatcagacaggcacctttcaaactcttctagacttcatggcattaaaacccagagaggtggccctagggatatggactaaaccagcagaagcctaaattgatatggtttggacgttcatttcctccaaatgcatgaggtttgaatttcaactggttacaatgcttaaatgccaactttccttcctctcctggctgtaaattaagctcaaggcaccaagaggtgagttaataagggaggagctgccccaccctcggcatcaggtagaaaggggcaggaaaaaatggcaacacactggarctaaggattggggtcactggctctccccaccccaggaactcagaaggcagcgactctcacttaaaggtgcctcagctactctggggagctgctgatgggtctgtagtggccttacattaggtttgtcctttaagggcccatagagaaaagtaggatacacaatacaatactattaagggcttgcaaaaagatccaagcactttgttaacacccttttttttgagacaaggtctcaccctgttacccaagctggagtgctgtggtgagatctcggttcactgcagcctcgacctccccagg

SEQ ID NO: 109284 - DNA, 601 bp, Human
gtctcaacctgtgtagaaagagtctcaaaaatgacctcctcaggacagcaccacaacacataatgactagcaagtgtgcaatggcagagggactaattggtgactactgggattgcaacctaggagatgaccacgtggagcagaggagagatgaccatacagacccctgagtacccacctgcacccccatcagacaggcacctttcaaactcttctagacttcatggcattaaaacccagagaggtggccctagggatatggactaaaccagcagaagcctaaattgatatggtttggacrttcatttcctccaaatgcatgaggtttgaatttcaactggttacaatgcttaaatgccaactttccttcctctcctggctgtaaattaagctcaaggcaccaagaggtgagttaataagggaggagctgccccaccctcggcatcaggtagaaaggggcaggaaaaaatggcaacacactggagctaaggattggggtcactggctctccccaccccaggaactcagaaggcagcgactctcacttaaaggtgcctcagctactctggggagctgctgatgggtctgtagtggccttaca

SEQ ID NO: 109285 - DNA, 601 bp, Human
cccaccactcacctcctgctgtgcggcctggttcctggaccactactggtccatggcctaggggttggggactcctgtgatacatgactcatagcatgagtatataaaaatcacttgcaactcaacaataaaaagacaacccaattttaaaaacgggcaaagaactgaaatagacatttctccaaagaagatatacaaatggccgataaacacagaaaagacactcagtatcttattagggaaatacaaatcaaagccacactgagataacagttcacactcaccaggatggctataatamagacagacaataacaagtgttggtgagaatatgaagaaatcagaaccctcatatgctgctggtgggaatataaaatggtgcagcagctctggaaaacactctggcaattcctcaaaaggtttaacatagagttgccatgtgacccaggattgctactcctgggcagatacccaagataaatgaaaacctagtccacacaaaaacttgtacgctgactgacacaaagaacaacctcaccctttctagcttaagtcacaggatgcagtcatcttccagaggactcgtctcaacctgtgtaga

SEQ ID NO: 109286 - DNA, 601 bp, Human
ataatcaaaggtgctgggacaaatggatatctacatggaaaaaaatgaagctggaccactacctcataatatacaaaaattaactcaaaatgcattaaagacttaaatgtaagggctaaaactataaaactctcagaagaaaacatggcaacaaatctttgtgacctttggattaggcacaagccaaatacaatgccaaaagcacaagccaccaagttaaaaataaattgaacttcattaaaatttaaagtttttatgcttcaaaccatcaagaaagtgaaagggcaacccacagaatggraaaaaatattttcaaatcacctatctgatacatcagcagtctccaaactttttggcaccagagatcagtttgatggaagacaatttttccacggaccagggtgacgggggaatggtttcagcatgattcaagcactttatatttattatatactttatttctattattattacattgtaatatacaattaaatcattatacaactcaccataatgtagaatcagtgggagccctgagcttgttttcctgcaactagatggtcctatctgggggtgatgggagacagtgacagatcatcag

SEQ ID NO: 109287 - DNA, 601 bp, Human
ggttctagccagggcaataggcaagaaagataaaaacatccagaatgaatgctatctgcagatgacacaatcttgtatacagaaaatcctaagaaattcacttaaaaactattagaataaatgagttcaggttgcagggtccaatttcaatatacaaaactcaattgtatttgtatatatttgcaatgaacaatctgaaaaataaattaagaaaacgattccactataatggcataaaatatttaggaataactttaacaagagaagtataaaattcatactcggtaaatgaaaaaacatwattgaaagaaattaaagatcttaataaatggaaagacatcttgagataatggatcaaaacactttttaagatggcaacactcctcaaattcatctacagattcaatgtaatcattatgaagatcctgcatggcttctctgcagaaattcatgagctgttccttaaattcatatataatatctagggatccagaatacccaaacgatcttgaagaagatgaacaaagctggaataatcacacttctaaattttaaaacttactagaagataaagtaatacagacagcgtgatactggcata

SEQ ID NO: 109288 - DNA, 601 bp, Human
ctcttgccacttctattcagcattgtactgaaggttctagccagggcaataggcaagaaagataaaaacatccagaatgaatgctatctgcagatgacacaatcttgtatacagaaaatcctaagaaattcacttaaaaactattagaataaatgagttcaggttgcagggtccaatttcaatatacaaaactcaattgtatttgtatatatttgcaatgaacaatctgaaaaataaattaagaaaacgattccactataatggcataaaatatttaggaataactttaacaagagaagtrtaaaattcatactcggtaaatgaaaaaacattattgaaagaaattaaagatcttaataaatggaaagacatcttgagataatggatcaaaacactttttaagatggcaacactcctcaaattcatctacagattcaatgtaatcattatgaagatcctgcatggcttctctgcagaaattcatgagctgttccttaaattcatatataatatctagggatccagaatacccaaacgatcttgaagaagatgaacaaagctggaataatcacacttctaaattttaaaacttactagaaga

SEQ ID NO: 109289 - DNA, 601 bp, Human
gtctgctcttgccacttctattcagcattgtactgaaggttctagccagggcaataggcaagaaagataaaaacatccagaatgaatgctatctgcagatgacacaatcttgtatacagaaaatcctaagaaattcacttaaaaactattagaataaatgagttcaggttgcagggtccaatttcaatatacaaaactcaattgtatttgtatatatttgcaatgaacaatctgaaaaataaattaagaaaacgattccactataatggcataaaatatttaggaataactttaacaagasaagtataaaattcatactcggtaaatgaaaaaacattattgaaagaaattaaagatcttaataaatggaaagacatcttgagataatggatcaaaacactttttaagatggcaacactcctcaaattcatctacagattcaatgtaatcattatgaagatcctgcatggcttctctgcagaaattcatgagctgttccttaaattcatatataatatctagggatccagaatacccaaacgatcttgaagaagatgaacaaagctggaataatcacacttctaaattttaaaacttacta

SEQ ID NO: 109290 - DNA, 601 bp, Human
aagacaagggtgtctgctcttgccacttctattcagcattgtactgaaggttctagccagggcaataggcaagaaagataaaaacatccagaatgaatgctatctgcagatgacacaatcttgtatacagaaaatcctaagaaattcacttaaaaactattagaataaatgagttcaggttgcagggtccaatttcaatatacaaaactcaattgtatttgtatatatttgcaatgaacaatctgaaaaataaattaagaaaacgattccactataatggcataaaatatttaggaataamtttaacaagagaagtataaaattcatactcggtaaatgaaaaaacattattgaaagaaattaaagatcttaataaatggaaagacatcttgagataatggatcaaaacactttttaagatggcaacactcctcaaattcatctacagattcaatgtaatcattatgaagatcctgcatggcttctctgcagaaattcatgagctgttccttaaattcatatataatatctagggatccagaatacccaaacgatcttgaagaagatgaacaaagctggaataatcacacttctaaatttt

SEQ ID NO: 109291 - DNA, 601 bp, Human
tctgataccaaaaccaaagaaatcactaaaaaccaaactacagcccagtatctcttatgaacatagattcaaaaatcctcaactaaatactagcaagtggttatgataaaaacactcaaactacaaatagaagtgaacatcctcaacctgataaaaattccatagctcataccacactttatggtgaaagactgaatgcgtttcccctaagatcaggaagacaagggtgtctgctcttgccacttctattcagcattgtactgaaggttctagccagggcaataggcaagaaagataaaarcatccagaatgaatgctatctgcagatgacacaatcttgtatacagaaaatcctaagaaattcacttaaaaactattagaataaatgagttcaggttgcagggtccaatttcaatatacaaaactcaattgtatttgtatatatttgcaatgaacaatctgaaaaataaattaagaaaacgattccactataatggcataaaatatttaggaataactttaacaagagaagtataaaattcatactcggtaaatgaaaaaacattattgaaagaaattaaagatcttaataaatggaaag

SEQ ID NO: 109292 - DNA, 601 bp, Human
ccagtgttactctgataccaaaaccaaagaaatcactaaaaaccaaactacagcccagtatctcttatgaacatagattcaaaaatcctcaactaaatactagcaagtggttatgataaaaacactcaaactacaaatagaagtgaacatcctcaacctgataaaaattccatagctcataccacactttatggtgaaagactgaatgcgtttcccctaagatcaggaagacaagggtgtctgctcttgccacttctattcagcattgtactgaaggttctagccagggcaataggcaagraagataaaaacatccagaatgaatgctatctgcagatgacacaatcttgtatacagaaaatcctaagaaattcacttaaaaactattagaataaatgagttcaggttgcagggtccaatttcaatatacaaaactcaattgtatttgtatatatttgcaatgaacaatctgaaaaataaattaagaaaacgattccactataatggcataaaatatttaggaataactttaacaagagaagtataaaattcatactcggtaaatgaaaaaacattattgaaagaaattaaagatcttaat

SEQ ID NO: 109293 - DNA, 601 bp, Human
gcgcagtggctcacacctgtaatcccagcactttgggaggccgaggcaggcagatcatgaggtcaagagatcgagaccatcctggctaacacggtgaaaccccatctctactaaaaatacaaaaaattagccaggcgtggtgttgggtgcctgtagtcccagctactcgggaggctgaggcaggagaatggcgtgaacccaggaagaagagcttgcagtgagccgagatcgcgccactgtactccagcctgggagacagtgagactccgtctcaaaaaaaaaaaaagtgcgaagaaagttyttaaaaaatgtttttgctatttattattagagcaactatttgtatgggtttttaaaaagtaacaattcagctgtgttctaagagaatttgaaatcattagttggtatagaggaggatgggaaagggtcttttataacatgggggctaaattgcaattgattcacctttgcgcttggatcccctacagattcattctgcaggaggctgtcaagtaattttccctactaaaatcacatccctgcctttgtgacatggatgaggacatagctgagcattgcaaaaaacaggcagggagagaat

SEQ ID NO: 109294 - DNA, 601 bp, Human
gtgtgaagaggccaggcgcagtggctcacacctgtaatcccagcactttgggaggccgaggcaggcagatcatgaggtcaagagatcgagaccatcctggctaacacggtgaaaccccatctctactaaaaatacaaaaaattagccaggcgtggtgttgggtgcctgtagtcccagctactcgggaggctgaggcaggagaatggcgtgaacccaggaagaagagcttgcagtgagccgagatcgcgccactgtactccagcctgggagacagtgagactccgtctcaaaaaaaaaaaaagtgcgaagaaagtttttaaaaaatgtttttgctatttattattagagcaactatttgtatgggtttttaaaaagtaacaattcagctgtgttctaagagaatttgaaatcattagttggtatagaggaggatgggaaagggtcttttataacatgggggctaaattgcaattgattcacctttgcgcttggatcccctacagattcattctgcaggaggctgtcaagtaattttccctactaaaatcacatccctgcctttgtgacatggatgaggacatagctgagcattgcaaaaaac

SEQ ID NO: 109295 - DNA, 601 bp, Human
gacactcaactgtctaatctagtgctggacttctgatgatgttgacaaaaccaaaataaggtgactattaccagaaaaaaaaggtataaaagaaaaaatactaattaaacaaaaattgtagtctactcaaagaggagtaagaattaaaagtgtgaagaggccaggcgcagtggctcacacctgtaatcccagcactttgggaggccgaggcaggcagatcatgaggtcaagagatcgagaccatcctggctaacacggtgaaaccccatctctactaaaaatacaaaaaattagccaggcrtggtgttgggtgcctgtagtcccagctactcgggaggctgaggcaggagaatggcgtgaacccaggaagaagagcttgcagtgagccgagatcgcgccactgtactccagcctgggagacagtgagactccgtctcaaaaaaaaaaaaagtgcgaagaaagtttttaaaaaatgtttttgctatttattattagagcaactatttgtatgggtttttaaaaagtaacaattcagctgtgttctaagagaatttgaaatcattagttggtatagaggaggatgggaaagggtcttttataa

SEQ ID NO: 109296 - DNA, 601 bp, Human
cacagttcaaattctggaaaagagataacttgctattgacactcaactgtctaatctagtgctggacttctgatgatgttgacaaaaccaaaataaggtgactattaccagaaaaaaaaggtataaaagaaaaaatactaattaaacaaaaattgtagtctactcaaagaggagtaagaattaaaagtgtgaagaggccaggcgcagtggctcacacctgtaatcccagcactttgggaggccgaggcaggcagatcatgaggtcaagagatcgagaccatcctggctaacacggtgaaaycccatctctactaaaaatacaaaaaattagccaggcgtggtgttgggtgcctgtagtcccagctactcgggaggctgaggcaggagaatggcgtgaacccaggaagaagagcttgcagtgagccgagatcgcgccactgtactccagcctgggagacagtgagactccgtctcaaaaaaaaaaaaagtgcgaagaaagtttttaaaaaatgtttttgctatttattattagagcaactatttgtatgggtttttaaaaagtaacaattcagctgtgttctaagagaatttgaaatcatta

SEQ ID NO: 109297 - DNA, 601 bp, Human
acccacttgctttacctgtcttattggaccagcacagttcaaattctggaaaagagataacttgctattgacactcaactgtctaatctagtgctggacttctgatgatgttgacaaaaccaaaataaggtgactattaccagaaaaaaaaggtataaaagaaaaaatactaattaaacaaaaattgtagtctactcaaagaggagtaagaattaaaagtgtgaagaggccaggcgcagtggctcacacctgtaatcccagcactttgggaggccgaggcaggcagatcatgaggtcaagwgatcgagaccatcctggctaacacggtgaaaccccatctctactaaaaatacaaaaaattagccaggcgtggtgttgggtgcctgtagtcccagctactcgggaggctgaggcaggagaatggcgtgaacccaggaagaagagcttgcagtgagccgagatcgcgccactgtactccagcctgggagacagtgagactccgtctcaaaaaaaaaaaaagtgcgaagaaagtttttaaaaaatgtttttgctatttattattagagcaactatttgtatgggtttttaaaaagtaacaatt

SEQ ID NO: 109298 - DNA, 601 bp, Human
aatgaacaaatgatctctggtcttcaacccacttgctttacctgtcttattggaccagcacagttcaaattctggaaaagagataacttgctattgacactcaactgtctaatctagtgctggacttctgatgatgttgacaaaaccaaaataaggtgactattaccagaaaaaaaaggtataaaagaaaaaatactaattaaacaaaaattgtagtctactcaaagaggagtaagaattaaaagtgtgaagaggccaggcgcagtggctcacacctgtaatcccagcactttgggaggcygaggcaggcagatcatgaggtcaagagatcgagaccatcctggctaacacggtgaaaccccatctctactaaaaatacaaaaaattagccaggcgtggtgttgggtgcctgtagtcccagctactcgggaggctgaggcaggagaatggcgtgaacccaggaagaagagcttgcagtgagccgagatcgcgccactgtactccagcctgggagacagtgagactccgtctcaaaaaaaaaaaaagtgcgaagaaagtttttaaaaaatgtttttgctatttattattagagcaactattt

SEQ ID NO: 109299 - DNA, 601 bp, Human
gcagttgtgcaagcctgcaccgagtcaagttgctgactgacaaccacacccttctccctatctcttttactcaataaatacgaagggagctaaaaactcagggccctcgtttactggaagcaaggagcccccaaccccttcttccaaatatactcttttgtctttgtctttattcccacattcatccccttttgttcagtccaacagggattgggtccacgtcagctttcatgtttttgtatttgtttgcctgtcttgctaaattttgggctctcaaatctggtcttaggaaggccaaaakctcacaatgaacaaatgatctctggtcttcaacccacttgctttacctgtcttattggaccagcacagttcaaattctggaaaagagataacttgctattgacactcaactgtctaatctagtgctggacttctgatgatgttgacaaaaccaaaataaggtgactattaccagaaaaaaaaggtataaaagaaaaaatactaattaaacaaaaattgtagtctactcaaagaggagtaagaattaaaagtgtgaagaggccaggcgcagtggctcacacctgtaatcccagcactttgg

SEQ ID NO: 109300 - DNA, 601 bp, Human
gtagcctctagtctaactgcatgcttgctaggagtctttgggagaagtcagtgaggaaaagagattaaaaccccaaataaaactcaagtgctttggtacttacctttagactggcacaggatttggttgttgagctgttctttctcatctttcaagagagcattttcttgctccaggtctgcaactcgctggaagagagcaataggggaaaaatgtctcatgatgctgggaagaggagaggctcctcttgtgggatttgaattttaactggatacgtgtaaatgctctttttaagaaaatygatttggttaaagcttcttttgttttcaaggaaaaattgtgtactgaaagaaaaatcccattaaaacaagacagatgagctcagcactatttatggtcatctaatgtccacaaacacatcatgaaaagtctatcacaagctcacatgccttgttgaggaacttgcaaagataacaggctttctgtagagagctgaaggcctgtggatcgtgaccaagtcagcattccactgaggctacatgatccaatagcaaactgtttatcatgaatgcaggatgtgggcaaactcacatctgcacct

SEQ ID NO: 109301 - DNA, 601 bp, Human
cttctattaaaatcctttccccactgtagcctctagtctaactgcatgcttgctaggagtctttgggagaagtcagtgaggaaaagagattaaaaccccaaataaaactcaagtgctttggtacttacctttagactggcacaggatttggttgttgagctgttctttctcatctttcaagagagcattttcttgctccaggtctgcaactcgctggaagagagcaataggggaaaaatgtctcatgatgctgggaagaggagaggctcctcttgtgggatttgaattttaactggatacrtgtaaatgctctttttaagaaaatcgatttggttaaagcttcttttgttttcaaggaaaaattgtgtactgaaagaaaaatcccattaaaacaagacagatgagctcagcactatttatggtcatctaatgtccacaaacacatcatgaaaagtctatcacaagctcacatgccttgttgaggaacttgcaaagataacaggctttctgtagagagctgaaggcctgtggatcgtgaccaagtcagcattccactgaggctacatgatccaatagcaaactgtttatcatgaatgcagga

SEQ ID NO: 109302 - DNA, 601 bp, Human
gaggtcatgtggttccatcctcttgtgacatgaatgaggaacctgagtatgggagaaggggatttgctcaaaatcacagtgagttgaagcagaaactggggtctgtggactctccctgctcctccacagccgagtggcacatggggactgatggcagcccaggagctggtgggcacttgagagaggctgacctgggatctgattcaagactgtttcttcagtaaacattaacagatgacccactgggtagaagaaaccatgatgcgtggatggacatgaaagacaaatgtgaaacccagcratgacgacagctcctgagcgctcgctgagtgtcatgcaccctcctaagcacttcacgtgcagcctcttcctcattcctcccatgagccccccgatgtctggacctttatgtccatgtagtagatgaacaaactgaaagcctattcaaggccatacagaagcacacggcagaatcatgcttcaagtgcgggcctccctgactccaagtctcatgtacaatgttgcccattatacgtgtctcacctctttacactcttgaggccaaatgtcctagtgggatcttaaaggtcattattcttca

SEQ ID NO: 109303 - DNA, 601 bp, Human
ttcctggaagaatgaaggcttattccacactcctttcctagtcctgatctttcagttcttaggagtgcagggagattaaaggcgactggggtaaaaggaaagaaggcaaatagagaaggatgggctactcccctgccaaaacttattcacattaatggacagaaaagtgttttaaaaggacatttgaaaacagttcacattttcaaaaagatgtgatattgggtgggactgtgaggtcatgtggttccatcctcttgtgacatgaatgaggaacctgagtatgggagaaggggatttgctsaaaatcacagtgagttgaagcagaaactggggtctgtggactctccctgctcctccacagccgagtggcacatggggactgatggcagcccaggagctggtgggcacttgagagaggctgacctgggatctgattcaagactgtttcttcagtaaacattaacagatgacccactgggtagaagaaaccatgatgcgtggatggacatgaaagacaaatgtgaaacccagcgatgacgacagctcctgagcgctcgctgagtgtcatgcaccctcctaagcacttcacgtgcagcctctt

SEQ ID NO: 109304 - DNA, 601 bp, Human
ttactctggcttagtcttcagagagggagagaaagaccctgctctcagggaatggggagagagaagttggcagcgtaggtgagaattccctcagttgatgccccagcctctcttctgccaactgtcacagcaactgctggcagcattcctggaagaatgaaggcttattccacactcctttcctagtcctgatctttcagttcttaggagtgcagggagattaaaggcgactggggtaaaaggaaagaaggcaaatagagaaggatgggctactcccctgccaaaacttattcacattaayggacagaaaagtgttttaaaaggacatttgaaaacagttcacattttcaaaaagatgtgatattgggtgggactgtgaggtcatgtggttccatcctcttgtgacatgaatgaggaacctgagtatgggagaaggggatttgctcaaaatcacagtgagttgaagcagaaactggggtctgtggactctccctgctcctccacagccgagtggcacatggggactgatggcagcccaggagctggtgggcacttgagagaggctgacctgggatctgattcaagactgtttcttcagtaa

SEQ ID NO: 109305 - DNA, 601 bp, Human
ctactgcagagcaaaggtgagtctcattactctggcttagtcttcagagagggagagaaagaccctgctctcagggaatggggagagagaagttggcagcgtaggtgagaattccctcagttgatgccccagcctctcttctgccaactgtcacagcaactgctggcagcattcctggaagaatgaaggcttattccacactcctttcctagtcctgatctttcagttcttaggagtgcagggagattaaaggcgactggggtaaaaggaaagaaggcaaatagagaaggatgggctactyccctgccaaaacttattcacattaatggacagaaaagtgttttaaaaggacatttgaaaacagttcacattttcaaaaagatgtgatattgggtgggactgtgaggtcatgtggttccatcctcttgtgacatgaatgaggaacctgagtatgggagaaggggatttgctcaaaatcacagtgagttgaagcagaaactggggtctgtggactctccctgctcctccacagccgagtggcacatggggactgatggcagcccaggagctggtgggcacttgagagaggctgacctgggat

SEQ ID NO: 109306 - DNA, 601 bp, Human
atcataaaattgtctctatgtatactgcatctcatcagattaggagacacaatcaggcccttgtgggtctctctgccacacacacactaatgaagctgagaactcccacaccccattactgtctcaacacaggaatgttcccgtaacaggaaacaggaaagataacacacttgggtagaatgttccttaaactcataactgagatcttcatgaccccaaagttggaaaaggagctgtcagtaggaatgaatcacccagtccagctacctttgcctctctgcagtaatggcaagtgctgcayatatgacacatggactgagcatcacatatcagaaagcagtgcctgagatcacgtggtcagaagctggacaggagccagggacctgtgccatggcacagcagaagcaccccccttgcctttatgatggtcatttcatcccgaaggttgtcgtatctctgctccaactgtgaatattccttcacaaggttctggtaccgggatcgctcctcctccagttctttcttcatgagattttccttcacagagttctgggcaaattcatctggaaagcaacacgctaagctgcagtttttctggatg

SEQ ID NO: 109307 - DNA, 601 bp, Human
tctgatttggctgtcagtgtgaaaattgagcttggtaggacaattttagacttctctggatgttcctattcagcttttcttcctggcttctatgcaattaacttactccatcttgtttgaatactcatttctggaggaaatgtttacatggggtaaaaaagaatgacagatcctaaaatatcataaaattgtctctatgtatactgcatctcatcagattaggagacacaatcaggcccttgtgggtctctctgccacacacacactaatgaagctgagaactcccacaccccattactgwctcaacacaggaatgttcccgtaacaggaaacaggaaagataacacacttgggtagaatgttccttaaactcataactgagatcttcatgaccccaaagttggaaaaggagctgtcagtaggaatgaatcacccagtccagctacctttgcctctctgcagtaatggcaagtgctgcatatatgacacatggactgagcatcacatatcagaaagcagtgcctgagatcacgtggtcagaagctggacaggagccagggacctgtgccatggcacagcagaagcaccccccttgccttta

SEQ ID NO: 109308 - DNA, 601 bp, Human
tcccttcaacctgcactcctcaaattttatgaaaatagtagcatattaaaaatagtttaccatttatactgttcatttaaaaatacttttttttttcctgcatctgatttggctgtcagtgtgaaaattgagcttggtaggacaattttagacttctctggatgttcctattcagcttttcttcctggcttctatgcaattaacttactccatcttgtttgaatactcatttctggaggaaatgtttacatggggtaaaaaagaatgacagatcctaaaatatcataaaattgtctctatstatactgcatctcatcagattaggagacacaatcaggcccttgtgggtctctctgccacacacacactaatgaagctgagaactcccacaccccattactgtctcaacacaggaatgttcccgtaacaggaaacaggaaagataacacacttgggtagaatgttccttaaactcataactgagatcttcatgaccccaaagttggaaaaggagctgtcagtaggaatgaatcacccagtccagctacctttgcctctctgcagtaatggcaagtgctgcatatatgacacatggactgag

SEQ ID NO: 109309 - DNA, 601 bp, Human
tggaaaaacctttccctcccagtcttgctcttgaaatgcacaaaggcagtcacattacccacttctcccttgaaaggaatgttccacacctgcccagaatggcccctcccttcaacctgcactcctcaaattttatgaaaatagtagcatattaaaaatagtttaccatttatactgttcatttaaaaatacttttttttttcctgcatctgatttggctgtcagtgtgaaaattgagcttggtaggacaattttagacttctctggatgttcctattcagcttttcttcctggcttctaygcaattaacttactccatcttgtttgaatactcatttctggaggaaatgtttacatggggtaaaaaagaatgacagatcctaaaatatcataaaattgtctctatgtatactgcatctcatcagattaggagacacaatcaggcccttgtgggtctctctgccacacacacactaatgaagctgagaactcccacaccccattactgtctcaacacaggaatgttcccgtaacaggaaacaggaaagataacacacttgggtagaatgttccttaaactcataactgagatcttcatgac

SEQ ID NO: 109310 - DNA, 601 bp, Human
catccacttttcatctcttaatgaaacgcaaattcctaacacttgggtcaatttctccgagaagtcctggaaaaacctttccctcccagtcttgctcttgaaatgcacaaaggcagtcacattacccacttctcccttgaaaggaatgttccacacctgcccagaatggcccctcccttcaacctgcactcctcaaattttatgaaaatagtagcatattaaaaatagtttaccatttatactgttcatttaaaaatacttttttttttcctgcatctgatttggctgtcagtgtgaaaaytgagcttggtaggacaattttagacttctctggatgttcctattcagcttttcttcctggcttctatgcaattaacttactccatcttgtttgaatactcatttctggaggaaatgtttacatggggtaaaaaagaatgacagatcctaaaatatcataaaattgtctctatgtatactgcatctcatcagattaggagacacaatcaggcccttgtgggtctctctgccacacacacactaatgaagctgagaactcccacaccccattactgtctcaacacaggaatgttcccgtaac

SEQ ID NO: 109311 - DNA, 601 bp, Human
tactgtagtcatccacttttcatctcttaatgaaacgcaaattcctaacacttgggtcaatttctccgagaagtcctggaaaaacctttccctcccagtcttgctcttgaaatgcacaaaggcagtcacattacccacttctcccttgaaaggaatgttccacacctgcccagaatggcccctcccttcaacctgcactcctcaaattttatgaaaatagtagcatattaaaaatagtttaccatttatactgttcatttaaaaatacttttttttttcctgcatctgatttggctgtcartgtgaaaattgagcttggtaggacaattttagacttctctggatgttcctattcagcttttcttcctggcttctatgcaattaacttactccatcttgtttgaatactcatttctggaggaaatgtttacatggggtaaaaaagaatgacagatcctaaaatatcataaaattgtctctatgtatactgcatctcatcagattaggagacacaatcaggcccttgtgggtctctctgccacacacacactaatgaagctgagaactcccacaccccattactgtctcaacacaggaatgt

SEQ ID NO: 109312 - DNA, 601 bp, Human
aggaggacagtacccaagagcctgcatcactcacctccacctgctggagggcatcctcagtgtctccgatctcagatgtggagatggaggggtaattggagtcagattctaagctactttggtttgatgggttccgcctatgacctggagtttgctgttcaacaagaaaaacgtgatagctcattaggaactaatgttcatgagaatttacctcccatggtggcaggccctagagttatccttctgcctaatttgtcaacaagaataggtatcattgcttcttggaatgatggctaaataragctagccctatgaaacatttcacctacagttcttactgtagtcatccacttttcatctcttaatgaaacgcaaattcctaacacttgggtcaatttctccgagaagtcctggaaaaacctttccctcccagtcttgctcttgaaatgcacaaaggcagtcacattacccacttctcccttgaaaggaatgttccacacctgcccagaatggcccctcccttcaacctgcactcctcaaattttatgaaaatagtagcatattaaaaatagtttaccatttatactgttcatttaaaaat

SEQ ID NO: 109313 - DNA, 601 bp, Human
tctgtcagatgagggcaaggacttctccggctcagtcaccactgtttctctagcactgaccagcagatcctgcacaaagaactgctccaaacccatttgtttttattctgtctctcctccatgttatttccacatactttacaaggttctgtgtgtatgtgcgcgcacacacacgcgcgcatgtgcctgtgattttcttttcaaatgccagaggaaaaattgtatcttttgtacctttgacaaaattatacacagaccacacagtccactgtgtggtatatttagtgactgactaagaggytattaccaacaaagatacagtcacccagcatactttcattccaaatattttttgttgttctgagttttatccagcttctaagtgagggggcaattttcttgtttatttattgatattactatatgcactatgatattaagtggggataagttgtatctattttaatgacttagctgttccttcctaaaccacctatttcacctctctgcatcagcttcttggtttttcaagaggaatcagagatccaccttcttctttcctttctggatagggtgtaaggtgaacaataatgtattgctt

SEQ ID NO: 109314 - DNA, 601 bp, Human
ctgcaatcatatcacatgtttcttccctaactgctcactgactagctctctgtcagatgagggcaaggacttctccggctcagtcaccactgtttctctagcactgaccagcagatcctgcacaaagaactgctccaaacccatttgtttttattctgtctctcctccatgttatttccacatactttacaaggttctgtgtgtatgtgcgcgcacacacacgcgcgcatgtgcctgtgattttcttttcaaatgccagaggaaaaattgtatcttttgtacctttgacaaaattatacamagaccacacagtccactgtgtggtatatttagtgactgactaagaggctattaccaacaaagatacagtcacccagcatactttcattccaaatattttttgttgttctgagttttatccagcttctaagtgagggggcaattttcttgtttatttattgatattactatatgcactatgatattaagtggggataagttgtatctattttaatgacttagctgttccttcctaaaccacctatttcacctctctgcatcagcttcttggtttttcaagaggaatcagagatccaccttc

SEQ ID NO: 109315 - DNA, 601 bp, Human
gtctatctgcctgtgaatgggtaatgtgtatgagcacatccatgtggatttttaagcacatgtatgtacatgtgagacaatataatttggttccaccaggatttaataagcactggttccaccaaggcttcatgtttaaccagcactggaccagtcttggcttccttaaagaacataaaaccagtgatgacaatgcttatgtctacatgtagatagtcacacatacaaacaccagggtgataagcctggagttgaggctgactgaaacctccaagggcctagacttaaaagaccgcaatgmaaagccaagcatctcaagccagcagttatgcaaggcttactaagtgcgtctggcaggcagcaagccacgcagaaccgcacaacagagaggagaccttcagttctggggacctccttctctccctccaccctctgctccagcattctctattgctgatggtctcttatttttctttatagcacttagcaggacctgcaatcatatcacatgtttcttccctaactgctcactgactagctctctgtcagatgagggcaaggacttctccggctcagtcaccactgtttctctagcactgac

SEQ ID NO: 109316 - DNA, 601 bp, Human
aaacacgtctatctgcctgtgaatgggtaatgtgtatgagcacatccatgtggatttttaagcacatgtatgtacatgtgagacaatataatttggttccaccaggatttaataagcactggttccaccaaggcttcatgtttaaccagcactggaccagtcttggcttccttaaagaacataaaaccagtgatgacaatgcttatgtctacatgtagatagtcacacatacaaacaccagggtgataagcctggagttgaggctgactgaaacctccaagggcctagacttaaaagaccrcaatgcaaagccaagcatctcaagccagcagttatgcaaggcttactaagtgcgtctggcaggcagcaagccacgcagaaccgcacaacagagaggagaccttcagttctggggacctccttctctccctccaccctctgctccagcattctctattgctgatggtctcttatttttctttatagcacttagcaggacctgcaatcatatcacatgtttcttccctaactgctcactgactagctctctgtcagatgagggcaaggacttctccggctcagtcaccactgtttctctagc

SEQ ID NO: 109317 - DNA, 601 bp, Human
tgcgtggggataggggtgtacaaacacgtctatctgcctgtgaatgggtaatgtgtatgagcacatccatgtggatttttaagcacatgtatgtacatgtgagacaatataatttggttccaccaggatttaataagcactggttccaccaaggcttcatgtttaaccagcactggaccagtcttggcttccttaaagaacataaaaccagtgatgacaatgcttatgtctacatgtagatagtcacacatacaaacaccagggtgataagcctggagttgaggctgactgaaacctccargggcctagacttaaaagaccgcaatgcaaagccaagcatctcaagccagcagttatgcaaggcttactaagtgcgtctggcaggcagcaagccacgcagaaccgcacaacagagaggagaccttcagttctggggacctccttctctccctccaccctctgctccagcattctctattgctgatggtctcttatttttctttatagcacttagcaggacctgcaatcatatcacatgtttcttccctaactgctcactgactagctctctgtcagatgagggcaaggacttctccggctc

SEQ ID NO: 109318 - DNA, 601 bp, Human
cacatgagccctggacacaagagctagattgttctctcatccaagcaccataagagcactgcagccccttcacgtacctggactttcttgctgtcctgctgttctctcttctccagctgcacttgcagctttttcctctcctgctccagctcccgtactctcttctgcagcttcaggaagaccgtcatgtccatggctgccttctccaggccaatttccttcaaaggaagacaggcacagaaaaaaggttttcctaaatacatgccttagggaacacacagcacttcactgcctccctctmtatcagccatctgtctcctctctcctcccaaacatcaatttgcatctcaaatacaaagccaatgacaaccaactaacatttctcatatcacagttggtgctccaggctcattttctgtccagataacatctgagtctcagccatttatattcctcctgtgtgagccacttaaaatgaccaaccatatattccaagaacaaatggataaaaacacaggcactttctttggaagttaaaagagctcacttctggaaaatggtctcacaccagagaaactatagaacttgggacatagcactt

SEQ ID NO: 109319 - DNA, 601 bp, Human
gggcgataggtcatctctgtgtacatttgacttctgctgtatttacactcttattacacaccctggtcctcctggcagggagctcccctctttgcaagtaggtgatgatgccacagacttccccctagcttcaccaacagaaacccggggcatgagggagcttactcctgttcagctgggcggtgtaggggcactcagagaagactcagcatgactccaatgcactaagtaggagccctctgagacttagcaggagcacaatcccatgtggtcacacatgccacatgagccctggacacawgagctagattgttctctcatccaagcaccataagagcactgcagccccttcacgtacctggactttcttgctgtcctgctgttctctcttctccagctgcacttgcagctttttcctctcctgctccagctcccgtactctcttctgcagcttcaggaagaccgtcatgtccatggctgccttctccaggccaatttccttcaaaggaagacaggcacagaaaaaaggttttcctaaatacatgccttagggaacacacagcacttcactgcctccctctctatcagccatctgtctcct

SEQ ID NO: 109320 - DNA, 601 bp, Human
cacttggtctgcctctgacccaaaaaggctgaacccaagcccatgcaagatcccaggtatgaaagggcgataggtcatctctgtgtacatttgacttctgctgtatttacactcttattacacaccctggtcctcctggcagggagctcccctctttgcaagtaggtgatgatgccacagacttccccctagcttcaccaacagaaacccggggcatgagggagcttactcctgttcagctgggcggtgtaggggcactcagagaagactcagcatgactccaatgcactaagtaggagcyctctgagacttagcaggagcacaatcccatgtggtcacacatgccacatgagccctggacacaagagctagattgttctctcatccaagcaccataagagcactgcagccccttcacgtacctggactttcttgctgtcctgctgttctctcttctccagctgcacttgcagctttttcctctcctgctccagctcccgtactctcttctgcagcttcaggaagaccgtcatgtccatggctgccttctccaggccaatttccttcaaaggaagacaggcacagaaaaaaggttttccta

SEQ ID NO: 109321 - DNA, 601 bp, Human
tactaagatttcaaacaatatcctttctagacccaagaggctgctgataatctggactgaggcaagggtgcagccatgagagaggaaagtgagtgacacacacttggtctgcctctgacccaaaaaggctgaacccaagcccatgcaagatcccaggtatgaaagggcgataggtcatctctgtgtacatttgacttctgctgtatttacactcttattacacaccctggtcctcctggcagggagctcccctctttgcaagtaggtgatgatgccacagacttccccctagcttcaccarcagaaacccggggcatgagggagcttactcctgttcagctgggcggtgtaggggcactcagagaagactcagcatgactccaatgcactaagtaggagccctctgagacttagcaggagcacaatcccatgtggtcacacatgccacatgagccctggacacaagagctagattgttctctcatccaagcaccataagagcactgcagccccttcacgtacctggactttcttgctgtcctgctgttctctcttctccagctgcacttgcagctttttcctctcctgctccagctcccgt

SEQ ID NO: 109322 - DNA, 601 bp, Human
tgaatgcagcatgggtgcccagtagttccttgagatggaatgattacttttggggctactaagatttcaaacaatatcctttctagacccaagaggctgctgataatctggactgaggcaagggtgcagccatgagagaggaaagtgagtgacacacacttggtctgcctctgacccaaaaaggctgaacccaagcccatgcaagatcccaggtatgaaagggcgataggtcatctctgtgtacatttgacttctgctgtatttacactcttattacacaccctggtcctcctggcagggwgctcccctctttgcaagtaggtgatgatgccacagacttccccctagcttcaccaacagaaacccggggcatgagggagcttactcctgttcagctgggcggtgtaggggcactcagagaagactcagcatgactccaatgcactaagtaggagccctctgagacttagcaggagcacaatcccatgtggtcacacatgccacatgagccctggacacaagagctagattgttctctcatccaagcaccataagagcactgcagccccttcacgtacctggactttcttgctgtcctgct

SEQ ID NO: 109323 - DNA, 601 bp, Human
tgaaaagagttatggagataagtgctggtgagatgctagcataacattatgagtgtatttaataccattgaactatacacttaaaaagggttaattatgatggtaaattttttgtgtattttaccacactttaaaaaattagaaataagccatgggaatgattcaagactgttctcctgggcaatgtagctgttaccagagttatttattttttgacaagttatttattttttgacaagtcaagtgcagcagtaagacaggggaaggaatagaacaaggagttcgatctgtaacagactgygaacagtccattgaaataactcactaccttcagaccaaccagccagagttatttgtagtcctgtaagtgactggcagataggctaaattcccacattaccacgtctttgaggatgggaatggggtgggcctgttcggaagccccttttctgtgcattcctccctgccatgggacccactcacctcccactgttctaccgccctgtctccctgcatgccagcagaggacacactggcagatccctctgccctatgtctacccatgcaagccttgatttttttcctaagtgatttttagtgg

SEQ ID NO: 109324 - DNA, 601 bp, Human
acaaatactatacgattctacttacatgaggaacctagaattgtctaatgcagaaagacagaaagtacaattgtggttgccagaggttgggggaggaggaactgggaagttgttaatgggtacgggcttcagttttaaaagatgaaaagagttatggagataagtgctggtgagatgctagcataacattatgagtgtatttaataccattgaactatacacttaaaaagggttaattatgatggtaaattttttgtgtattttaccacactttaaaaaattagaaataagccatgggaaygattcaagactgttctcctgggcaatgtagctgttaccagagttatttattttttgacaagttatttattttttgacaagtcaagtgcagcagtaagacaggggaaggaatagaacaaggagttcgatctgtaacagactgtgaacagtccattgaaataactcactaccttcagaccaaccagccagagttatttgtagtcctgtaagtgactggcagataggctaaattcccacattaccacgtctttgaggatgggaatggggtgggcctgttcggaagccccttttctgtgcattc

SEQ ID NO: 109325 - DNA, 601 bp, Human
ggatggccacatgatccagcaactccactttggggtatatacctaaaagaactgaaagcagggtctcaaagagatacttgtatatccatgttcagtacagcattattcacaatagccaaaacagagaagcaacctagatgtctaacaaatggataagcaaagtgtgatccctatacacacaatgggacacagttttaaaagaagatggacacatactacaatagagatcaaccatcaggacacaaatgttaagtgaaataagccaattacaaaaaacaaatactatacgattctacttacrtgaggaacctagaattgtctaatgcagaaagacagaaagtacaattgtggttgccagaggttgggggaggaggaactgggaagttgttaatgggtacgggcttcagttttaaaagatgaaaagagttatggagataagtgctggtgagatgctagcataacattatgagtgtatttaataccattgaactatacacttaaaaagggttaattatgatggtaaattttttgtgtattttaccacactttaaaaaattagaaataagccatgggaatgattcaagactgttctcctgggcaa

SEQ ID NO: 109326 - DNA, 601 bp, Human
aaaagacattcttcaaagactacatagaaatggccaatcaacacatgagaagatgctcagtattactatcaggaaaatgcaagtcaaaactacaatgagatatcaccttacacctatcagaatagctactatcaaaaaaataaataaataaataaaagaaaagaaaatactacgtgttggcaaggatgtggagaaactggaatccttgtgcactgctggtgggaatgtaaaatggtgcagctgctatggaaaacagtatagcagttcctccaaaaattaataataggatggccacatgatycagcaactccactttggggtatatacctaaaagaactgaaagcagggtctcaaagagatacttgtatatccatgttcagtacagcattattcacaatagccaaaacagagaagcaacctagatgtctaacaaatggataagcaaagtgtgatccctatacacacaatgggacacagttttaaaagaagatggacacatactacaatagagatcaaccatcaggacacaaatgttaagtgaaataagccaattacaaaaaacaaatactatacgattctacttacatgaggaacctagaat

SEQ ID NO: 109327 - DNA, 601 bp, Human
tatgacacaccctcctatgccatctgtgtggccctggttgtttaaaaagtcaaatggtgctgggaaaccggacatccacagcaaaagaattaagttgggcccttacctcacatcttcaacaaagattaactcaaagtggatcaaaggcctaaatgtaagacctaaaattgtaaaactctcagaagaaaacatagggcaaaagccttatgacatcagatttgatgatttcttaaacatgacaccaaaggcacaggcaacaatatagacaaattggacttcatgaaaatttaaacattttgtrcaccaaaagacactatcagaataaaaagatgacccacagaatgggagaaactatttgccaatcatgtatctgataagggattaatatctagaatatgtagagaactcctaaaactcaacacaaaaccccaaacagcataattcagaaatggtcagaagactgaaaagacattcttcaaagactacatagaaatggccaatcaacacatgagaagatgctcagtattactatcaggaaaatgcaagtcaaaactacaatgagatatcaccttacacctatcagaatagctactatcaaaaa

SEQ ID NO: 109328 - DNA, 601 bp, Human
aaggggcatcttcctcaaggacagctaaatgagaggaggagtttttgcgctgattttaatgcaggagtccgggaggcagtttcatgcgtagggtagtacagtggttctcagacttgagtgggcaacagaatcccttgcagggcttgttaaaacacagatgggtgggccctatcccagccttctgattcagcaggtctcgggggtggggtacctgagaatctacatttccagcaagctcagtgatgctgatgccatcagtcccacatctactgctggggagctactgggcccctctcattasttctaaaagggtgggtaggattgatgccccgaaagtgctacctataatagttcacatgctcattttcatccccaggcactaagcctcccttgggaaaggcgggtgaaggttagcatgcagaagtccccttgctgcaggcatttatcccactgaaagactcccaggctccttggagggttttgaatctttagaatatcacatgaggaaagtaagtctaatcaataactccagaaggagatctctatgacacaccctcctatgccatctgtgtggccctggttgtttaaaaagtcaaatggt

SEQ ID NO: 109329 - DNA, 601 bp, Human
tattgcgccctctctgtgccaggccccatgcttggcagtggagacgaggcctgtaaaatcaagaaggggcatcttcctcaaggacagctaaatgagaggaggagtttttgcgctgattttaatgcaggagtccgggaggcagtttcatgcgtagggtagtacagtggttctcagacttgagtgggcaacagaatcccttgcagggcttgttaaaacacagatgggtgggccctatcccagccttctgattcagcaggtctcgggggtggggtacctgagaatctacatttccagcaagctyagtgatgctgatgccatcagtcccacatctactgctggggagctactgggcccctctcattacttctaaaagggtgggtaggattgatgccccgaaagtgctacctataatagttcacatgctcattttcatccccaggcactaagcctcccttgggaaaggcgggtgaaggttagcatgcagaagtccccttgctgcaggcatttatcccactgaaagactcccaggctccttggagggttttgaatctttagaatatcacatgaggaaagtaagtctaatcaataactccagaaggag

SEQ ID NO: 109330 - DNA, 601 bp, Human
gagcagctatttagacttatggcagtttaagacaaatgtttattgcgccctctctgtgccaggccccatgcttggcagtggagacgaggcctgtaaaatcaagaaggggcatcttcctcaaggacagctaaatgagaggaggagtttttgcgctgattttaatgcaggagtccgggaggcagtttcatgcgtagggtagtacagtggttctcagacttgagtgggcaacagaatcccttgcagggcttgttaaaacacagatgggtgggccctatcccagccttctgattcagcaggtctsgggggtggggtacctgagaatctacatttccagcaagctcagtgatgctgatgccatcagtcccacatctactgctggggagctactgggcccctctcattacttctaaaagggtgggtaggattgatgccccgaaagtgctacctataatagttcacatgctcattttcatccccaggcactaagcctcccttgggaaaggcgggtgaaggttagcatgcagaagtccccttgctgcaggcatttatcccactgaaagactcccaggctccttggagggttttgaatctttagaatatc

SEQ ID NO: 109331 - DNA, 601 bp, Human
aagtcaacagcagcagagtggagcagctatttagacttatggcagtttaagacaaatgtttattgcgccctctctgtgccaggccccatgcttggcagtggagacgaggcctgtaaaatcaagaaggggcatcttcctcaaggacagctaaatgagaggaggagtttttgcgctgattttaatgcaggagtccgggaggcagtttcatgcgtagggtagtacagtggttctcagacttgagtgggcaacagaatcccttgcagggcttgttaaaacacagatgggtgggccctatcccagscttctgattcagcaggtctcgggggtggggtacctgagaatctacatttccagcaagctcagtgatgctgatgccatcagtcccacatctactgctggggagctactgggcccctctcattacttctaaaagggtgggtaggattgatgccccgaaagtgctacctataatagttcacatgctcattttcatccccaggcactaagcctcccttgggaaaggcgggtgaaggttagcatgcagaagtccccttgctgcaggcatttatcccactgaaagactcccaggctccttggaggg

SEQ ID NO: 109332 - DNA, 601 bp, Human
tctcacatcctcagaatcctggcctaagtcaacagcagcagagtggagcagctatttagacttatggcagtttaagacaaatgtttattgcgccctctctgtgccaggccccatgcttggcagtggagacgaggcctgtaaaatcaagaaggggcatcttcctcaaggacagctaaatgagaggaggagtttttgcgctgattttaatgcaggagtccgggaggcagtttcatgcgtagggtagtacagtggttctcagacttgagtgggcaacagaatcccttgcagggcttgttaaaasacagatgggtgggccctatcccagccttctgattcagcaggtctcgggggtggggtacctgagaatctacatttccagcaagctcagtgatgctgatgccatcagtcccacatctactgctggggagctactgggcccctctcattacttctaaaagggtgggtaggattgatgccccgaaagtgctacctataatagttcacatgctcattttcatccccaggcactaagcctcccttgggaaaggcgggtgaaggttagcatgcagaagtccccttgctgcaggcatttatcccactg

SEQ ID NO: 109333 - DNA, 601 bp, Human
ctggttgagaagcacccaagccagcctcttcaacatgagtgcttccttacatgggtaattttaaccccaggggtccccgggaccagcctctgtgacaaggcccacaagtaaaatcatttcatcagagacaatgctgggaaaaccaggtctcacatcctcagaatcctggcctaagtcaacagcagcagagtggagcagctatttagacttatggcagtttaagacaaatgtttattgcgccctctctgtgccaggccccatgcttggcagtggagacgaggcctgtaaaatcaagaagggkcatcttcctcaaggacagctaaatgagaggaggagtttttgcgctgattttaatgcaggagtccgggaggcagtttcatgcgtagggtagtacagtggttctcagacttgagtgggcaacagaatcccttgcagggcttgttaaaacacagatgggtgggccctatcccagccttctgattcagcaggtctcgggggtggggtacctgagaatctacatttccagcaagctcagtgatgctgatgccatcagtcccacatctactgctggggagctactgggcccctctcattacttcta

SEQ ID NO: 109334 - DNA, 601 bp, Human
tttccattattataaaaaatactagtaagtggtaataaagtcccctgaatgtctgggctgggcctggttgagaagcacccaagccagcctcttcaacatgagtgcttccttacatgggtaattttaaccccaggggtccccgggaccagcctctgtgacaaggcccacaagtaaaatcatttcatcagagacaatgctgggaaaaccaggtctcacatcctcagaatcctggcctaagtcaacagcagcagagtggagcagctatttagacttatggcagtttaagacaaatgtttattgygccctctctgtgccaggccccatgcttggcagtggagacgaggcctgtaaaatcaagaaggggcatcttcctcaaggacagctaaatgagaggaggagtttttgcgctgattttaatgcaggagtccgggaggcagtttcatgcgtagggtagtacagtggttctcagacttgagtgggcaacagaatcccttgcagggcttgttaaaacacagatgggtgggccctatcccagccttctgattcagcaggtctcgggggtggggtacctgagaatctacatttccagcaagctcagtga

SEQ ID NO: 109335 - DNA, 601 bp, Human
aagcccaatttccattattataaaaaatactagtaagtggtaataaagtcccctgaatgtctgggctgggcctggttgagaagcacccaagccagcctcttcaacatgagtgcttccttacatgggtaattttaaccccaggggtccccgggaccagcctctgtgacaaggcccacaagtaaaatcatttcatcagagacaatgctgggaaaaccaggtctcacatcctcagaatcctggcctaagtcaacagcagcagagtggagcagctatttagacttatggcagtttaagacaaatrtttattgcgccctctctgtgccaggccccatgcttggcagtggagacgaggcctgtaaaatcaagaaggggcatcttcctcaaggacagctaaatgagaggaggagtttttgcgctgattttaatgcaggagtccgggaggcagtttcatgcgtagggtagtacagtggttctcagacttgagtgggcaacagaatcccttgcagggcttgttaaaacacagatgggtgggccctatcccagccttctgattcagcaggtctcgggggtggggtacctgagaatctacatttccagcaag

SEQ ID NO: 109336 - DNA, 601 bp, Human
gcacacttcagagcattcaggagggatgtgcacagcgggagctcactaaatataagctgaccgtgttctgcctaaaagcccaatttccattattataaaaaatactagtaagtggtaataaagtcccctgaatgtctgggctgggcctggttgagaagcacccaagccagcctcttcaacatgagtgcttccttacatgggtaattttaaccccaggggtccccgggaccagcctctgtgacaaggcccacaagtaaaatcatttcatcagagacaatgctgggaaaaccaggtctcacaycctcagaatcctggcctaagtcaacagcagcagagtggagcagctatttagacttatggcagtttaagacaaatgtttattgcgccctctctgtgccaggccccatgcttggcagtggagacgaggcctgtaaaatcaagaaggggcatcttcctcaaggacagctaaatgagaggaggagtttttgcgctgattttaatgcaggagtccgggaggcagtttcatgcgtagggtagtacagtggttctcagacttgagtgggcaacagaatcccttgcagggcttgttaaaacacagatg

SEQ ID NO: 109337 - DNA, 601 bp, Human
ttactttaataaatttacaaataaaatgaaaaatgtctataaaaaggacacattaaggagaaaaaaaaacactcgaaggatcttctcaactgagtcttttctgatgcacgttcaacattggataagccaatggctggatagtcagttgaggtgaaaagtgtttaagtgccaagctggactcttagttctctatcattcttgcacaaactctgagtcagtgggtaccatctcctgatttgaatccagctctggctgatagcaggtcgataaagaaaaaccaacactgctgctggccgtaagsagggtctgtctgcccagccagcttccaggtcagcacagtcatggctccttttggctaccaggcctgtctcaggcaccagggaatggtgagcttcccctagagccacccttcctgccctcaccatccctaccactcattctcctctgcttttgcacactggccggggctaacagtcactgcagggagacccatcttccatccaccctactcaggcctccggagacaatgctctgcaggagtgactggccctgagaacccttctacatgaccttaccccaaatgggggcacctaagccttgt

SEQ ID NO: 109338 - DNA, 601 bp, Human
cttgttttaaaattatgaggaattttaataaaatggacagtccagttctctctcagaaaaagcctagtttcatcacaggattatttataaaagtaaaacatgagagtatattcatcagttagagaatggataattgtgataatcatgtcataaaattttaatcaaccatggaaatcatgtttacaaagacatgtagaaaaatgctcgttatagtgagaaaaaaagcagaataaaaaattatatatataacaactatataaatatgcatataaaaagcattagaaataaatatccaaataayatcagagactgcctttaagtggcaggaatatggattttttaaaaattctctagattttcttgtattttaaaatttttctaagatgaacagaattactttaataaatttacaaataaaatgaaaaatgtctataaaaaggacacattaaggagaaaaaaaaacactcgaaggatcttctcaactgagtcttttctgatgcacgttcaacattggataagccaatggctggatagtcagttgaggtgaaaagtgtttaagtgccaagctggactcttagttctctatcattcttgcacaaac

SEQ ID NO: 109339 - DNA, 601 bp, Human
agttgtgaaaatggctctcacaaatctagccacagtaaacagtaatggatacagcttgttttaaaattatgaggaattttaataaaatggacagtccagttctctctcagaaaaagcctagtttcatcacaggattatttataaaagtaaaacatgagagtatattcatcagttagagaatggataattgtgataatcatgtcataaaattttaatcaaccatggaaatcatgtttacaaagacatgtagaaaaatgctcgttatagtgagaaaaaaagcagaataaaaaattatatatayaacaactatataaatatgcatataaaaagcattagaaataaatatccaaataatatcagagactgcctttaagtggcaggaatatggattttttaaaaattctctagattttcttgtattttaaaatttttctaagatgaacagaattactttaataaatttacaaataaaatgaaaaatgtctataaaaaggacacattaaggagaaaaaaaaacactcgaaggatcttctcaactgagtcttttctgatgcacgttcaacattggataagccaatggctggatagtcagttgaggtga

SEQ ID NO: 109340 - DNA, 601 bp, Human
aattctatatatagtcaacactataccaccattctataactctgtaagattttaagccagtaaaactgatccgtgttccataaaacaagctaaagttgtgaaaatggctctcacaaatctagccacagtaaacagtaatggatacagcttgttttaaaattatgaggaattttaataaaatggacagtccagttctctctcagaaaaagcctagtttcatcacaggattatttataaaagtaaaacatgagagtatattcatcagttagagaatggataattgtgataatcatgtcataamattttaatcaaccatggaaatcatgtttacaaagacatgtagaaaaatgctcgttatagtgagaaaaaaagcagaataaaaaattatatatataacaactatataaatatgcatataaaaagcattagaaataaatatccaaataatatcagagactgcctttaagtggcaggaatatggattttttaaaaattctctagattttcttgtattttaaaatttttctaagatgaacagaattactttaataaatttacaaataaaatgaaaaatgtctataaaaaggacacattaaggaga

SEQ ID NO: 109341 - DNA, 601 bp, Human
ctggaggcggcacaattttgaataagggttcattgaaattctatatatagtcaacactataccaccattctataactctgtaagattttaagccagtaaaactgatccgtgttccataaaacaagctaaagttgtgaaaatggctctcacaaatctagccacagtaaacagtaatggatacagcttgttttaaaattatgaggaattttaataaaatggacagtccagttctctctcagaaaaagcctagtttcatcacaggattatttataaaagtaaaacatgagagtatattcatcarttagagaatggataattgtgataatcatgtcataaaattttaatcaaccatggaaatcatgtttacaaagacatgtagaaaaatgctcgttatagtgagaaaaaaagcagaataaaaaattatatatataacaactatataaatatgcatataaaaagcattagaaataaatatccaaataatatcagagactgcctttaagtggcaggaatatggattttttaaaaattctctagattttcttgtattttaaaatttttctaagatgaacagaattactttaataaatttacaaataaa

SEQ ID NO: 109342 - DNA, 601 bp, Human
tgagcgttaccactggaggcggcacaattttgaataagggttcattgaaattctatatatagtcaacactataccaccattctataactctgtaagattttaagccagtaaaactgatccgtgttccataaaacaagctaaagttgtgaaaatggctctcacaaatctagccacagtaaacagtaatggatacagcttgttttaaaattatgaggaattttaataaaatggacagtccagttctctctcagaaaaagcctagtttcatcacaggattatttataaaagtaaaacatgagartatattcatcagttagagaatggataattgtgataatcatgtcataaaattttaatcaaccatggaaatcatgtttacaaagacatgtagaaaaatgctcgttatagtgagaaaaaaagcagaataaaaaattatatatataacaactatataaatatgcatataaaaagcattagaaataaatatccaaataatatcagagactgcctttaagtggcaggaatatggattttttaaaaattctctagattttcttgtattttaaaatttttctaagatgaacagaattactttaataaa

SEQ ID NO: 109343 - DNA, 601 bp, Human
gagaagaacaagcaggacttgccggggaaatgctgtcatgcagaagacagagcagagctggtgggggtcaagagattccaaaatccagggaaggaagctggatccaggaaaaagcagtgagctggtcatcgcagagcttcagaagggtttccctggtttgcatggggagatgggccacctggctggagtataacgtggcatggcccatggcagggagcagagggagatgtgaatgagatacagagatttaggaggtggaactgtcaagacctggagactgcttggatgtgggaagtgagtrggaagaaagtctagatgcttgggtgacgtgtgtcatctattgagacaagatggggtttcagggttcagatgtgtgcagctgtagtccccacggcgcagtgagcagttggaattatgggctagagatggatcagtatgttggtgaggactgaagtcttgggaggatgtgtgggtgggtgggggtgaaaccgccccgggagagtgtgctgaggctgggccctgcacaccgcatgcttccgatttcctgtccctgggtagccctaggttagctggacattggactgggcaggaaacctttctg

SEQ ID NO: 109344 - DNA, 601 bp, Human
ctacccagggcacatctgtgacatttctatttatcccattctctaaccattcctggacaccatctcccctaaccatacctcactggtcccccacacataacctctcctctccactcccctctcctcccccacaggttcactaccattccctcatcatcctttctggtcaacagtgccaaaagaatatgcatgctttattgtggtaaaaaatataaaacacaaaattagccatctaacctatttttattttttgagatgtagtttcgctctgtcgcccaggctggagtgcattggcgtgatytcggctcactgcaagctccgcctcccaggttcacgccattctcctgcttcagcctcccgagtagctgggactacaggcgcccaccaccacgcctggctaatttttttttttttctagtagagatggggtttcaccatgttagtcaggatggtctcgatctcctgacctcgtgatccgcccacctcggcctcccaaagtgctgggattacaggcatgagccgccacgcccgacctcatcttacctatttttacgtgcacagttcagtgacattaagtccatttatgttgtgcaaccatccc

SEQ ID NO: 109345 - DNA, 601 bp, Human
gctgagtgaggaagctgagcccagggaggggaaggctcacagcaagtttagagactgacccaggacagagggccagggctcctgactcctggtccagggcgcccctgtgactccaccatatatgtggtgatttccagaagatttagaaccatgcatagagatagtaactctgcagacatgatgagggccccaaaataaggtgattaataatgatcattgatgagtcaccaagcctatggtgagtctatttactaagttcaggagttaaggatcccctcagtgcctgggtgatcttctggcwgccaaggccatcctcaggagagccagtgtcacatgctagaggagcactgggtgtggaggcagccctgggtcccctcctggctcaaggtgcacactgcacagtcctggaaccttagcctcctcaggtgtggcttaagggagtgagaacagctggtggctaaggtttcctccagctgtgacaggccagaactgagctcggtgacagctgttggctgtgtgcctgtgctgacagccacgccaggccctactcagctgtgagattgtgcctcaagacagagccaggttggttgaaagctctggc

SEQ ID NO: 109346 - DNA, 601 bp, Human
ttgttctctgactccagctcttgcctctggaagacagcccaagggccgctgccattactccctgccctagggctctctccctgtgtgggcctcccctcctccccttcttttgtccactgggaaacttcgctctttaaacgttgacacacatggaaagttctgactgccatcagcaagcagtcaaagctggggcctggatgtgaactcatgacttcaagtcacaagtgtgaagcacctgcacaatgcctccagagcggcagtctccaaagtgattcaacagtgttcgtgttgctaaacatgkttggctgtgaaactcctccttgtggaaatgctgggctcacaattttaaatgacatatagtaaacataagaattcctacaatctaaatatgttcacacgctttgtgactttccaagaaaagatacaagaatgcaggatttcctaaacttatttgcccagagaaccccttgctccctatttttcaggaagcatcatttttgtcccggactaattagacttggaagatacaccagggacacagttttgttgttttggtcatatagaaagccaccaactgtccctgtcagcagaggaaaaatac

SEQ ID NO: 109347 - DNA, 601 bp, Human
tggttaaacaattgccacaaaatggctttatatacaaacaggtataaaaacatgcctttgggaaaagacaaaggcctggaaagaacagagataaccacaatcaaacccacgccaggaacatgactccaaaaggtcatcttggaagagacacagaacaacgaggccaggctgagacagagctgcatgtggggcggtgggggaagatggccaggaggtgcccctgggaggagagagcacccaagtccagagcacacaggtagaccctggttcagctggaatcctccacactcctcagcacctscttaccccagctgtcccgaggctcatgcccagaagtggctcaggtttttagagcccatggagtgacccacgtggcctctgtccccaccctctggctctagtctgccccagaaagtgagaacattaggaaaatacagtgaataggacttgccaccctgggggactgaggaggaccaatgactctctccacttcagaaagcaaacagcaaggggtataaggtgaaaaggccaccctgaggttacctattaaacatcttcatattaacttcagaagagtccagaagcttgtagctgcatcccc

SEQ ID NO: 109348 - DNA, 601 bp, Human
ggctcaaggtcaaatgagccaacagctccgagcaaatcttgagactgcacacagttccttgtcaaacacagtctccgctgtcccggacaggcccctggtgtgtgtattggcggggggcggcgggtgtgaataataaccccaggtgcgcccgaccaagcccaggtgccaatgcctggaggcctcctgtcttgccggggacctgctggatggagaggagctgctaggaggttttctgggacctcgggaatgcaccagtctcactttggagttttacactcttgataaggcttgggtagaagtkgacaggaatcaaaggagcactgtcaaagagccagaccagagccctggccacactcctgcccctacctaactctgactttaagtgctcaccccgaggtgaggttgggctgagggcagtggcaacttgtgccctcctaaaccacttccccatccttctcccatatacagccctgaaaagaagacaaactgcccagcacccagctcatgttcacagccctcttcccccttcattttcctatatataaaatggtgataatgatgctggtgtctcttagttcccagaggtaaaaaaggagaaagc

SEQ ID NO: 109349 - DNA, 601 bp, Human
actgcagtgattcttggggagggccggaagtagagcgcatcagcgctgaaagggaacaagtgcagggatcctgggctccacccacctcctttcccacaccagagagacactgactcctgcgccaggacccagggtctccagaccttgaactaaagctcctttccagcctccagccccccaccccccagggaggggctgctggggctctgtctcagaggttcacctcacctctgtcgtccccgtaaagctacagactgcagagctctctagggtggggcacgcgaagctgactcacacaagraagttaggattaatgaatgcccaggccaccagcctcacagggccatactcccagaattcttaattctgtaacaagccaggcactattgacaaagataaaagtagagaactgtgcagcccaggcagcccacagtgctcaggaaatcagacacacgagtaaactaaaaaccagtcaaccaacttgcttcagccgttggttcccagaggaaagaacccctggaggagctcctccagctccacttaggccattatgggccaaggccagggagggagcgccacctcctggtgggaaaagaaaaag

SEQ ID NO: 109350 - DNA, 601 bp, Human
acgataggaagtgggggtcggatgtgcctcattatacctctccatcattaacatcaacatagactttaacaaatcccaaactcataactcagcatcatcccgtctcagatgttagtgcctgcattttactacggcctttcatggctggtgctttaacccaaaggcacagctcactggaggactgtaggcacccactgcagtgattcttggggagggccggaagtagagcgcatcagcgctgaaagggaacaagtgcagggatcctgggctccacccacctcctttcccacaccagagagayactgactcctgcgccaggacccagggtctccagaccttgaactaaagctcctttccagcctccagccccccaccccccagggaggggctgctggggctctgtctcagaggttcacctcacctctgtcgtccccgtaaagctacagactgcagagctctctagggtggggcacgcgaagctgactcacacaagaaagttaggattaatgaatgcccaggccaccagcctcacagggccatactcccagaattcttaattctgtaacaagccaggcactattgacaaagataaaagtagaga

SEQ ID NO: 109351 - DNA, 601 bp, Human
tgcccccagcaggactctgccgcacctccctgctcctaacagcctctgttcctggagtactcctcctgcaggccagattccagctttccaggcaggaataatggagcaagaactgcatccaaacagccctaaatgaggacctgtaatcccctcgtcctcattcccagggtgcaaaccatctgtaaaccaaaaataaaatcctaaggccccccaccatctgaagggacttcctcctcagccagggctcttttaatgtttaacctgagagactgtttcaggccacgataggaagtgggggtcsgatgtgcctcattatacctctccatcattaacatcaacatagactttaacaaatcccaaactcataactcagcatcatcccgtctcagatgttagtgcctgcattttactacggcctttcatggctggtgctttaacccaaaggcacagctcactggaggactgtaggcacccactgcagtgattcttggggagggccggaagtagagcgcatcagcgctgaaagggaacaagtgcagggatcctgggctccacccacctcctttcccacaccagagagacactgactcctgcgccagga

SEQ ID NO: 109352 - DNA, 601 bp, Human
ttgggtaattaaatcaggattttaaatgaaatacagcatttagataatatccaatattggctacagtaagcacattaaaagtagtcaccaataagttatacatttaatgagagagaacagacactcttgggttctaggcgagctgccctgaggatttctctcctgccttgtgcagcacgttcactgttcatgtcttattctccaggtggactgtagctgactcagccagggtctgttcctacttaaacattaggctagccacctcatcgtgcaggtgagaaaactaaggccaaaagagctytgaggccacgaccagtggcagggctgattctagaaaccaggactcttgattcataggtctgtgctttattaatgcattcagttgccgattcatgaaaccatgtctgatctgctgatggagaggcacgaggaatcacctggcttcacacaaggatccttcctccaataaaacaaactacttggtgggacagaaatctgatcttattgaataataaccatgatagtaatagaagtagcagctaatatttattattccatggttacgtatcaggcatgtgcaaagtacttcacctgtattaac

SEQ ID NO: 109353 - DNA, 601 bp, Human
catacctcctgtctcagctcaagcctcatgtcctcccaaaagctcgccccaccatttattctcttcctgtaatactcattgttaactcaatgcagaatcatgcttttaaaaacactatctactttctcttctttattacataccttgcttcccctactgaccaatctgcaagctctcataagacaggggccctcttccatttctctggcacctgctggggctcctttggtgactgtctgcaaagaggccccaacaacttcttccactactcctcccctcaagaggtagaatctctctctcrccatatctggcctagccatgagactggttttgatcaatgggcagaagcaacagttagttcagggactgagtcttgaggagtctcgctgttcctgctttcatcctcttggaagccagcagccaggtaaagcagctcagaccagtgaaattcagcaagaaggcaggtgacgccccccagccaacgacaaggccccagacacaggagtggggctgtctgagatctttcagctccagtgaaggggtcttgaccggagacttctagaatctctgttcctactatagggccaagggtcatgaacct

SEQ ID NO: 109354 - DNA, 601 bp, Human
acaccctgggaggacaggcaataaatgctctaatgcctatttgcagcatcttatacaccagatgcttcaagaaggaaagattaatccaggccaggctttgactcctgtctttgagagctctgacatctcagtcatcttctcaggaaagcccagaaaatccaatacccctcccgaaatgctcaagcagaggtgattgtaagatccatgtcactaacggtggctttgtgctaagacatgcctgggtgtctaacccccaaccccctacaaatcccagaaggctgaattcttaatgtgctaaggrgaattatatagagctatgcttcccaaactttgtaggggtattggaaccacctgggaatctttaaagcttgaaatcaacaaatttagaacaaataaagggaacatagtgctggccacagtggttgtaaacttgtggagacacgaaggcccaaagtcctaaagcctaaaattacaaaagcttacagaataatgaattcaattcataaggaatcttggaaatgaaaaatgagcacatctgaagatggcgctaaacttttcaagttgctaccaggagggacaatcacatcctcccctctacaca

SEQ ID NO: 109355 - DNA, 601 bp, Human
ggattaaccaactcttggggccacaagacttggccagcccagtgaatggggagcccagggctgctccagactggatcgggaccaggacgctggtactatgaccaccatcagtccgaagctcctctgtacaatattatcaaatccacaagataaagcatttcttgtgtcttttccaccattactttgaaaaccttcactacaccctgggaggacaggcaataaatgctctaatgcctatttgcagcatcttatacaccagatgcttcaagaaggaaagattaatccaggccaggctttgackcctgtctttgagagctctgacatctcagtcatcttctcaggaaagcccagaaaatccaatacccctcccgaaatgctcaagcagaggtgattgtaagatccatgtcactaacggtggctttgtgctaagacatgcctgggtgtctaacccccaaccccctacaaatcccagaaggctgaattcttaatgtgctaaggggaattatatagagctatgcttcccaaactttgtaggggtattggaaccacctgggaatctttaaagcttgaaatcaacaaatttagaacaaataaagggaac

SEQ ID NO: 109356 - DNA, 601 bp, Human
ccttgccaagcagcaccaaagcatgtgattccctggctccccagctccgctgcactgccacccctgcctcgtgttcatataaccctgtccagatccaaccccactgaatcctcggctacaactctgactcttgcaaaggattaaccaactcttggggccacaagacttggccagcccagtgaatggggagcccagggctgctccagactggatcgggaccaggacgctggtactatgaccaccatcagtccgaagctcctctgtacaatattatcaaatccacaagataaagcatttcttrtgtcttttccaccattactttgaaaaccttcactacaccctgggaggacaggcaataaatgctctaatgcctatttgcagcatcttatacaccagatgcttcaagaaggaaagattaatccaggccaggctttgactcctgtctttgagagctctgacatctcagtcatcttctcaggaaagcccagaaaatccaatacccctcccgaaatgctcaagcagaggtgattgtaagatccatgtcactaacggtggctttgtgctaagacatgcctgggtgtctaacccccaaccccctaca

SEQ ID NO: 109357 - DNA, 601 bp, Human
caggaatctctgtggctaccgaaggtctcctgtgaaccctgagttctactcagactccgtctcccctgttaggtgccttgccaagcagcaccaaagcatgtgattccctggctccccagctccgctgcactgccacccctgcctcgtgttcatataaccctgtccagatccaaccccactgaatcctcggctacaactctgactcttgcaaaggattaaccaactcttggggccacaagacttggccagcccagtgaatggggagcccagggctgctccagactggatcgggaccaggacrctggtactatgaccaccatcagtccgaagctcctctgtacaatattatcaaatccacaagataaagcatttcttgtgtcttttccaccattactttgaaaaccttcactacaccctgggaggacaggcaataaatgctctaatgcctatttgcagcatcttatacaccagatgcttcaagaaggaaagattaatccaggccaggctttgactcctgtctttgagagctctgacatctcagtcatcttctcaggaaagcccagaaaatccaatacccctcccgaaatgctcaagcagaggt

SEQ ID NO: 109358 - DNA, 601 bp, Human
cttgcagttggaggtgaccagtgcggcccgtgggcagccgtcagaaatgcgccagtcagggacgctgccaggagagctgctcttcacaggctgttgccacctgctctggaactcaggaagtgggagatgatgagtcagagtccattctctcaaggcaagactcctcccaggtcaggctctctggcgccttgctgaatcccaagcctccccaagccaagcctcctccggttgccatgccaaccccccaggagacacactcagcctaggagtcccagggtggggcgggcagcgccctgggaasgaacggacaggtgtgagaatgcagggggcagggaggttggaagagcaagtgggcaagtgagattatccagggcccagcggcaaaacaggacactggtgtggccccagaccctagcagctgttgccactggaagcccatcagcccactgagacctagaacagcaagccgctgagggaggagtttgctgtcattaatgtcacctccatcccagctgagcagtggtcctctgtggccagggacacaaagaggagaagaggagccctgctccatccaccactagagccggcttcggtgactaga

SEQ ID NO: 109359 - DNA, 601 bp, Human
gcagacagctcacacccacaggcgtggccaagtatacctgtgattcacaaaacacactcactcacaccccgctaccttctaggtcctgggctttcttcatgtaaatcttcagttgctttttgagcttcctctcattcttttccagcttttctaccagttctttaaggtcctggaagcagaggaagcagtgtgagaacagacatcagcccggcctgggatggtgggggtaaaatcctgcttgcagttggaggtgaccagtgcggcccgtgggcagccgtcagaaatgcgccagtcagggacrctgccaggagagctgctcttcacaggctgttgccacctgctctggaactcaggaagtgggagatgatgagtcagagtccattctctcaaggcaagactcctcccaggtcaggctctctggcgccttgctgaatcccaagcctccccaagccaagcctcctccggttgccatgccaaccccccaggagacacactcagcctaggagtcccagggtggggcgggcagcgccctgggaaggaacggacaggtgtgagaatgcagggggcagggaggttggaagagcaagtgggcaagtgagat

SEQ ID NO: 109360 - DNA, 601 bp, Human
gctggactgggcagagccaccaagaaatcagtgatgtaggaagaatgtgcagagggcaggcagacagctcacacccacaggcgtggccaagtatacctgtgattcacaaaacacactcactcacaccccgctaccttctaggtcctgggctttcttcatgtaaatcttcagttgctttttgagcttcctctcattcttttccagcttttctaccagttctttaaggtcctggaagcagaggaagcagtgtgagaacagacatcagcccggcctgggatggtgggggtaaaatcctgcttgsagttggaggtgaccagtgcggcccgtgggcagccgtcagaaatgcgccagtcagggacgctgccaggagagctgctcttcacaggctgttgccacctgctctggaactcaggaagtgggagatgatgagtcagagtccattctctcaaggcaagactcctcccaggtcaggctctctggcgccttgctgaatcccaagcctccccaagccaagcctcctccggttgccatgccaaccccccaggagacacactcagcctaggagtcccagggtggggcgggcagcgccctgggaaggaac

SEQ ID NO: 109361 - DNA, 601 bp, Human
caagccgtttgagggcagggaccaccaggtcacctctgggttccccattcctctagccctgcagagccttgctcagagtaagcacccaaactggctgaattcaagtgtcttttgtccatattctggcaactgcagatgggtaagctcatgggatccaacttctatcgcctggctggactgggcagagccaccaagaaatcagtgatgtaggaagaatgtgcagagggcaggcagacagctcacacccacaggcgtggccaagtatacctgtgattcacaaaacacactcactcacaccccsctaccttctaggtcctgggctttcttcatgtaaatcttcagttgctttttgagcttcctctcattcttttccagcttttctaccagttctttaaggtcctggaagcagaggaagcagtgtgagaacagacatcagcccggcctgggatggtgggggtaaaatcctgcttgcagttggaggtgaccagtgcggcccgtgggcagccgtcagaaatgcgccagtcagggacgctgccaggagagctgctcttcacaggctgttgccacctgctctggaactcaggaagtgggagatgatgag

SEQ ID NO: 109362 - DNA, 601 bp, Human
aacaggtaaaatgacaactgtgatcagggttgtgcccaacacacaagtggggtcaggactgtctaagacgagactcaagccctgagcatgtggctcctgagctgagggtggaaggatgtggaggggtatccaagcagtgaggggctgaaagagggttccaagcagggtgacatatgtaaagagtgacacagtgagatttgcagcagggagtcagagggagagaacattctaggtctttctggaagagtgatttaaatctctacctgaagatcccagattggaagtttaatcctgacactcmatagcatggagtgaggaccttggggtttaggtctttgtgttacacagcattctttcacatcaatcttgcctcccaacttcaagccgtttgagggcagggaccaccaggtcacctctgggttccccattcctctagccctgcagagccttgctcagagtaagcacccaaactggctgaattcaagtgtcttttgtccatattctggcaactgcagatgggtaagctcatgggatccaacttctatcgcctggctggactgggcagagccaccaagaaatcagtgatgtaggaagaatgtgc

SEQ ID NO: 109363 - DNA, 601 bp, Human
actcaggcctctcctcagcctcacaccatggtagagggacagtgggcaaccacagcatcactcccaaacacatctcagtgctgactgcacacgggacgctgtcctaagcatgggaacagatacaatggcatgcttaatctgtccctggccagtcgaactaaggagacacatctgtacattcacatggaaacactatgacacagctcagtcaggcaccaagccaggagtgtgtgatgtgggtgctggtggtgatgggctggaaggaccccacggaggaggtgggatgaagggtgggtgctgrtgatgtgggtgctgatggtggtggggctggaaggaccccacagaagaggtgggatgaagggcgggtgggactcttacatccaggttcaaaggagctgatccactgggaaaggaccaatggaagaggaccaggacgagtgacacccagggaagggtgctccatgaactcctagtggctgaagggaggctctgagtggaggtgggggagagtgtgagaggatgaaggctggcagactagggctgggatttcattctgcaggcaataaggcaaaggcaaaggccagacagtgctgtgaaaaaa

SEQ ID NO: 109364 - DNA, 601 bp, Human
acactgtctgtgacctgtgggtggtggatcagggtggtgatggtgatagtaaggacacgtcctcagccactaaatgcaggttcaggtttaggaagctgccaagtgcagtctttgcaactacataagatgatgactatttgggaagagtttcagtggcagggttgaaggtataaaggcctggtcaaccctcactcaggcctctcctcagcctcacaccatggtagagggacagtgggcaaccacagcatcactcccaaacacatctcagtgctgactgcacacgggacgctgtcctaagcaygggaacagatacaatggcatgcttaatctgtccctggccagtcgaactaaggagacacatctgtacattcacatggaaacactatgacacagctcagtcaggcaccaagccaggagtgtgtgatgtgggtgctggtggtgatgggctggaaggaccccacggaggaggtgggatgaagggtgggtgctgatgatgtgggtgctgatggtggtggggctggaaggaccccacagaagaggtgggatgaagggcgggtgggactcttacatccaggttcaaaggagctgatccactgggaaa

SEQ ID NO: 109365 - DNA, 601 bp, Human
tggccatcgtgacacagccgcagggcaaacccaggtgttcagggcaaggcctggacactgtctgtgacctgtgggtggtggatcagggtggtgatggtgatagtaaggacacgtcctcagccactaaatgcaggttcaggtttaggaagctgccaagtgcagtctttgcaactacataagatgatgactatttgggaagagtttcagtggcagggttgaaggtataaaggcctggtcaaccctcactcaggcctctcctcagcctcacaccatggtagagggacagtgggcaaccacagcrtcactcccaaacacatctcagtgctgactgcacacgggacgctgtcctaagcatgggaacagatacaatggcatgcttaatctgtccctggccagtcgaactaaggagacacatctgtacattcacatggaaacactatgacacagctcagtcaggcaccaagccaggagtgtgtgatgtgggtgctggtggtgatgggctggaaggaccccacggaggaggtgggatgaagggtgggtgctgatgatgtgggtgctgatggtggtggggctggaaggaccccacagaagaggtgggatg

SEQ ID NO: 109366 - DNA, 601 bp, Human
tggccacaacgtggccatcgtgacacagccgcagggcaaacccaggtgttcagggcaaggcctggacactgtctgtgacctgtgggtggtggatcagggtggtgatggtgatagtaaggacacgtcctcagccactaaatgcaggttcaggtttaggaagctgccaagtgcagtctttgcaactacataagatgatgactatttgggaagagtttcagtggcagggttgaaggtataaaggcctggtcaaccctcactcaggcctctcctcagcctcacaccatggtagagggacagtggrcaaccacagcatcactcccaaacacatctcagtgctgactgcacacgggacgctgtcctaagcatgggaacagatacaatggcatgcttaatctgtccctggccagtcgaactaaggagacacatctgtacattcacatggaaacactatgacacagctcagtcaggcaccaagccaggagtgtgtgatgtgggtgctggtggtgatgggctggaaggaccccacggaggaggtgggatgaagggtgggtgctgatgatgtgggtgctgatggtggtggggctggaaggaccccacagaa

SEQ ID NO: 109367 - DNA, 601 bp, Human
tgccaaagcactgtggcccgtagagagctgcaccaaggaaagggggctgtggctgctgctgaggaaaagcatgtgggtggctcccctcccacttccatcgtatgggcagaacaaagaagcagtgggtcttgccatcgagaatagcagctggacacagcaggagctggggggaggatgagagtaggtgtggggagtggaagatgggggcaggtgcaagggcaagtaggagacagagggtgggggctgtgcaggaggtgaaggaaggggtgtgggggttgtgctggggatggagatgggagcrggggctgaaggaggggcaggcagcatagggtggcacagagggtccttacctgtcaccaggttccggatgaggagggcctcgtcctctttgtggtactccagcatgccctggaaatccttctctttccgctggaccgtgacctgcctgttgagctcatggcgcttcctctcactctgggccaatgcctgggcagctgagcaggaaagaaaacaggaagcatggatgagacttccagctgcaggcctgagggtagcgggcatctctggcgggtggaggatgggacctggggcaggggaaggg

SEQ ID NO: 109368 - DNA, 601 bp, Human
agtcctaaccaaacagaaggagtctgaatccttgatccactgcttcccagctgtgtgacctgggcaagttactagagtgagtctctgtttccttcagtgtaaaatgagaaggcagcagttctgacttaaagggaggttgtgaggattaaaggagggatgagtctggtagaggatgtgctccaaaagcatgagcttccatcattgccaaagcactgtggcccgtagagagctgcaccaaggaaagggggctgtggctgctgctgaggaaaagcatgtgggtggctcccctcccacttccatmgtatgggcagaacaaagaagcagtgggtcttgccatcgagaatagcagctggacacagcaggagctggggggaggatgagagtaggtgtggggagtggaagatgggggcaggtgcaagggcaagtaggagacagagggtgggggctgtgcaggaggtgaaggaaggggtgtgggggttgtgctggggatggagatgggagcaggggctgaaggaggggcaggcagcatagggtggcacagagggtccttacctgtcaccaggttccggatgaggagggcctcgtcctctttgtggtactc

SEQ ID NO: 109369 - DNA, 601 bp, Human
gccaggtctgaacacagcccatgtgattccagagaccacacccacatgtgctgtaccacacagcactttaaactgtaaagtcctaaccaaacagaaggagtctgaatccttgatccactgcttcccagctgtgtgacctgggcaagttactagagtgagtctctgtttccttcagtgtaaaatgagaaggcagcagttctgacttaaagggaggttgtgaggattaaaggagggatgagtctggtagaggatgtgctccaaaagcatgagcttccatcattgccaaagcactgtggcccgyagagagctgcaccaaggaaagggggctgtggctgctgctgaggaaaagcatgtgggtggctcccctcccacttccatcgtatgggcagaacaaagaagcagtgggtcttgccatcgagaatagcagctggacacagcaggagctggggggaggatgagagtaggtgtggggagtggaagatgggggcaggtgcaagggcaagtaggagacagagggtgggggctgtgcaggaggtgaaggaaggggtgtgggggttgtgctggggatggagatgggagcaggggctgaaggaggggcagg

SEQ ID NO: 109370 - DNA, 601 bp, Human
aagccaggtctgaacacagcccatgtgattccagagaccacacccacatgtgctgtaccacacagcactttaaactgtaaagtcctaaccaaacagaaggagtctgaatccttgatccactgcttcccagctgtgtgacctgggcaagttactagagtgagtctctgtttccttcagtgtaaaatgagaaggcagcagttctgacttaaagggaggttgtgaggattaaaggagggatgagtctggtagaggatgtgctccaaaagcatgagcttccatcattgccaaagcactgtggccygtagagagctgcaccaaggaaagggggctgtggctgctgctgaggaaaagcatgtgggtggctcccctcccacttccatcgtatgggcagaacaaagaagcagtgggtcttgccatcgagaatagcagctggacacagcaggagctggggggaggatgagagtaggtgtggggagtggaagatgggggcaggtgcaagggcaagtaggagacagagggtgggggctgtgcaggaggtgaaggaaggggtgtgggggttgtgctggggatggagatgggagcaggggctgaaggaggggca

SEQ ID NO: 109371 - DNA, 601 bp, Human
aactttcattctcacaactccatgccagcggcatgatcccctttcctgtgctctacacaagaacactggtgagtagcacagccacggccatgtgcggctagttaggaaagaagccaggtctgaacacagcccatgtgattccagagaccacacccacatgtgctgtaccacacagcactttaaactgtaaagtcctaaccaaacagaaggagtctgaatccttgatccactgcttcccagctgtgtgacctgggcaagttactagagtgagtctctgtttccttcagtgtaaaatgagaargcagcagttctgacttaaagggaggttgtgaggattaaaggagggatgagtctggtagaggatgtgctccaaaagcatgagcttccatcattgccaaagcactgtggcccgtagagagctgcaccaaggaaagggggctgtggctgctgctgaggaaaagcatgtgggtggctcccctcccacttccatcgtatgggcagaacaaagaagcagtgggtcttgccatcgagaatagcagctggacacagcaggagctggggggaggatgagagtaggtgtggggagtggaagatgggggca

SEQ ID NO: 109372 - DNA, 601 bp, Human
cacagctgcctggtggccccagggagcacatgggggtgggaggctggcaggccagccctgattcagccacatgcctggataagaaactgcagatgatcgcagggacagtaaaagccaaccctgatgaactttgacagtgggaccagggtgatcccagacagactgcagaagctcagcattcctcactttaatgagcctgtgaatgtcacctggcatcttgttatgtgccttgcaattgaggaggcctggcacggagcccgagactctgcatctctcaccccttcccaggggtgatactgaygctgatgctgatgctgctggtccagggaccatgtatgagcaacgaaatacgaactttcattctcacaactccatgccagcggcatgatcccctttcctgtgctctacacaagaacactggtgagtagcacagccacggccatgtgcggctagttaggaaagaagccaggtctgaacacagcccatgtgattccagagaccacacccacatgtgctgtaccacacagcactttaaactgtaaagtcctaaccaaacagaaggagtctgaatccttgatccactgcttcccagctgtgtgac

SEQ ID NO: 109373 - DNA, 601 bp, Human
ggggtctcaccatagctctgcactgtatctccagcccttgttctttacactcataccctcccaaacgaggcctcatgagccacctgtaggctcagaatggcaatgaagggaggccacctccctcccacctgcaggtgggcagtatccttgcaaaccttctaccaggctggtcctgggctgggctctgctgccagcagctccagttggtacttgggttacattgtccctgctccaacgcatccttctagttaaatgataactgtaggccataatactcttgagtacatggttgacatttggscattttataggtccagcagatggctgtggattggccattggctctagttagaatgccagtcatttatccaggaaaatgtattttgtaggcccagacttccaatccataacttcttacttcaaacctgatccatgtgcagattgcaaacaacttgtcctgtcttggaatgttctattgtgattaaataaagcttgtttgggtgccccagctaaatgttagcatcttggggaagagacgatgacactagttttatttctcctccacagcaactggccagtgccaggtacctaagaggtaggt

SEQ ID NO: 109374 - DNA, 601 bp, Human
gaaggccagagaactagggggaaaggcctggtgcaaaggcaagatgacaggtgagaatggggcaggagcacaaggccccaggggtctcaccatagctctgcactgtatctccagcccttgttctttacactcataccctcccaaacgaggcctcatgagccacctgtaggctcagaatggcaatgaagggaggccacctccctcccacctgcaggtgggcagtatccttgcaaaccttctaccaggctggtcctgggctgggctctgctgccagcagctccagttggtacttgggttacaytgtccctgctccaacgcatccttctagttaaatgataactgtaggccataatactcttgagtacatggttgacatttgggcattttataggtccagcagatggctgtggattggccattggctctagttagaatgccagtcatttatccaggaaaatgtattttgtaggcccagacttccaatccataacttcttacttcaaacctgatccatgtgcagattgcaaacaacttgtcctgtcttggaatgttctattgtgattaaataaagcttgtttgggtgccccagctaaatgttagc

SEQ ID NO: 109375 - DNA, 601 bp, Human
caggggcccatggcaagtggaaggctgaggacagggcctagctcccacatgggggcaggaactcctgattcgtgggcaccaccacttccagaaggcaagggctggctccagaattagacaaattgtatgtgcccaaagacagggccagcctgctgagggctagggaggttggaacaatctctggcccatcagttcaggaacaaattacccagccgtgcttgcccagcttcacagccaaatagatcaggcaggccccccttccccaccccggtgctgctgcttggcatgcatctctccagcrgctctcttacttcccccaactgctctcctctgtatcccacactcctgtccctgcctgggcaagggctgctctggctggactggaagggccttgtgagtctccccattaactgcagactcagccctttggccctttcttgcaaaaggccctggagggacaggaagcagctgtcagaccattttctattccagaccatgccagctgagccagacttaaggcaacaggtggtggtagaaggccagagaactagggggaaaggcctggtgcaaaggcaagatgacaggtgagaatggggcagga

SEQ ID NO: 109376 - DNA, 601 bp, Human
cacattcctaattgtctgcactataaccctgaaacaggcttctaatgcctcagcctaacaatatggaggaaaagtgcctgcaagttacacagatgcctcagtccgcagccaacaggggcccatggcaagtggaaggctgaggacagggcctagctcccacatgggggcaggaactcctgattcgtgggcaccaccacttccagaaggcaagggctggctccagaattagacaaattgtatgtgcccaaagacagggccagcctgctgagggctagggaggttggaacaatctctggcccawcagttcaggaacaaattacccagccgtgcttgcccagcttcacagccaaatagatcaggcaggccccccttccccaccccggtgctgctgcttggcatgcatctctccagcggctctcttacttcccccaactgctctcctctgtatcccacactcctgtccctgcctgggcaagggctgctctggctggactggaagggccttgtgagtctccccattaactgcagactcagccctttggccctttcttgcaaaaggccctggagggacaggaagcagctgtcagaccattttctattc

SEQ ID NO: 109377 - DNA, 601 bp, Human
ttgtactgtgtcaaatacaaagccatcttaatatgaaaaaaagcaggcagaaaaggggataattgtaatgatgaagatagagtcaatcattcttccttgttatttggactacacggatctggtcatgctgtggttcagctcttgacccagagaatatgagcacatgtaaccacaacctaatgtaatggagttctaggtcctgccctagccttatataacctcccatttagaatgtgtataacattgggtaaagtgatggacctcaatgaaataacattacatgtagttctatgcttcaagkaaatgcttggatattatgattttgtaacagaagtcatggggtttgaaatggctatttctttaacctttggcccatctcttttataataaaagcaggccatcaaatgaagtgctggttcttaggagagagatggcgtcaagccaactgcaaagaaggtaagactgaaaggaagggcatatccttttactaacccagggagaagagtctgtcaaaattggttctggcacaaaagatggaataaagctttaaaaatggtcgcactattttggtttacactatgtcttgaccttgggaagggtg

SEQ ID NO: 109378 - DNA, 601 bp, Human
tttaaacccaagtctgtctgactccagaactgctgctattaaccttcacattattctgagtatctccagcttgatatgtcagttctccctctgtctggtgccttataaaaagatttccagacaggaaggagggtttggaatgaacctcatttcaagtaatgtatttctagattggtccttcttgggattcactcataacctacttgtgttgtaagaacctggggaaagcattatgaataggtccaggtacactttccttcccagcctttgcagagcacagtgagtaatgcatctacacatmatttttcttccgattgaaaatgtaactgctctcatttctcaattctgatttcatgttcagtgcccaagtacactgcttggttcaaagcaagtgtctaataaatactgatgcatcgtgccgactgctgtgtcctttcgcatgaacactcctgcttttttccatgaatcaagttcataataggttaagagggttatgctttttcactgtatatgcatttgtaccttttgagtttacatttattatgtattaaaatttgggaaaaaatacaacatattacagaaaaagagataaagggaaagt

SEQ ID NO: 109379 - DNA, 601 bp, Human
gcaaatacctgatgctgccaatttctgaaaatttgtggatttctatgtaagaaacattccagaattcattatatttaaagaagtttttacctaaacttaacgttttgtgagtttgctaccttatctttttaagtgagtaagagggatagagagttactagaaaacagtatctgtggcatcttgtttcacagaccaaatggtttttggttcatctaggaatatcccatcagctgcacttcaaaattgtctcattaggggtatataaagggtgggagtgcaacactaacaaataaccaccaaygagaacagacttggaatggactcagggcttccttggaataccatgttgacagaggtgcaaagtgactgtacctgctgggtgctgagggaggtacacagggagcagatagcctctgcgtcctcctgggttttcttctttaattgcaggagctgggctgcttggatcagaggttccatggtctgaactgctccactctggtgaaggtttcttccccgaagccactcctcaagctgacttatattgtaccttagccataggtagaaagcaagctatgttaagccggtcctcctaattcactga

SEQ ID NO: 109380 - DNA, 601 bp, Human
acacttaaatgcccctaagttcttaatgacttcatttaaaacaatataaatgagtgtgagtgaaaatatgaccatattgcaattagttttaaagaaaaggtttttcttacagttatatttgtaaagaaagcaaatacctgatgctgccaatttctgaaaatttgtggatttctatgtaagaaacattccagaattcattatatttaaagaagtttttacctaaacttaacgttttgtgagtttgctaccttatctttttaagtgagtaagagggatagagagttactagaaaacagtatcygtggcatcttgtttcacagaccaaatggtttttggttcatctaggaatatcccatcagctgcacttcaaaattgtctcattaggggtatataaagggtgggagtgcaacactaacaaataaccaccaacgagaacagacttggaatggactcagggcttccttggaataccatgttgacagaggtgcaaagtgactgtacctgctgggtgctgagggaggtacacagggagcagatagcctctgcgtcctcctgggttttcttctttaattgcaggagctgggctgcttggatcagaggt

SEQ ID NO: 109381 - DNA, 601 bp, Human
tagatatttaatattttaatagtaagcagaggaggtaaggaaaggtgttcactttgctatattaagatgtgtttttctgtactgagtttggattttgttatttatctttcagggactggcaatgtgtcggcaactgaatcatggttatacattttttagggaaaaggaaagtaacacttaaatgcccctaagttcttaatgacttcatttaaaacaatataaatgagtgtgagtgaaaatatgaccatattgcaattagttttaaagaaaaggtttttcttacagttatatttgtaaagaragcaaatacctgatgctgccaatttctgaaaatttgtggatttctatgtaagaaacattccagaattcattatatttaaagaagtttttacctaaacttaacgttttgtgagtttgctaccttatctttttaagtgagtaagagggatagagagttactagaaaacagtatctgtggcatcttgtttcacagaccaaatggtttttggttcatctaggaatatcccatcagctgcacttcaaaattgtctcattaggggtatataaagggtgggagtgcaacactaacaaataaccacca

SEQ ID NO: 109382 - DNA, 601 bp, Human
tatctactagtaatttaaaggtttcttctgaagagtactggagatcttaccttagatgagaaaggtcttgtttaatacctaactaccccctgtcccccaacattgtttacaaatgagtatttgaacaggagatactcttttgtctgcctaccactggtttggtggaagtagactgcccaaatgcaatgccagctgcatctagaaggaaacttactttaagtgaaatgtatttaaagagaagaaaaatgtttgaagactttctggaaatgtttacagaaggaagcagttttttaaagagttmgatatttaatattttaatagtaagcagaggaggtaaggaaaggtgttcactttgctatattaagatgtgtttttctgtactgagtttggattttgttatttatctttcagggactggcaatgtgtcggcaactgaatcatggttatacattttttagggaaaaggaaagtaacacttaaatgcccctaagttcttaatgacttcatttaaaacaatataaatgagtgtgagtgaaaatatgaccatattgcaattagttttaaagaaaaggtttttcttacagttatatttgtaaagaaa

SEQ ID NO: 109383 - DNA, 601 bp, Human
atttcctttatagtcgtagactggactttataaaattactatcttaaaactcacctggattgttcgtataaaggccactgttacccgttcttcaaattcattcaggggagtataaaggtttaaaattttgacaatctgttggggataaaaacggaatttagcacagagctaaatgaacatgagacaacttttgaactttaaagaatatgtgacattggtacaagagtatgatcctctttagacaaggcccacaacacagatggagctggactgacatttacacttggagcctgcatccagkaaactagagcccacagctttgtcaggtggatctgagccctctcaccgaactcatgtctcctgtaaacccacctgcccctccccactatgctcattggtatacacaatgaggagtttagaatgcagttgcctgaaatcctcagcctcatatctactagtaatttaaaggtttcttctgaagagtactggagatcttaccttagatgagaaaggtcttgtttaatacctaactaccccctgtcccccaacattgtttacaaatgagtatttgaacaggagatactcttttgtctgcctacca

SEQ ID NO: 109384 - DNA, 601 bp, Human
gcacctggcctatattataagtcttagacaaagatttaagagctcaaattgctttctttaaagaacatttcttagttccatttatggttagggctgatattctgctgacattgttaattccatttggtgctaatagttcagtaacatgctagtggcaaatgacataatgcttaaactatgtctataatctgagaggcagagatgataaaagttgagttttctgtgtgtaaacagtaagttactcatgggtgatacggttcatgtttacctaagtagaaagtctaggaatgtaaggtctccyagcatatatgtaaccagtattttagtaataaagagaagcaagattaaagcccaaatttttaatttcctttatagtcgtagactggactttataaaattactatcttaaaactcacctggattgttcgtataaaggccactgttacccgttcttcaaattcattcaggggagtataaaggtttaaaattttgacaatctgttggggataaaaacggaatttagcacagagctaaatgaacatgagacaacttttgaactttaaagaatatgtgacattggtacaagagtatgatcctcttt

SEQ ID NO: 109385 - DNA, 601 bp, Human
taaacctgcagtatgatgtggcatatattttttaacctgaattctcataaacagtggggttgccaatttatgagcagttatagttctccctctaatgtgtgtctcagatattcgaaactaaacaagactttctaaacttgcacttttgtataaattatcagccctccataaaaatccatataatgggtccaggttcagatatctcagtggcttctgtcatcaaactcttcccattcagcagctgactatgagcatcctaactggatcctttctgtcagcgccacccacaaccccattgttrtatacatgttggtgagtagagagactcactctgcctgccccattctgcggcctgtgtctttaacaatcgactgtgtttctgtcattgcccttaggagaacaacctttagtctgactaggcaccacttcccagacgttccctctgttggcctctgttccctacttagatgctgggctaaagttcatttaggctttttttttgccatggctcttttcaaacccctttttagctcttttcagggctctctaaatctctggatctacattgaaacactgtaaggagctccaaataaaatcccag

SEQ ID NO: 109386 - DNA, 601 bp, Human
aagtgaaataagccagacccgaaagaatatcgtatgagccaacttatatgtgatatctagaatttacatatagaagcctacccagggttgaagggaagggagaatattatttgcccaaatgggtagtgtttctgtttaggatgatgaaagaattttggaaatagtggtgatggttatgtaatattgtgaatatacttaatgccacggaactatacacttaaaaatggttaaaatggaacacacataccccaaaaccatgggatggagaagagtacccttctgataaggttgtgaggatttraagagttaacaggtgtaaagaacacagagtaccatcactggcacatagtaagtgctgtatttgctgttatcagttttataatatgctcctttgttcctcctgcccatgcattaaccattgacctctgaaccatgaactgctggtagaagctgtacttttacaaaagtcaatagggttaactgtgggagtattgccaaaaaggaaaatcaatatatcctgattttgtgaaaacacaatttatttttcttaaacctcgaaacaggccatagtcagtaaatacatagcagcatttgaaaatcg

SEQ ID NO: 109387 - DNA, 601 bp, Human
aaaacgcaaaaattagccaggcatggtggtgcatgcctatattccctgaggcaggagaattgcttgaacctgggaggcggaggttgcagtgagccaagattgcactactgcgctccatgggtgatagagtgagactctgtctcaaaaaaaaaaaaaaaaaaaaaaaggaaaacaaaattggaggactcacacttcccatttgaaaactttttacaaagctatgggaatcaaaacagtatggtactggtatacggacagacatacagaccaatagaatataagggcccagaaaaaaaaaaamccctcatatttttggtcaattgatttttgacaagggtgccaagtccattcaatgagggaaagggcagtgtctttgacaaatggtgctgagacaactggatatccacatacagaagaatgaagtgggacattcaccttataccatatacaaaaattaactctgaatggatcaaaaacttaaagggagctaaatctgcaaagctcttagaaaacataggggaaagtatttatggttcttaaaaatgacatcaagagcataggaaacaaaaaaatatacatagattggacatcctcaaaattt

SEQ ID NO: 109388 - DNA, 601 bp, Human
gatggagaaaagcatttgccaaaatccaacttttttaatgataaaaagataaatccctccatgatgaagaccatatgtaaaaaccccacatttaacatcacaaatatcacactcagaaagtttttcctctaagatcaagaataagataaggatgcctgttcttaccacttctattcagtatagttctagccagggcaattatacaagaaaagagataagaggcagccaatttaaaatgatcctcttgcagacaacatatcttacatgtagaaaaactgaaagaatccacacacacacacacacacacacacaaatattgctagagctaatgaattcagcgaagtacataataaaaaaaaacacataaaaatcagttgtatttctattcactagtaatgaataatcagaaagaaaaacaattccatttacaataacatcaaaaagaataaaatacttaggaataaatctagccaagaaggtgcaacacttctgaaaaagtcaagacctaaacaaatggaaagacaccccatgttcatgtactagaagacttaagatgacaatactacataagcaatctacagattcagtgcaatccctatca

SEQ ID NO: 109389 - DNA, 601 bp, Human
tcgatggagaaaagcatttgccaaaatccaacttttttaatgataaaaagataaatccctccatgatgaagaccatatgtaaaaaccccacatttaacatcacaaatatcacactcagaaagtttttcctctaagatcaagaataagataaggatgcctgttcttaccacttctattcagtatagttctagccagggcaattatacaagaaaagagataagaggcagccaatttaaaatgatcctcttgcagacaacatatcttacatgtagaaaaactgaaagaatccacacacacacacacacacacacacaaatattgctagagctaatgaattcagcgaagtacataataaaaaaaaacacataaaaatcagttgtatttctattcactagtaatgaataatcagaaagaaaaacaattccatttacaataacatcaaaaagaataaaatacttaggaataaatctagccaagaaggtgcaacacttctgaaaaagtcaagacctaaacaaatggaaagacaccccatgttcatgtactagaagacttaagatgacaatactacataagcaatctacagattcagtgcaatccctat

SEQ ID NO: 109390 - DNA, 601 bp, Human
ttatgggatgggataaacatagtgctaaaaagtttgtagctgtaaatgtctacattaaaaaaaaaaatctcaaatcaataacctaactgtataccttaaggaatcagaaaaagagcaaactaaacctaaacctagaagaaatgaaataacataaattagatggaaaaaatagagaacagatcaatacccaaaacaaatgaaatcaaagttggttcaaaaaattgacaattttttttttttttttaagatggggtcttgctctgtcacccaggctggagtgcagtggtgtgatctctgctcrcaatctccgcctcccaggttcaagtgattctcctgcctcagccccccaagtagctgggattacaggtgtgtgggaagactaaaatgagaaattagcaaatcagaaatgaaagtgaggacattactgccaattttacagaaataaaaaggattataagagaatactatgaaaaatttaacaccaacaaattggataacctagatgaaatggacaaaatcccaggaacacacaaactaccaaaactgatttaagaagaaatagaaaatttgaatagacctataacaagtaagcatattgaat

SEQ ID NO: 109391 - DNA, 601 bp, Human
ctgtataaggtatcctcaaataagattaacagctgtttttcatcagaaaccatggaggctaggaggcagtgggatgacacagctcaaatcctgaaaggaaaaaatcttgtctgctaagaattctaaatctggcaaaactacccttcaagaatgaaggagaaattaagtcatttccagagacaaagaaggacattatattttaataaaaggttcaactcatcaagaagatataataaacatctgcatctagcaacagaaccccaaaatatttgaagggagaattgacagactttaagggagratagttctacagtaatggttggacatttcaataccccatttttaatcatggatagaaccagatagaagatcaataagaaaatagaggccatgaacaacactataaaccaattagtcctaacaaacacatatggaacaccccacttagcagcatacacattcttctcaatgcatatggaacagtctccaatattcaaacaagtctgaataaatttaaaaatattaaagccatatgaaatattttttctgattaggatggaatgaaactataaatcaataaatgaaagctgcaaaatccaca

SEQ ID NO: 109392 - DNA, 601 bp, Human
aaatgaacagagcctaacagacctattggacaccatcaagtataccaacatacacattacaggagtaccagaaggaaaagagcaagaagggggcaacaaaatatttgaagaaataatgccagaaacttcccaaatctgatgaaagacatgtatgtaatcatccaaaaagttcaatgaactccaagcaggataaaggcaaagagattcacagtgaaacacattatactaaattgtcaaaaccctaagacaaagagggagtcttgaaggcagtgagaaagaagtgacttgtcacatacagtcrtccctcagtatccatgggggattggttccaggaattcccacagatacccagatccatggatatgcaagtactgctgtcggccctgtagaacctatagatagaaaaagttgtccctccataactacaggttctgcatcctgtgaatactgaattttgaatctgtggttggctgaatctgcagatatggaacctgtggatatggagggctgactgtataaggtatcctcaaataagattaacagctgtttttcatcagaaaccatggaggctaggaggcagtgggatgacacagctcaaatc

SEQ ID NO: 109393 - DNA, 601 bp, Human
gacagtgtataaggatagtaagccactgtgtttgtggaaccactgcatgtcaaaactccttaacactctaacaaggcatttttggtcttttaaggatggtccttacataagagactcactttcaaactaaagtgcattaaaaaacaaattatccttcacaaacaactttaaagaggtagccacaaacccagttgttttagattggccttctaaatgaagtcagcacatggatccatgggtaagtgtcatggacgtcagtgattatgtaactgtaactgaaagaaaaaggcacagctctgcmgatgcccaagagaagccggcatgtttaatgtggatgtagaggggataatgcccatgacaactgattggaacacaatgtcagcagccttaacccaggctaagactggcctaagccccaggagatgcagagaacaactgaggaagctgtgctctaagggcacagtgcagaaggtagcgtggagtgtgctgtgtttccaagagccttttaagttgggtggttgagtaaaagagggtgaaggcaggctgttctacttccaattcatggataaatcttattttctcaatgtaatacagaggctgt

SEQ ID NO: 109394 - DNA, 601 bp, Human
gtcttagtaggtcaagtgtatgaaaatttactttatgcagaagaaatgaattctaatttattggttactggaatcttaatgtatgaaagctctaagtaaatatttgatgaattgatggtagcagtgttgatttttaactgttccaagctcctagttttgttttgtttttacaaaagccttaaaatttagtactagggaaatcaaaggaagcaactcccactgacatgcttcatggaaaggggaaaaacatctacctttgggtctaatctgcctcccaggtgagcctacaggtactggaackctaactgcaactatgagggcacagggaaaatgcatgtatgtaatatgcttgtcagcttcagcaacaactcatgtgtacattcacatttactataagtaaacaggtcccgtataatacttaaaacacaagttttgatctataaatatttgattcttaatatttaaaatgcttctaatgttttaaaagacaaaactcccccatgatatcaccttgaacattaaaattattcccacagcaacacttatttcagagaaacaactgatgtcagttatcttagtaaccgctaaaggcacctggtga

SEQ ID NO: 109395 - DNA, 601 bp, Human
cagggccgggcgcggtggctcacgcctataatcccagcactttgggaggccgaggcgggtggattacctgaggtcgggagtttgagaccagcctgacagacatggagaaaccttgtctctactaaaaatacaaaattagctgggcatggtggcacatacctataatcccagctactagggaggctgaggcaggagaatcgcttgaacctgggaggcggaggttgcggtgagctgagattgtgccattgcactccagcctgggcaacaaaagcgaaactctgtttcaaaaaaaaaaaaaaaatttccatgtctgtcatcctcacacatcttaattactgaaattttgtaagtctcaatgcctgctaaggaaagcttcccactttctcaaggagggtcttccttattcatgggcctttgctcttccatataaatcttataatgagcttgtcagttttcacatagaaacagttgaaattttgatttttaatctatagatcaacttggggacaactgacaaacttttagtggtatggagtcttcgaattcttgtacctaattatttctccattttaatgttgtcattgtttttcacttatatttt

SEQ ID NO: 109396 - DNA, 601 bp, Human
gattttgatgtgtactcccagttaagaaaaaatgtatcagtatttccatatagatgctcagtttctgggctattctgttccactggtcaatttttccacatccagggccgggcgcggtggctcacgcctataatcccagcactttgggaggccgaggcgggtggattacctgaggtcgggagtttgagaccagcctgacagacatggagaaaccttgtctctactaaaaatacaaaattagctgggcatggtggcacatacctataatcccagctactagggaggctgaggcaggagaatygcttgaacctgggaggcggaggttgcggtgagctgagattgtgccattgcactccagcctgggcaacaaaagcgaaactctgtttcaaaaaaaaaaaaaaaatttccatgtctgtcatcctcacacatcttaattactgaaattttgtaagtctcaatgcctgctaaggaaagcttcccactttctcaaggagggtcttccttattcatgggcctttgctcttccatataaatcttataatgagcttgtcagttttcacatagaaacagttgaaattttgatttttaatctatagatcaa

SEQ ID NO: 109397 - DNA, 601 bp, Human
aagggcgcctgagagctcctggcaagccattggtgtaagtccaagggtccaaaggctgaagaacctggagtctgatgtccaagggcaggaggaatggaaggaagcatccagcacaggagaaagatgaaagccagaagactcagcaagccagcttatcccaccttcttccacccactttgttctagctgcgctggcagccaattgcatggtgcccacccacactgagggtggctcttcctctcccaggccaccgactcaaatgttaatttcctctggcaacaacctcacagacctactcagraacaatactttaccagctatctaggcatccttcaatcaagttgacaactaatattaaccgtcacagtatcatcttatcctgaaggagggctgattagagctaggctcaagctgcacctgggaaagcagctacagtccctcatattacctgggacagggcatatttggtgttacatggtttacacagtgatcttgtttttgtgcctgggcaaaattacagtcttgtttcatatcactttagtgtagtcagagtggccacatctgatattggtgttttataaggttgttcatagcaaaagaa

SEQ ID NO: 109398 - DNA, 601 bp, Human
caaaagaaagaaaggaagggagggaggggagggagggagggagtttattaaggagaattgactcacaggatcacaaggtgaagtcgcacaataggccatcagcaggctcagccaggaatggctcagtctgggtccaaaagcctcaaaagtagggaagccaacagtgtagtcttcagtctgtggccaaagggcgcctgagagctcctggcaagccattggtgtaagtccaagggtccaaaggctgaagaacctggagtctgatgtccaagggcaggaggaatggaaggaagcatccagcacrggagaaagatgaaagccagaagactcagcaagccagcttatcccaccttcttccacccactttgttctagctgcgctggcagccaattgcatggtgcccacccacactgagggtggctcttcctctcccaggccaccgactcaaatgttaatttcctctggcaacaacctcacagacctactcagaaacaatactttaccagctatctaggcatccttcaatcaagttgacaactaatattaaccgtcacagtatcatcttatcctgaaggagggctgattagagctaggctcaagctgc

SEQ ID NO: 109399 - DNA, 601 bp, Human
ggaggcggaggttgcagtgagccaagatggtgccactgcactctagcctggtgacagagcgagactctgtgaccccgtctcaaaaaaaaaaaaaaaaaaaagcaaaagaaagaaaggaagggagggaggggagggagggagggagtttattaaggagaattgactcacaggatcacaaggtgaagtcgcacaataggccatcagcaggctcagccaggaatggctcagtctgggtccaaaagcctcaaaagtagggaagccaacagtgtagtcttcagtctgtggccaaagggcgcctgasagctcctggcaagccattggtgtaagtccaagggtccaaaggctgaagaacctggagtctgatgtccaagggcaggaggaatggaaggaagcatccagcacaggagaaagatgaaagccagaagactcagcaagccagcttatcccaccttcttccacccactttgttctagctgcgctggcagccaattgcatggtgcccacccacactgagggtggctcttcctctcccaggccaccgactcaaatgttaatttcctctggcaacaacctcacagacctactcagaaacaatacttta

SEQ ID NO: 109400 - DNA, 601 bp, Human
gtgagcatgtttgagcccactctcccaaaatcttatccacaagctgctgatcaccagattctagtattttccatctattgggagaatgcctttccctgacgccagttgagacgaatgattattttagatagtttaacaacttgcctgaccatcacctgatagtcgcttgacattcctgggcggggtgggggaggttttctcctgccctgcccaagtctgcctagctacctattctaagggaatgtagacaggaagtaataaagacaccaatacgccaaactccctcatgttaagtttaccytaagtcttgatgtgttcccagtaaccctaaggcactgtctcaaacttaagatagatatttgtttttcttttttctctacttgtctgaaagttatttgcagcttctatatctttggctcaactttcatttagtagcataaccttaggcaaatcttccttggatctaagtttactctgcaaaatactaatgttggtagaaggagacaatgctgttgttgccttccagccagaaacctccagaaacacacctatagttgaacaagttgggtttaatgttctttggaagaagggagattgcaca

SEQ ID NO: 109401 - DNA, 601 bp, Human
ccagtcttgttcctagaggaagctcatataccagttaaactctaccattttgcctcttagtgagcatgtttgagcccactctcccaaaatcttatccacaagctgctgatcaccagattctagtattttccatctattgggagaatgcctttccctgacgccagttgagacgaatgattattttagatagtttaacaacttgcctgaccatcacctgatagtcgcttgacattcctgggcggggtgggggaggttttctcctgccctgcccaagtctgcctagctacctattctaagggartgtagacaggaagtaataaagacaccaatacgccaaactccctcatgttaagtttaccctaagtcttgatgtgttcccagtaaccctaaggcactgtctcaaacttaagatagatatttgtttttcttttttctctacttgtctgaaagttatttgcagcttctatatctttggctcaactttcatttagtagcataaccttaggcaaatcttccttggatctaagtttactctgcaaaatactaatgttggtagaaggagacaatgctgttgttgccttccagccagaaacctccagaa

SEQ ID NO: 109402 - DNA, 601 bp, Human
agtatatgaatctgaatgagtgagataagtgaatttgctgatcttgagtagtttggaacgttatgtgtgtgctcactgttaatctaattgctttggaaatacttcaatttttgttaattagaacgcaaatgttgaatgtggttttattcttaaaacaaatactaactcttcagaaagttcaagttgccaagcaagaacatcagatgaatgaaattgttcgcagtggcaaatccgtactggcctgcagcaactcacttcttgcctcctcaaaggaatgaagcataaggcagagtgagagacygaggcaagtttttgagcaggagtgagagtttattaagaagtattagagcaggaataaaagtaagtaaagtacacttggaagagggccaagtgggcaacttgagagattcagctgtgccacctgacccttgatttggggattgatacattggtacggttctaggccttgcattacttcttccgatttttcccttggggtgggctgtcggcatgctcagtggcctgccggcacttgggaggggcggcatgtgcagtgtgtttactgaagttgtgcacatactcactagagacattcctccct

SEQ ID NO: 109403 - DNA, 601 bp, Human
catgtttaagcaggtatgtattcttgtaattttaatatgtatattaaaattgtgataatttttgtctagatgtggagtctttcatgagatgtaaagttattgttctacttttagacatttaactctcagtatttttataaatgcaatattatcatttccttacttattttcctatgcttaaacacagtttctcctgctttcctataacactaaaaattgacggtggcttaagcagcagtggctttagaagtttcagtaatggaaactggggaaagctgacgaagtcagtagggcctaggayaacttttaaaaatgagtatatgaatctgaatgagtgagataagtgaatttgctgatcttgagtagtttggaacgttatgtgtgtgctcactgttaatctaattgctttggaaatacttcaatttttgttaattagaacgcaaatgttgaatgtggttttattcttaaaacaaatactaactcttcagaaagttcaagttgccaagcaagaacatcagatgaatgaaattgttcgcagtggcaaatccgtactggcctgcagcaactcacttcttgcctcctcaaaggaatgaagcataag

SEQ ID NO: 109404 - DNA, 601 bp, Human
ttgtgtgaacatcatagatttcacttacacaaacctcaatggtagagcctactacacacctaggctatatggtacagcctattgctcctaggctacaaacctgtatagcattttactctactgaacactgtaggcagttgtagcaagtagtaagcatttgtgcatctaaacataggaaagatagtgcatgactatacactggcagagaaagataaagcaaatatggccaaatattaccaactggggaatccaaatgaagaatatacagttgttcattattctttttcttttttttttttttgagacagtcttgctttgttgcccaggctggagtgcagtggcatgatctccacttactgcaacctccacctcccaggttcaagtgattttcctgcctcagcctcccgattatctgggattacaggtgcttgccatcctgcccggctaatttttgtatttttagtagagacaggtttcgccatgttggccaggctggtctcaaactcctgacctcaggtgatctgcccacctcggcctcgcaaagtgctggcattagaggcgtgagccactgcacctggcccattattctttttctaagagg

SEQ ID NO: 109405 - DNA, 601 bp, Human
attaggcgatttcgtcattgtgtgaacatcatagatttcacttacacaaacctcaatggtagagcctactacacacctaggctatatggtacagcctattgctcctaggctacaaacctgtatagcattttactctactgaacactgtaggcagttgtagcaagtagtaagcatttgtgcatctaaacataggaaagatagtgcatgactatacactggcagagaaagataaagcaaatatggccaaatattaccaactggggaatccaaatgaagaatatacagttgttcattattcttyttcttttttttttttttgagacagtcttgctttgttgcccaggctggagtgcagtggcatgatctccacttactgcaacctccacctcccaggttcaagtgattttcctgcctcagcctcccgattatctgggattacaggtgcttgccatcctgcccggctaatttttgtatttttagtagagacaggtttcgccatgttggccaggctggtctcaaactcctgacctcaggtgatctgcccacctcggcctcgcaaagtgctggcattagaggcgtgagccactgcacctggcccatt

SEQ ID NO: 109406 - DNA, 601 bp, Human
ccgggcgccgtggctcacgcctgtaatcccagcactttgggaggccgaggtgggcggatcacgaggtcaggagatcgagaccatcctggctaacacggtgaaacctcatctctactaaaaatacagaaaaattagctgggcgtggtggcgggcgcctgtagtcccagctgctggggaggctgaggcaggagaatggtgtgaacctgggaggcggagcttgcagtgagccgagatcgtgccactgcactccagcctgggtgacagagcaagactccgtctcaaaaaaaaaaaaaaaaaaaaatgctcatgtatagagtgttcatttttgtacacagttttctattcagtttgcctctacatatttaagaaaggttaagtatcacaacttcccactgcagatcaccatcagtaggtctttatagatgtactgtgttttctctaattggaaatgtcactaatgagtggattctaacaccattcagtgaaaggtttacatatattaaaacacgtaaatatatgagagaatattgacatagtctccaagtctcatgaagaggaaagggtacctttacaatggataaatcttgcgggtattacttca

SEQ ID NO: 109407 - DNA, 601 bp, Human
tgctatccacctgttcttccatcaaaccatcttatctttttaatgcagaccttagtactctacacccatgaacacatcagcacacattattcatttacagttctttttaaggcaaaatatccacgcaatcaaatgtacaaatcttagacaagcttcacaaatgctcatgtataggccgggcgccgtggctcacgcctgtaatcccagcactttgggaggccgaggtgggcggatcacgaggtcaggagatcgagaccatcctggctaacacggtgaaacctcatctctactaaaaatacaraaaaattagctgggcgtggtggcgggcgcctgtagtcccagctgctggggaggctgaggcaggagaatggtgtgaacctgggaggcggagcttgcagtgagccgagatcgtgccactgcactccagcctgggtgacagagcaagactccgtctcaaaaaaaaaaaaaaaaaaaaatgctcatgtatagagtgttcatttttgtacacagttttctattcagtttgcctctacatatttaagaaaggttaagtatcacaacttcccactgcagatcaccatcagtaggtctttatagatgt

SEQ ID NO: 109408 - DNA, 601 bp, Human; identical to SEQ ID NO: 60472

SEQ ID NO: 109409 - DNA, 601 bp, Human; identical to SEQ ID NO: 60473

SEQ ID NO: 109410 - DNA, 601 bp, Human; identical to SEQ ID NO: 60474

SEQ ID NO: 109411 - DNA, 601 bp, Human; identical to SEQ ID NO: 60475

SEQ ID NO: 109412 - DNA, 601 bp, Human; identical to SEQ ID NO: 60476

SEQ ID NO: 109413 - DNA, 601 bp, Human; identical to SEQ ID NO: 60477

SEQ ID NO: 109414 - DNA, 601 bp, Human; identical to SEQ ID NO: 60478

SEQ ID NO: 109415 - DNA, 601 bp, Human; identical to SEQ ID NO: 60479

SEQ ID NO: 109416 - DNA, 601 bp, Human; identical to SEQ ID NO: 60480

SEQ ID NO: 109417 - DNA, 601 bp, Human; identical to SEQ ID NO: 60481

SEQ ID NO: 109418 - DNA, 601 bp, Human; identical to SEQ ID NO: 60482

SEQ ID NO: 109419 - DNA, 601 bp, Human; identical to SEQ ID NO: 60483

SEQ ID NO: 109420 - DNA, 601 bp, Human; identical to SEQ ID NO: 60484

SEQ ID NO: 109421 - DNA, 601 bp, Human
aaagtttttcagcgcagacatgatgccacaagtggaaaattccacacctgacctcatgtgatgggttgcacaaaattatttaaaatattgcataaaattaccttccagctatgtgtataaggtgtatatgaaaaataaataaatttcctgtttacacttgggtcccaccccccagatctcttgtatatatgcaaatattaaaaaaaaaaaaatccgaaatgcttcccagtcccaagcatttcagataagggttactcaatttgtaaatgaactgtaggtgcctaacaaatctctgttcaaygtgtgaaggaataaataaaagggtagatgcgccagtcatatagccagccgcagctcacctagcctgaccaagtgagagatgctgctatcctgacgccactactgtaaggattaatcaaggacagcatgtaaaacttcaacgccgtgcgcggctctctctttccttccccttctctctttccagtgaaggggacggctccttccccttctctctttccaatgcagatccttcaaatcctaaaatgtcgaggcagccgcgtgctgtgggaccacgtcctcgccctctacacccgcattttgc

SEQ ID NO: 109422 - DNA, 601 bp, Human
ccacatcagggctttcccatttactgttccttctaccagacagccaaatggcaactgtcctcatctacctcagttttgtactcagatgtcactttttcaatgaattctttcccaactttgctttattaaaagtgcaagcccccacctccagtttttatcctacaccctactatatttttctccgttgcacatatcaccatttgatatgttatgttttacttgttaatttctttataatctgcttctcctactggagagtaggttccaaaagaacaaagaatttagtctgtttagttccctmctgtatcctcagcacctagtaggtgctcaataactgtgttaaatgaatataggttgagcatcctaatctgaaaatgggaaacccaaaatctgaaagtttttcagcgcagacatgatgccacaagtggaaaattccacacctgacctcatgtgatgggttgcacaaaattatttaaaatattgcataaaattaccttccagctatgtgtataaggtgtatatgaaaaataaataaatttcctgtttacacttgggtcccaccccccagatctcttgtatatatgcaaatattaaaaaaaaa

SEQ ID NO: 109423 - DNA, 601 bp, Human
caataacttctgtacctgcccctcccttccaaactaaactcctaacttcttccccttgcttactcatttccagccacgctgatctgaatgctgtcccttgaacacaccagacatacttccacatcagggctttcccatttactgttccttctaccagacagccaaatggcaactgtcctcatctacctcagttttgtactcagatgtcactttttcaatgaattctttcccaactttgctttattaaaagtgcaagcccccacctccagtttttatcctacaccctactatatttttctcygttgcacatatcaccatttgatatgttatgttttacttgttaatttctttataatctgcttctcctactggagagtaggttccaaaagaacaaagaatttagtctgtttagttccctactgtatcctcagcacctagtaggtgctcaataactgtgttaaatgaatataggttgagcatcctaatctgaaaatgggaaacccaaaatctgaaagtttttcagcgcagacatgatgccacaagtggaaaattccacacctgacctcatgtgatgggttgcacaaaattatttaaaatattg

SEQ ID NO: 109424 - DNA, 601 bp, Human
tcccctgtaactgactgtgagctctgggaaaacacaaagctcctaccctgtgtcctcttttgaccccactgtagtagccccagggcctgttggagaaccttgcaagtgtttgtatttgctgactctaattactctgaatatttttctgtaacccatcccaataaagatctcactatcacgactctcccaaaactgcttttgtcaagattaatcatctttatattgctaaatccaataatcagttgtcagcctttatcttccttgacccattaacatttgatacagttgatcatgacctatyaacatttgatgcagttgatcatgcccttcttcctgaaacattttcttcacttggcttcaaggacactgcgctttcctgacccctccacttcaccggctatttggttacagcctcctttgctagtttctcctcatttcctccacctccaaatggaatggagtgcctcagggcttagtcctctgtgtacgctcatttcctaggtggtctcacctagcctttaactactagctgtatgccgaagactccctacttaaatctccaacccgtatctctgtcctagactccacactccaaatgcct

SEQ ID NO: 109425 - DNA, 601 bp, Human
cccattttgaacttacttattccatttgcaacctgtgagaaagcttaagcaccaattttagaacaagaaaaggctactgcctagagaattgtctattccttttatttctctgaaaacaacgttctccacactgagctgtaattgtaggttacttaactgcctctgcctcccctgtaactgactgtgagctctgggaaaacacaaagctcctaccctgtgtcctcttttgaccccactgtagtagccccagggcctgttggagaaccttgcaagtgtttgtatttgctgactctaattactytgaatatttttctgtaacccatcccaataaagatctcactatcacgactctcccaaaactgcttttgtcaagattaatcatctttatattgctaaatccaataatcagttgtcagcctttatcttccttgacccattaacatttgatacagttgatcatgacctatcaacatttgatgcagttgatcatgcccttcttcctgaaacattttcttcacttggcttcaaggacactgcgctttcctgacccctccacttcaccggctatttggttacagcctcctttgctagtttctcctca

SEQ ID NO: 109426 - DNA, 601 bp, Human
actcacctcctgctgtgtggcctagttcctaacaggtcacagacccagggagtttgggacccccgctctagggcacaaaatttaaggaggcactcattctcaggtttatgtaagtgttgaccctgaatttgagagtgagtgccccgttaaatttgcacttcaggagcctcttcatcttgtcctagccccagacttgtttcttctatttcagggaactagaactaggaacgggaagcaaactggctactgagtagaagtggactgagatcatttcccattttgaacttacttattccatttkcaacctgtgagaaagcttaagcaccaattttagaacaagaaaaggctactgcctagagaattgtctattccttttatttctctgaaaacaacgttctccacactgagctgtaattgtaggttacttaactgcctctgcctcccctgtaactgactgtgagctctgggaaaacacaaagctcctaccctgtgtcctcttttgaccccactgtagtagccccagggcctgttggagaaccttgcaagtgtttgtatttgctgactctaattactctgaatatttttctgtaacccatcccaa

SEQ ID NO: 109427 - DNA, 601 bp, Human
gttagttgcacaacattgcaaatacactaaatgccactgaattgtaccattttaaatggttaactttacatgaatttttacctcaattttaaaaaatagaagaaagaacattttttgcttagctcctgtttatcaaggaataacaagcttcaaaagtccatacaggagctgggtgtcgtggctcacgtctgtaatcccagcagtttgggaggccgaggtgggtggatcacaaggtcaggagctcgagaccagcctgggcaacatggtgaaaccccatctctactaaatatacaaaaattasccgggtgtggtggcacatgtctgtagtcccagctacttggggggctgaggcaggagaatcgcttgaacctgaaaggtggaggtttcagtgagccaagatcatgccactgcactccagcctgggcaacagaacaaggctccatctcaaaaaaaaaaaaaaaaaaaaatccatataggccaagcatgggctcatacctatcatcccagcgctttggtaagacgaggcaggaggattgcttgaggccaagagttcgagaccagtttgggcaacataacgagaccctgtctcaaaaaaaccaaa

SEQ ID NO: 109428 - DNA, 601 bp, Human
taaaaccccatctctactaaaaatacaaaaaattagctaggtgtggtggtgagcacctatagtcccagctactcgggaggctgaggcaggagaatcacttgaacctgggacgtggaggttgcagtgagctgagatcgcgccactgcactccagcctgggcaacaagagagaaattctgtctcaaaaaaaaaaaaaaaagaaaagaaattaagttccataaagcttcttacacaggaacattttaggaaatttcccttccaagataggtgacaatcttgaattggaggagtggatttatctraataaaagaaacaaaaatcaattccatataagtggtacaatataacaaaaaggaacgtacagaaattggcctccctgggagaatcccatagcattgtagccttgctgcaatttaggatccttagcaagtgcctgacacactgttgttacttgggaattgacattcaagaagaagctgttctccacgtcctaaaaaagaagccagagagaagtgagaggatgggactgaaaacaaccactgacatcttctctaagaggtaaactcatttaggttggtatcctcacatgagccactcaaggg

SEQ ID NO: 109429 - DNA, 601 bp, Human
aaataaattaagctccagccaggcatggtggctcacacctgtaatctcagcactttgggaggctgaggtgggtggactacctgaggtcaggagttcgagaccagcctagacaacatggtaaaaccccatctctactaaaaatacaaaaaattagctaggtgtggtggtgagcacctatagtcccagctactcgggaggctgaggcaggagaatcacttgaacctgggacgtggaggttgcagtgagctgagatcgcgccactgcactccagcctgggcaacaagagagaaattctgtctcaaaaaaaaaaaaaaaagaaaagaaattaagttccataaagcttcttacacaggaacattttaggaaatttcccttccaagataggtgacaatcttgaattggaggagtggatttatctaaataaaagaaacaaaaatcaattccatataagtggtacaatataacaaaaaggaacgtacagaaattggcctccctgggagaatcccatagcattgtagccttgctgcaatttaggatccttagcaagtgcctgacacactgttgttacttgggaattgacattcaagaagaagctgttctc

SEQ ID NO: 109430 - DNA, 601 bp, Human
ccatgtgcccagctatcctccattttatcgtgtatatatatatatgtgtgtgtgtatatatgtgtatataagtgcatatgtgtgtatatatatgtctatatatgtctatgtatgtgtgtatataggtgcatatgtgtatatatatatgtctatgtatgtatgtgcatatatgtgcacatgtgtgtgtgtatatatatatatttcatgaatgcaagaaccttgtctgtcttgttcctggcatataataggttttcaataaatatttgttaaatgaatgaataataaagctgtttttaccaayttgcgtttgtataatccttatacttttaaaaagtattttcctacctattatttcactttatcctctgaaaaattcccataggacaggcagggccatattttggtttcttccatctgtgagtggaacctaagataccaaattacttgcctaggagtaatagttaattgggtgagtccaggtttcctgattacacggagaatcattctgctcccacattataccagctaatagctatacccatcacaacagagatgaaattccattctaatgacacatccttccccaatagtatggaattcc

SEQ ID NO: 109431 - DNA, 601 bp, Human
atgttgcctagactaaagtgcaatggctattcacaggcacaattacagcacaccacagtgtcttgaactcctggcttcaaatgatcctccagcctcagcctcccaagtagcagggactacaggtgtacaccaccatgtgcccagctatcctccattttatcgtgtatatatatatatgtgtgtgtgtatatatgtgtatataagtgcatatgtgtgtatatatatgtctatatatgtctatgtatgtgtgtatataggtgcatatgtgtatatatatatgtctatgtatgtatgtgcatayatgtgcacatgtgtgtgtgtatatatatatatttcatgaatgcaagaaccttgtctgtcttgttcctggcatataataggttttcaataaatatttgttaaatgaatgaataataaagctgtttttaccaacttgcgtttgtataatccttatacttttaaaaagtattttcctacctattatttcactttatcctctgaaaaattcccataggacaggcagggccatattttggtttcttccatctgtgagtggaacctaagataccaaattacttgcctaggagtaatagttaattgg

SEQ ID NO: 109432 - DNA, 601 bp, Human
ggataagccaggattcagacacaggcagtttggccccagagcccactcctttaagcactacaaccactagtgtgtccttcaaacagtatcctgttgtttttttccaagagattgggtcttgctatgttgcctagactaaagtgcaatggctattcacaggcacaattacagcacaccacagtgtcttgaactcctggcttcaaatgatcctccagcctcagcctcccaagtagcagggactacaggtgtacaccaccatgtgcccagctatcctccattttatcgtgtatatatatatatrtgtgtgtgtatatatgtgtatataagtgcatatgtgtgtatatatatgtctatatatgtctatgtatgtgtgtatataggtgcatatgtgtatatatatatgtctatgtatgtatgtgcatatatgtgcacatgtgtgtgtgtatatatatatatttcatgaatgcaagaaccttgtctgtcttgttcctggcatataataggttttcaataaatatttgttaaatgaatgaataataaagctgtttttaccaacttgcgtttgtataatccttatacttttaaaaagtattttcctacc

SEQ ID NO: 109433 - DNA, 601 bp, Human
agggataagccaggattcagacacaggcagtttggccccagagcccactcctttaagcactacaaccactagtgtgtccttcaaacagtatcctgttgtttttttccaagagattgggtcttgctatgttgcctagactaaagtgcaatggctattcacaggcacaattacagcacaccacagtgtcttgaactcctggcttcaaatgatcctccagcctcagcctcccaagtagcagggactacaggtgtacaccaccatgtgcccagctatcctccattttatcgtgtatatatatatrtgtgtgtgtgtatatatgtgtatataagtgcatatgtgtgtatatatatgtctatatatgtctatgtatgtgtgtatataggtgcatatgtgtatatatatatgtctatgtatgtatgtgcatatatgtgcacatgtgtgtgtgtatatatatatatttcatgaatgcaagaaccttgtctgtcttgttcctggcatataataggttttcaataaatatttgttaaatgaatgaataataaagctgtttttaccaacttgcgtttgtataatccttatacttttaaaaagtattttccta

SEQ ID NO: 109434 - DNA, 601 bp, Human
acatggctggacgcattttcagctctcaggtcttggtcctacacaagtcacatctgaccaccttatctcaaatagtacccacccccatttccttcccctcccccagttatacttcatccttagcatcctcatcaataacattgttttgagtaacacaaatagttctaagcaaaatattggcaataattaatttaatcctcacaaccaccctgtggagtagatttcattatttgccctatatcacagatagaaaactgtaaaaatgaggttaaataccttgtccaaggttagacaataaggkataagccaggattcagacacaggcagtttggccccagagcccactcctttaagcactacaaccactagtgtgtccttcaaacagtatcctgttgtttttttccaagagattgggtcttgctatgttgcctagactaaagtgcaatggctattcacaggcacaattacagcacaccacagtgtcttgaactcctggcttcaaatgatcctccagcctcagcctcccaagtagcagggactacaggtgtacaccaccatgtgcccagctatcctccattttatcgtgtatatatatatatgt

SEQ ID NO: 109435 - DNA, 601 bp, Human
gcctccggagtggctgagactacaggtgtgcaccaccacgcctgcctaatttttgtatttttagtagagatggggttttgccatgttggccaggctggtcttgaactccaggcctcaagtgatctgcctaccaaggcctcccaaagtgctgggataacaggcatgagccactgcgccccgccttaatcagtatttaggtgtcacttgtcaccccccgacggactgctcacttagcatcactaacagaattctgatcgccaagggttgttttggttcacacaaagaaagaaaagtataggckttttggaggcaactgggcaagagtgagaataaagagtaaaggaagaagaatgaagtttaaataccatgcaaatccatgagaacagagaatatgtagaatataaataattaagttgtaattagccacagccaatcaaaccaggcaaaggggaaagcttggtgtagcctgagggtaaaaaaaaggagctagaggtacagagtatcttagttttctataataaccatcaggtggtactgctgacccaaaacagctttgtggctatttgtgtagccaacgagtgggaaaagaaaagacagctat

SEQ ID NO: 109436 - DNA, 601 bp, Human
tctgctaaaacagttctcacactcattcatctgcttgcttgctttcaaaaacatgttgccattttttatgatctcttacctcctctctccctgttctctctgcccttgtgggtttatcactttttattcttctgctaccacttaattaaagtttaaggaggaagtgaagataaacacatcaatctatagcttttaatcagtattttttatttttattttttgagacagagtctcactctgtcatctaggttggggtgcagtggtgcgatctcagctcactgcaacctccgccttctgggtrcaagcaattctctagcctcagcctccggagtggctgagactacaggtgtgcaccaccacgcctgcctaatttttgtatttttagtagagatggggttttgccatgttggccaggctggtcttgaactccaggcctcaagtgatctgcctaccaaggcctcccaaagtgctgggataacaggcatgagccactgcgccccgccttaatcagtatttaggtgtcacttgtcaccccccgacggactgctcacttagcatcactaacagaattctgatcgccaagggttgttttggttcacac

SEQ ID NO: 109437 - DNA, 601 bp, Human
ctttaagccttcaccatctgctctgctaaaacagttctcacactcattcatctgcttgcttgctttcaaaaacatgttgccattttttatgatctcttacctcctctctccctgttctctctgcccttgtgggtttatcactttttattcttctgctaccacttaattaaagtttaaggaggaagtgaagataaacacatcaatctatagcttttaatcagtattttttatttttattttttgagacagagtctcactctgtcatctaggttggggtgcagtggtgcgatctcagctcacygcaacctccgccttctgggtgcaagcaattctctagcctcagcctccggagtggctgagactacaggtgtgcaccaccacgcctgcctaatttttgtatttttagtagagatggggttttgccatgttggccaggctggtcttgaactccaggcctcaagtgatctgcctaccaaggcctcccaaagtgctgggataacaggcatgagccactgcgccccgccttaatcagtatttaggtgtcacttgtcaccccccgacggactgctcacttagcatcactaacagaattctgatcgcc

SEQ ID NO: 109438 - DNA, 601 bp, Human
ggattgcttgagcctgggaggttgaggctatgttgcagtaagccgtaatggcaccactgcactccaacttgggtgacagagtgagactctgtctcaaaaacaaacaaacaaaaattcatgattcacgggaagaggtcaaaatatcagtattatcaggaatttaaaagaagttgattccaaccctcatgaatggctgagggattcaagacttcaatgaaggaagtaactgcagatgtggaaatagcaggagaactagaattagaagtggaacctgacgatgtgactgaattgttgcaatctmaaaaaacagataaggaattgcttcttacggatgagcaaaacagtggcttcttgagatggaatctactcctggtgaagatgctgtgaacactgatgaaacgacaacaaaggatttagaataaatattacataagcttacataaaagcagcggcagggtttgaggattgactccagttctgaaagatgttctattgtggccaaaatgctaccaaatagcatcgcatgctacaaagaaatctttcatgaaaggaagagtcaactgatacaaagttcatcattgtctcactttaagaaattagc

SEQ ID NO: 109439 - DNA, 601 bp, Human
gggctgggtaccatgcactttgggagggtgaggagggaaaatcagtggagcccaggagtgtgagactagcctgggcaacataaatgagatcctatctctacaaaaaaagtaaaaaattagtggggtgtagtggctcacacctgtagtcccagctgctcaggacgctgaggtgggaggattgcttgagcctgggaggttgaggctatgttgcagtaagccgtaatggcaccactgcactccaacttgggtgacagagtgagactctgtctcaaaaacaaacaaacaaaaattcatgattcaygggaagaggtcaaaatatcagtattatcaggaatttaaaagaagttgattccaaccctcatgaatggctgagggattcaagacttcaatgaaggaagtaactgcagatgtggaaatagcaggagaactagaattagaagtggaacctgacgatgtgactgaattgttgcaatctcaaaaaacagataaggaattgcttcttacggatgagcaaaacagtggcttcttgagatggaatctactcctggtgaagatgctgtgaacactgatgaaacgacaacaaaggatttagaataaatat

SEQ ID NO: 109440 - DNA, 601 bp, Human
cctgccacagcacatccattctacagcccatggatcaagtagtaatttcaattttcaagtcttattatttaagaaatacatttacaaggttgtagctgcatagacagtgatccctttgatgcatctgggcaaagtaaacggaaaacctgatggaaaggatttatcattctagatgccattaagaacattaacgggctgggtaccatgcactttgggagggtgaggagggaaaatcagtggagcccaggagtgtgagactagcctgggcaacataaatgagatcctatctctacaaaaaaaktaaaaaattagtggggtgtagtggctcacacctgtagtcccagctgctcaggacgctgaggtgggaggattgcttgagcctgggaggttgaggctatgttgcagtaagccgtaatggcaccactgcactccaacttgggtgacagagtgagactctgtctcaaaaacaaacaaacaaaaattcatgattcacgggaagaggtcaaaatatcagtattatcaggaatttaaaagaagttgattccaaccctcatgaatggctgagggattcaagacttcaatgaaggaagtaactgcagat

SEQ ID NO: 109441 - DNA, 601 bp, Human
agattcctttcaaaacattaccacgcagctgggcatggtggctcatacctacaatgccagcactttgggaggccaaggtaggaggaccatttgaggccaggagttcaagactagcttgggcaacatagcaagaccccacctctagaaaagaaaattctttttaaaagtagccgagcatggcggtgcatgcctgtagtcctagctactcaggaggctgaagtgggaggatggcttgagtccaggaggtgaaggctgcagtgagctgtgatcacaccactgcactctagtctgggcaagagarcacaaccctgtctcaaaaactattttttttaattaaaaaaagtttaaaaacaaactcaaaaaacaaacaaatattacagctcattaaaaagcacctggtcacccaagcgctctgatggagatgtacaaagagattaatgttgtcttcatgcctgccacagcacatccattctacagcccatggatcaagtagtaatttcaattttcaagtcttattatttaagaaatacatttacaaggttgtagctgcatagacagtgatccctttgatgcatctgggcaaagtaaacggaaaacctga

SEQ ID NO: 109442 - DNA, 601 bp, Human
ctcttgtgagtgcctcatggagctgatgacttgaagctgaagccaatgctgggttaccattttttaaatcctagggcccttaagaactacgctaaattactctgcctgtgctctacaaatggaacacaaagcctggatgacagcagatctgtttacagtgtggtttgctgactattttaagcccactgttgagacctattgctcagaaaaaaagattcctttcaaaacattaccacgcagctgggcatggtggctcatacctacaatgccagcactttgggaggccaaggtaggaggaccrtttgaggccaggagttcaagactagcttgggcaacatagcaagaccccacctctagaaaagaaaattctttttaaaagtagccgagcatggcggtgcatgcctgtagtcctagctactcaggaggctgaagtgggaggatggcttgagtccaggaggtgaaggctgcagtgagctgtgatcacaccactgcactctagtctgggcaagagagcacaaccctgtctcaaaaactattttttttaattaaaaaaagtttaaaaacaaactcaaaaaacaaacaaatattacagctcattaaa

SEQ ID NO: 109443 - DNA, 601 bp, Human
ttctagaatgtgtttatacatgtatttgaaaccttttaaaggtttagaactctgaacatttatagaatgcaaaaaaaaaaaaagttcctgaggaaaattagaagtgctatttcagtgaacacacaaataataaggaagcaaaacagtcttattgctgctatggagaaaatctgagtggtctagatagaagaccaaaccagccacaacattcccttaagccaaagcctaattcagagcaacgtcctaactctcttcaattcaatgaaggctgagagaggtgaggaagctgcagaaaaaaagygtgaagctagcagaggttggtttgtaaggttcaaggaaagaaaccatctccataacacaggagtgcaagatggggcagcaagtgctgatgtagaagctgcagtaagttatccaggagatctagctaagatacttaatgaaggtggcgaccataaacaacaaattttcagtgtaggtgaaacagtcttaaattggaagaagatgccatctaggactttcacagctatagaggagaagtcaatgcctggcttcaaaacttcaaaggacaggctgactctcttgtgagtgcctcatggagctg

SEQ ID NO: 109444 - DNA, 601 bp, Human
tcagagatggagctctccctcccaggagcagatgagactgaagttaaaggaagcaacagtcagagtgacattctagaatgtgtttatacatgtatttgaaaccttttaaaggtttagaactctgaacatttatagaatgcaaaaaaaaaaaaagttcctgaggaaaattagaagtgctatttcagtgaacacacaaataataaggaagcaaaacagtcttattgctgctatggagaaaatctgagtggtctagatagaagaccaaaccagccacaacattcccttaagccaaagcctaatycagagcaacgtcctaactctcttcaattcaatgaaggctgagagaggtgaggaagctgcagaaaaaaagcgtgaagctagcagaggttggtttgtaaggttcaaggaaagaaaccatctccataacacaggagtgcaagatggggcagcaagtgctgatgtagaagctgcagtaagttatccaggagatctagctaagatacttaatgaaggtggcgaccataaacaacaaattttcagtgtaggtgaaacagtcttaaattggaagaagatgccatctaggactttcacagctatagag

SEQ ID NO: 109445 - DNA, 601 bp, Human
agaaatcaaaatttctacaacatacgctccgtagccagagtggaagagctgcccagaggcagtggtcctgaaaacgccactcagtggagcaggctggcgctaaagcccaacagagccagttacgtcagagatggagctctccctcccaggagcagatgagactgaagttaaaggaagcaacagtcagagtgacattctagaatgtgtttatacatgtatttgaaaccttttaaaggtttagaactctgaacatttatagaatgcaaaaaaaaaaaaagttcctgaggaaaattagaagtgytatttcagtgaacacacaaataataaggaagcaaaacagtcttattgctgctatggagaaaatctgagtggtctagatagaagaccaaaccagccacaacattcccttaagccaaagcctaattcagagcaacgtcctaactctcttcaattcaatgaaggctgagagaggtgaggaagctgcagaaaaaaagcgtgaagctagcagaggttggtttgtaaggttcaaggaaagaaaccatctccataacacaggagtgcaagatggggcagcaagtgctgatgtagaagctgcagtaag

SEQ ID NO: 109446 - DNA, 601 bp, Human
aaattcgaacaaactctatcccaggttggcagggagagaaatcaaaatttctacaacatacgctccgtagccagagtggaagagctgcccagaggcagtggtcctgaaaacgccactcagtggagcaggctggcgctaaagcccaacagagccagttacgtcagagatggagctctccctcccaggagcagatgagactgaagttaaaggaagcaacagtcagagtgacattctagaatgtgtttatacatgtatttgaaaccttttaaaggtttagaactctgaacatttatagaatgcaaaaaaaaaaaaagttcctgaggaaaattagaagtgctatttcagtgaacacacaaataataaggaagcaaaacagtcttattgctgctatggagaaaatctgagtggtctagatagaagaccaaaccagccacaacattcccttaagccaaagcctaattcagagcaacgtcctaactctcttcaattcaatgaaggctgagagaggtgaggaagctgcagaaaaaaagcgtgaagctagcagaggttggtttgtaaggttcaaggaaagaaaccatctccataacacaggagtgcaaga

SEQ ID NO: 109447 - DNA, 601 bp, Human
agcccccacctcctcaaaatgggcacggttaccccaaggcctcacatggggaaattcgaacaaactctatcccaggttggcagggagagaaatcaaaatttctacaacatacgctccgtagccagagtggaagagctgcccagaggcagtggtcctgaaaacgccactcagtggagcaggctggcgctaaagcccaacagagccagttacgtcagagatggagctctccctcccaggagcagatgagactgaagttaaaggaagcaacagtcagagtgacattctagaatgtgtttatacrtgtatttgaaaccttttaaaggtttagaactctgaacatttatagaatgcaaaaaaaaaaaaagttcctgaggaaaattagaagtgctatttcagtgaacacacaaataataaggaagcaaaacagtcttattgctgctatggagaaaatctgagtggtctagatagaagaccaaaccagccacaacattcccttaagccaaagcctaattcagagcaacgtcctaactctcttcaattcaatgaaggctgagagaggtgaggaagctgcagaaaaaaagcgtgaagctagcagaggttg

SEQ ID NO: 109448 - DNA, 601 bp, Human
gtctcagatggagatgaggaacttgctgggaactggagcaaaggggactctttatactttctttccaatctctctccacttcctcttcccttccagcccccacctcctcaaaatgggcacggttaccccaaggcctcacatggggaaattcgaacaaactctatcccaggttggcagggagagaaatcaaaatttctacaacatacgctccgtagccagagtggaagagctgcccagaggcagtggtcctgaaaacgccactcagtggagcaggctggcgctaaagcccaacagagccagytacgtcagagatggagctctccctcccaggagcagatgagactgaagttaaaggaagcaacagtcagagtgacattctagaatgtgtttatacatgtatttgaaaccttttaaaggtttagaactctgaacatttatagaatgcaaaaaaaaaaaaagttcctgaggaaaattagaagtgctatttcagtgaacacacaaataataaggaagcaaaacagtcttattgctgctatggagaaaatctgagtggtctagatagaagaccaaaccagccacaacattcccttaagccaaagcc

SEQ ID NO: 109449 - DNA, 601 bp, Human
tgatagtgatatagacaataaggtccaggctgaggtagtctcagatggagatgaggaacttgctgggaactggagcaaaggggactctttatactttctttccaatctctctccacttcctcttcccttccagcccccacctcctcaaaatgggcacggttaccccaaggcctcacatggggaaattcgaacaaactctatcccaggttggcagggagagaaatcaaaatttctacaacatacgctccgtagccagagtggaagagctgcccagaggcagtggtcctgaaaacgccactcrgtggagcaggctggcgctaaagcccaacagagccagttacgtcagagatggagctctccctcccaggagcagatgagactgaagttaaaggaagcaacagtcagagtgacattctagaatgtgtttatacatgtatttgaaaccttttaaaggtttagaactctgaacatttatagaatgcaaaaaaaaaaaaagttcctgaggaaaattagaagtgctatttcagtgaacacacaaataataaggaagcaaaacagtcttattgctgctatggagaaaatctgagtggtctagatagaa

SEQ ID NO: 109450 - DNA, 601 bp, Human
aaaagcctgatagtgatatagacaataaggtccaggctgaggtagtctcagatggagatgaggaacttgctgggaactggagcaaaggggactctttatactttctttccaatctctctccacttcctcttcccttccagcccccacctcctcaaaatgggcacggttaccccaaggcctcacatggggaaattcgaacaaactctatcccaggttggcagggagagaaatcaaaatttctacaacatacgctccgtagccagagtggaagagctgcccagaggcagtggtcctgaaaacsccactcagtggagcaggctggcgctaaagcccaacagagccagttacgtcagagatggagctctccctcccaggagcagatgagactgaagttaaaggaagcaacagtcagagtgacattctagaatgtgtttatacatgtatttgaaaccttttaaaggtttagaactctgaacatttatagaatgcaaaaaaaaaaaaagttcctgaggaaaattagaagtgctatttcagtgaacacacaaataataaggaagcaaaacagtcttattgctgctatggagaaaatctgagtggtcta

SEQ ID NO: 109451 - DNA, 601 bp, Human
taccaaaccatgtttgtgtctgggacatactcagtgcctactgtatctctcttttaggtaaatctctagagaaaaatccacccccagactgatccatcaggaaagcttccctcattaagacagcagctgtgaatttccacctcgcccagtcagcaacctgccgagcttatcctgtgtgtttcaacactaggagagggaaagaacttaagggaagaaaggcaaatgaatttcaacctccctaaagggaactgaatctcaaaggccctgcctcccaaaaaaaacagaacttctctttcctagkgtctgcccaggacagtttgggtaaacagtcactgctgatttgtttatgaagacctaaacaggaaaaagaacgcacatctatgggagcccggtttgggtgcttacccgctcctgatttatatctgccaagaagatgctgtggttgcgatacacatcctcctttatggggtcatgccagtattcggcttgcacgaggctgtaggaaaaaaaaagaatgaggtgatcaagctacaggtcagtcagtacgcccagggcatgctcagtgcaaaggccaccaagagactttaaaaggacaaaaggc

SEQ ID NO: 109452 - DNA, 601 bp, Human
ttgggctagtgattctgaacattttttgggtctctgatctctggaaaatggattaaaattatagatccttccccagagaatgtaattacataattttgcatagaattttggggttgggggattgattacaatcttcagtgtcccatttatggacctcaggtgaagaactgttttatacaaaagttggtggaagggactgaaggttttttccccagcaggcagctgtattttttcatttcatttcaatttcattttatgttctttttgagacagagtctcgctctgtcacccaggctggggygcagtggcacgatcttggctcactgcaagctctgcctcctgggttcaagtaattctcctgcctcagcttcccaagcagctgggattacagatggctgtcaccatacccggctaatttctttttgtattttgagtagcgatggggtttcaccaagttggccaggctggtcttgaactcctgacctcaggtgatccacccgccttggcctcccagagtgctgggattacaggcatgagccaccgtgcccggccagcagccctattttaatgccatttactctcctggcatgtggcctaagta

SEQ ID NO: 109453 - DNA, 601 bp, Human
atagggtgcgtctgagtcatctcttcttaagggtggagcccgagggatgagttaatctttctgagaggccgctttccacttccccagaatttctgcttcctaaaattattaagcaataaatgtgaaaaattcctgtgctgagctctagacattcaaggatgaatacataatctgtttccaaagagctcccagtcttgcaaggcacggaaacaattcactcttgagtacagaggtcagcaaacgtttttgtaaaggccagatacaaaatattttaggctttaagggccatatggttgtaacyactcattgctgccactgtaacaaatgcagccacagacagtatgtaaaaagtaactaaaactgttccaataaggacactgaaatttaaattttacataatctttatatgtccaaatacttgatatgtctaaataaattttacataatctttatatgtccaattctttcccccaaccattaaaaaatgttaaaaacattcttttatgttagtgtttggtgttactcgtgggtagcaccaaaacgggtagcaggatggactgggcctgtgggccacaatcggccaatccctggtggtgtgaca

SEQ ID NO: 109454 - DNA, 601 bp, Human
aggaaagaagctcagatatgacacacagcacatactgccaaaataatttgagactggttagaagctaaaactgccaacaaagtgaacatcataaagctgtaggaagaaggaaaaatggatagggtgcgtctgagtcatctcttcttaagggtggagcccgagggatgagttaatctttctgagaggccgctttccacttccccagaatttctgcttcctaaaattattaagcaataaatgtgaaaaattcctgtgctgagctctagacattcaaggatgaatacataatctgtttccaaaragctcccagtcttgcaaggcacggaaacaattcactcttgagtacagaggtcagcaaacgtttttgtaaaggccagatacaaaatattttaggctttaagggccatatggttgtaactactcattgctgccactgtaacaaatgcagccacagacagtatgtaaaaagtaactaaaactgttccaataaggacactgaaatttaaattttacataatctttatatgtccaaatacttgatatgtctaaataaattttacataatctttatatgtccaattctttcccccaaccattaaaa

SEQ ID NO: 109455 - DNA, 601 bp, Human
aggtggctacacgctcgtatgcgggaacctgccttttgcttccttgggttgctaagaacaaaatcaagcatctgacatcagcatctgtttgacagtcccccaaatgccacctcctctcccgcctgacctgtccttgccttttttttttgagatggagtctcactctgtcacagactggagtgcagtggcacgatctccactaactgcaacttctgcctcccaggttcaagcgatactcctgcctcagtctcttgagtagctgggattacaggcacttgccaccacgtcctgctaatttttstatttttagtagagacggggtttcaccatgttggtcaggctggtcttgaactcctgacctcatgatctgcccacctcggcctctcaaagtgctgggattacaggtgtgagccattgcacccggccacgacctgtccttgtctaaatgtgctagttcccctgtccctctgtgcccttatggccggtgggaggagggagaaaggaactggcaagcttggattgcctggagatctccaacagccgagggacagggcccaacttctcacctgagagtcccacctgcaggatgagagcagaagac

SEQ ID NO: 109456 - DNA, 601 bp, Human
aggcacccagcagctccaggcctgtttcagcctccaccctgccctccttcagccgcaggagccctcagagtcagggccccaggaaccaggctgtcctcatgccttgagaagctccacccaaagggcttcagtgctgggaaatcacacgggtgcatatttattgaggggcttcttgtgcgacagtcttacagcctatttaacccaagctcctcaagcatctgaggcttgaactggcgataaggggtttggaagtgagcaccactcttgggaccgccttttccgcttctgtgacaaccaggtrttgctgagggaacgtttaaaaataaacacccttaaaaaataaacgccatcttcaaagagagtgtgctaatggcaaacagcaaagatatttttgaaccatttcaatcaaggtggctacacgctcgtatgcgggaacctgccttttgcttccttgggttgctaagaacaaaatcaagcatctgacatcagcatctgtttgacagtcccccaaatgccacctcctctcccgcctgacctgtccttgccttttttttttgagatggagtctcactctgtcacagactggagtgcagtggcacga

SEQ ID NO: 109457 - DNA, 601 bp, Human
gaccgagtcttgctctgtctcccaggctggagtgcagtggcgtgatctaggctcactgcaagctccacctcccgggttcacgtgcagggcggtttttaatgccttttttccttcatgcccaacccaatgatagtatttcctttacttgtctcttttattttctttctttctttctctttctttctttccttccttccttgctttctttcttccttctttctttccttccttccttccctccatctctctttcactctttctttcttttttcctttttttgctttttacttttcttgggacwtttccagattctcctgatgtggattttagaaactagtgagctccagaattcctcgcagcacccccacagtggcttgggccagaatgtaatgggctgcagtgctcatccccttcatgatacaaggaggctgctatttcactgagcttgtggtcccctaggatccctaacacattttccttacttccttggttagatggccattgatagaataatttgggacaaatctaggctaccaaaggagagtgttctgaaacagcgctcattcatgttgaactcccaactccacacccttgggacacg

SEQ ID NO: 109458 - DNA, 601 bp, Human
tcctgccctttctggggtcagagtgttataagccaggcaaacggcaccatgaggcagagcagtggttctgagcacctgcacttctctcagcaggacaaacccccacaccctcgggaagctggaggacctcaggcacagggggtggggaacttgtcttcctctcccctgccctgtcctcacctcctttttctctgtgacctcctctgaaatggtcagttttcctggttctgtctctgggcagtgtggatgggaaacctgccttttccctgccttcaagcagggattcattcaaaccatcccrgccaatgggccctggctgtctatgatggtctcttaggttcatcttagattatcattcactgtatctagcttcctccttccctgacgtgttagcagcccattcttagctccttattggaaatacacagagagccaccttttcggagctccaatgcttggtagcactgcagggcggttcttattttttggggggaccgagtcttgctctgtctcccaggctggagtgcagtggcgtgatctaggctcactgcaagctccacctcccgggttcacgtgcagggcggtttttaatgcctttttt

SEQ ID NO: 109459 - DNA, 601 bp, Human
caggctggtgcccatggattgccaacattctgagctctctgaaagcagctgtccagcccccggcccacctcttcccccttcaccacccagccccagcatgctcaggaaagggcccctcagttgccctccccacccctttcctgccctttctggggtcagagtgttataagccaggcaaacggcaccatgaggcagagcagtggttctgagcacctgcacttctctcagcaggacaaacccccacaccctcgggaagctggaggacctcaggcacagggggtggggaacttgtcttcctctyccctgccctgtcctcacctcctttttctctgtgacctcctctgaaatggtcagttttcctggttctgtctctgggcagtgtggatgggaaacctgccttttccctgccttcaagcagggattcattcaaaccatcccggccaatgggccctggctgtctatgatggtctcttaggttcatcttagattatcattcactgtatctagcttcctccttccctgacgtgttagcagcccattcttagctccttattggaaatacacagagagccaccttttcggagctccaatgcttggtagc

SEQ ID NO: 109460 - DNA, 601 bp, Human
tatgtcccctgcagtcgtgaggcagggaccgaagagaatgaggaaggggcattggattgccaggctggtgcccatggattgccaacattctgagctctctgaaagcagctgtccagcccccggcccacctcttcccccttcaccacccagccccagcatgctcaggaaagggcccctcagttgccctccccacccctttcctgccctttctggggtcagagtgttataagccaggcaaacggcaccatgaggcagagcagtggttctgagcacctgcacttctctcagcaggacaaacccscacaccctcgggaagctggaggacctcaggcacagggggtggggaacttgtcttcctctcccctgccctgtcctcacctcctttttctctgtgacctcctctgaaatggtcagttttcctggttctgtctctgggcagtgtggatgggaaacctgccttttccctgccttcaagcagggattcattcaaaccatcccggccaatgggccctggctgtctatgatggtctcttaggttcatcttagattatcattcactgtatctagcttcctccttccctgacgtgttagcagcccattc

SEQ ID NO: 109461 - DNA, 601 bp, Human
agaaaatgacgcatatgtcccctgcagtcgtgaggcagggaccgaagagaatgaggaaggggcattggattgccaggctggtgcccatggattgccaacattctgagctctctgaaagcagctgtccagcccccggcccacctcttcccccttcaccacccagccccagcatgctcaggaaagggcccctcagttgccctccccacccctttcctgccctttctggggtcagagtgttataagccaggcaaacggcaccatgaggcagagcagtggttctgagcacctgcacttctctcarcaggacaaacccccacaccctcgggaagctggaggacctcaggcacagggggtggggaacttgtcttcctctcccctgccctgtcctcacctcctttttctctgtgacctcctctgaaatggtcagttttcctggttctgtctctgggcagtgtggatgggaaacctgccttttccctgccttcaagcagggattcattcaaaccatcccggccaatgggccctggctgtctatgatggtctcttaggttcatcttagattatcattcactgtatctagcttcctccttccctgacgtgt

SEQ ID NO: 109462 - DNA, 601 bp, Human
ggtgcgtcagcatggccatgtcttcgatcctgtcgaacttgggggggttcatggcgtacacatcctctggtttgaccaccagggtctaaaaaggaagaggcacagtgcttcactaagatggtctgcacgtcttttttttttttttttttttttttttttttgagacggagtcttgctttgtcgcccaggctggagtgcagtgatgcgatctcggctcactgcaagctccacctcccgggttcacaccattcttctgcctcagcctcccaagtagctgggattacaggcgcccgccaccacrcccggctaattttttttatttttagtagagacggggtttcaccgtgttagccaggatggtctcgatctcctgacctcgtgatccacccgcctcagcctcccaaagtgctgggattacaggtgtgaggcaccgtgcctggcctgtctgcacgtcttgtctgctgcccccaccaaaagaccaagagactcttgagccgagatggaagggccaaaccctagaacaagcccagctcacagcgagaggaggaaaggctatggggcggcttgtggtggtgctgatgaaatggggtttgtttctgtt

SEQ ID NO: 109463 - DNA, 601 bp, Human
cccgccttaccctcccaaagtgctgggattacgggcgtgagccaccacacccagctgcctttattattatctcatgtttctttgggataaacttataaaggggggaggctaccattcctatttatagtgaggcactgagactcaaaaaggggagtggcgaccctcccacagttggtaagtcacagcaccccgtgaccaagcctggccccagcttccccgctctccggctcctggtcctccttcccaccttccttcttcctgccccatccacctcttgctttcttgccttctttctcctccrtctttgtgttttgttcatcagctaggcaagcactcatcttccagaatcccacggcccacacacatacctctgcctccctcccctgcccgcatatctaatgccccagggaaaccacgtcgaaagccctcgctgacatagatcatccaagatgtgtaacggtccttcaggttgtacagcacggctggctcattcaggtgcgtcagcatggccatgtcttcgatcctgtcgaacttgggggggttcatggcgtacacatcctctggtttgaccaccagggtctaaaaaggaagaggcacagtg

SEQ ID NO: 109464 - DNA, 601 bp, Human
aatttttgtattttagtagagatggggcttcaccatgttggccagaatggtctcgatctcttgacctcatgatccacccgccttaccctcccaaagtgctgggattacgggcgtgagccaccacacccagctgcctttattattatctcatgtttctttgggataaacttataaaggggggaggctaccattcctatttatagtgaggcactgagactcaaaaaggggagtggcgaccctcccacagttggtaagtcacagcaccccgtgaccaagcctggccccagcttccccgctctcyggctcctggtcctccttcccaccttccttcttcctgccccatccacctcttgctttcttgccttctttctcctccgtctttgtgttttgttcatcagctaggcaagcactcatcttccagaatcccacggcccacacacatacctctgcctccctcccctgcccgcatatctaatgccccagggaaaccacgtcgaaagccctcgctgacatagatcatccaagatgtgtaacggtccttcaggttgtacagcacggctggctcattcaggtgcgtcagcatggccatgtcttcgatcct

SEQ ID NO: 109465 - DNA, 601 bp, Human
tattattattgtttttttttttttttgagacggagtctcactctgtcaccaggctggagtgcagtggcacgatcttggctcactgcaacctccacctcccgggttcaagcaattctcctgcctcagcctcccgagtagctgggactacaggtacatgccatcacgcccggctaatttttgtattttagtagagatggggcttcaccatgttggccagaatggtctcgatctcttgacctcatgatccacccgccttaccctcccaaagtgctgggattacgggcgtgagccaccacacccrgctgcctttattattatctcatgtttctttgggataaacttataaaggggggaggctaccattcctatttatagtgaggcactgagactcaaaaaggggagtggcgaccctcccacagttggtaagtcacagcaccccgtgaccaagcctggccccagcttccccgctctccggctcctggtcctccttcccaccttccttcttcctgccccatccacctcttgctttcttgccttctttctcctccgtctttgtgttttgttcatcagctaggcaagcactcatcttccagaatcccac

SEQ ID NO: 109466 - DNA, 601 bp, Human
tgctccagcatcccatgcttcctcctgggaaactcaccagtcagcatgaactgataggcgttgtcagagatggagaagatgtggggtggggcctcctggcgctttttgcctcggtagccttccaccacctcggggttgtacaccggcagccacttgtaggggttgacagtgacacagaagaggcctgagtaggtctgtgggaggaaaaacatatacgtgcgtatatgtatgtatgtgcatatggaaaaccccttgcctttattattattattgtttttttttttttttgagacggagtctyactctgtcaccaggctggagtgcagtggcacgatcttggctcactgcaacctccacctcccgggttcaagcaattctcctgcctcagcctcccgagtagctgggactacaggtacatgccatcacgcccggctaatttttgtattttagtagagatggggcttcaccatgttggccagaatggtctcgatctcttgacctcatgatccacccgccttaccctcccaaagtgctgggattacgggcgtgagccaccacacccagctgcctttattattatctcatgtttctttgggataaa

SEQ ID NO: 109467 - DNA, 601 bp, Human
ctcatgcagtgcctgctccagcatcccatgcttcctcctgggaaactcaccagtcagcatgaactgataggcgttgtcagagatggagaagatgtggggtggggcctcctggcgctttttgcctcggtagccttccaccacctcggggttgtacaccggcagccacttgtaggggttgacagtgacacagaagaggcctgagtaggtctgtgggaggaaaaacatatacgtgcgtatatgtatgtatgtgcatatggaaaaccccttgcctttattattattattgtttttttttttttttgagacggagtctcactctgtcaccaggctggagtgcagtggcacgatcttggctcactgcaacctccacctcccgggttcaagcaattctcctgcctcagcctcccgagtagctgggactacaggtacatgccatcacgcccggctaatttttgtattttagtagagatggggcttcaccatgttggccagaatggtctcgatctcttgacctcatgatccacccgccttaccctcccaaagtgctgggattacgggcgtgagccaccacacccagctgcctttattattatctcatgtt

SEQ ID NO: 109468 - DNA, 601 bp, Human
gcaactgccgctcgcctcatgcagtgcctgctccagcatcccatgcttcctcctgggaaactcaccagtcagcatgaactgataggcgttgtcagagatggagaagatgtggggtggggcctcctggcgctttttgcctcggtagccttccaccacctcggggttgtacaccggcagccacttgtaggggttgacagtgacacagaagaggcctgagtaggtctgtgggaggaaaaacatatacgtgcgtatatgtatgtatgtgcatatggaaaaccccttgcctttattattattattgtttttttttttttttgagacggagtctcactctgtcaccaggctggagtgcagtggcacgatcttggctcactgcaacctccacctcccgggttcaagcaattctcctgcctcagcctcccgagtagctgggactacaggtacatgccatcacgcccggctaatttttgtattttagtagagatggggcttcaccatgttggccagaatggtctcgatctcttgacctcatgatccacccgccttaccctcccaaagtgctgggattacgggcgtgagccaccacacccagctgccttta

SEQ ID NO: 109469 - DNA, 601 bp, Human
ggggcaactgccgctcgcctcatgcagtgcctgctccagcatcccatgcttcctcctgggaaactcaccagtcagcatgaactgataggcgttgtcagagatggagaagatgtggggtggggcctcctggcgctttttgcctcggtagccttccaccacctcggggttgtacaccggcagccacttgtaggggttgacagtgacacagaagaggcctgagtaggtctgtgggaggaaaaacatatacgtgcgtatatgtatgtatgtgcatatggaaaaccccttgcctttattattattrttgtttttttttttttttgagacggagtctcactctgtcaccaggctggagtgcagtggcacgatcttggctcactgcaacctccacctcccgggttcaagcaattctcctgcctcagcctcccgagtagctgggactacaggtacatgccatcacgcccggctaatttttgtattttagtagagatggggcttcaccatgttggccagaatggtctcgatctcttgacctcatgatccacccgccttaccctcccaaagtgctgggattacgggcgtgagccaccacacccagctgcct

SEQ ID NO: 109470 - DNA, 601 bp, Human
ctaaacaccagatggggtccagcctgggagtaaggggcaactgccgctcgcctcatgcagtgcctgctccagcatcccatgcttcctcctgggaaactcaccagtcagcatgaactgataggcgttgtcagagatggagaagatgtggggtggggcctcctggcgctttttgcctcggtagccttccaccacctcggggttgtacaccggcagccacttgtaggggttgacagtgacacagaagaggcctgagtaggtctgtgggaggaaaaacatatacgtgcgtatatgtatgtatgtrcatatggaaaaccccttgcctttattattattattgtttttttttttttttgagacggagtctcactctgtcaccaggctggagtgcagtggcacgatcttggctcactgcaacctccacctcccgggttcaagcaattctcctgcctcagcctcccgagtagctgggactacaggtacatgccatcacgcccggctaatttttgtattttagtagagatggggcttcaccatgttggccagaatggtctcgatctcttgacctcatgatccacccgccttaccctcccaaagtgctggg

SEQ ID NO: 109471 - DNA, 601 bp, Human
gtggcagccgggtgcagtggctcatgcctgtaatcccagcactttgggaggctgtggcaggcagatcacgaggtcaggagtttgagaccagcctggccaacaaagtgacccctgtctctattaaaaatataaaaatagccggacatggtggtgcatacctgtagtcgcagctactcgggaggctgaggcaggagaatcgcttgaacccgggaggcagaggttgtggtgagccgagatcacaccactgcactccagcctgggcaacatagcaagactccatctcaaaaaaaaaaaaaaaaaaccagccagtggcttctcatcgttcttgctgtattaggctgaactatataaaatgatcagtttttggttttgatccatgaaaacatccatatccgttttgcatattctaacttgcattaaatccaaaactcgtcaccttggcatgcggggccctacatgatgcagcccctttctgcctcttttggctccttcttcctcctttccctgtgctaaacaccagatggggtccagcctgggagtaaggggcaactgccgctcgcctcatgcagtgcctgctccagcatcccatgcttcctcctgg

SEQ ID NO: 109472 - DNA, 601 bp, Human
atcaaaagagagagaaagaaacaagtctgttggtataaacaggcttttcaggatgtcatactgaggcctgggcatggtctgagccatctctgacacacactcaccacactaatgtgacagaccacttgagaaggcagacgcccagggcacaggtgccacaggcacttgctcagctgacccaaggatgggtaattccatttttctgaggccttatgcagaccttcctccccatccccaaatcgatctttttattttttatttatttatttttctcttttattttttattttttgagacagartctcactctgctgcccaggctggagtgcagtggcgcgatctcggctcactgcaagctccggctcctgggttcacgccattctcctgcctcagcctcctgagtagctgtgactacaggtgcccgccaccacacccagctaatttttttgtattttttttagtagaggcagggtttcaccgtgttagccaggatggtctcgatctcctggacctcgtgatccgcccatctcagcctaccaaagtgctgggattacaggtgtcagccaccgcgcccagcctgatctttttattatagactctg

SEQ ID NO: 109473 - DNA, 601 bp, Human
tgactggctgtccttcaagatagtaaatcctagcctgttctccattctctgaagaggggggaatgtgaggacatttggccccctcattctgaggttaagaccacagttaaaagtggaagcaaagcaagccttcctctcccatctataccttcattttggagtccttcttcttggccaggtccccagtagctgcaattgttgcaaagtactggatgacccgtttggtgttcacagtctttcctgccccggattctccgctgtacagagtgatcaaaagagagagaaagaaacaagtctgttrgtataaacaggcttttcaggatgtcatactgaggcctgggcatggtctgagccatctctgacacacactcaccacactaatgtgacagaccacttgagaaggcagacgcccagggcacaggtgccacaggcacttgctcagctgacccaaggatgggtaattccatttttctgaggccttatgcagaccttcctccccatccccaaatcgatctttttattttttatttatttatttttctcttttattttttattttttgagacagaatctcactctgctgcccaggctggagtgcagt

SEQ ID NO: 109474 - DNA, 601 bp, Human
ctattcatcttatgggtaatttgagtaggagcctagtccccctaaaatttttgttttgttttgttttgttttgttatgtttttgagacggagtctcgctctgtcaccaggctggagtgcagtggcgtgatctcggctcactgcaacctctgcctcccgggttcaagtgattctcctgcctcagcctcctgagtagctgggactacaatcacgtgccaccacacctggctaatttctgtatttttaatagagacggggtttcaccatgttggccaggatggtctcgatctcttgacctcgtratccgcccgcctcggcctcccaaagtgctgggattacaggcgtgagccaccgtgcccagcaccccctacagtttgaaattagatatgtccttcctcttctcccttcttcttcttccagtttggggttttccttatttccttttatttatcccttttattctatgctcatcccccacttcaacgtatctagtcaacaaagcaactacagtgattgtttcaaggtgtaaatcaaaccatatcactccctggcttatagaatccctcagtagcttcctgttacacttcaaaaggaatccaaac

SEQ ID NO: 109475 - DNA, 601 bp, Human
gccccctcagcctcccaaagtgctgggattacaggtgtgagccactgtgcctggctggattaattgctttcaaaagcagtaccaagtgacctcagcagatcagccacccgctctggtttgctgtcacactgattttgtaccttctgtgccatccggctcggcctgctcctctcgctgcttctgcttgaacttcatgttcccgtagtgcatcacggctcccgtcagcttgtagagcccagatttctcttctggggtgaagcccaggatgtcaatggcgctctggcatggaaagggcagcacrtcagtcagttggccccagtgatggaggaggaacacccaccccttctgttggttccacttacgtctgtagccagcagctcctctgcatcatctatgctggccaccaggatctccccctggctaatgaacgggtagtcgtaagggttggtcgtaataagcagcagctctgaaatgacaaatagttccaggaggttatgcagatgcaaagaaaaaacccacccagtggacttgagctcctgcaccctgggctggaacttttaccgctggatcctaaattgaacttagaattaaaaatctttta

SEQ ID NO: 109476 - DNA, 601 bp, Human
tgagctgagatcatgccactgcactctagcctggatgacagagcaaaactctgtctgactctcgtgcctcagcctcctgagtagctgggattataggcatgctccaccatgcccagctaattttttttagtagagatggggtttcaccatgttggccatgctggtctcgaactcctgacctcaggtgatctggccccctcagcctcccaaagtgctgggattacaggtgtgagccactgtgcctggctggattaattgctttcaaaagcagtaccaagtgacctcagcagatcagccaccygctctggtttgctgtcacactgattttgtaccttctgtgccatccggctcggcctgctcctctcgctgcttctgcttgaacttcatgttcccgtagtgcatcacggctcccgtcagcttgtagagcccagatttctcttctggggtgaagcccaggatgtcaatggcgctctggcatggaaagggcagcacgtcagtcagttggccccagtgatggaggaggaacacccaccccttctgttggttccacttacgtctgtagccagcagctcctctgcatcatctatgctggccaccagga

SEQ ID NO: 109477 - DNA, 601 bp, Human
gcaacctcctcctcctaggttcaagcaattctcctgcctcagcctcctgagtagctgggactacaggcatatgccaccacacctggctaatttttcatatgtttaatggagacggggttttactgtgttagccaggatggtctcgatcttctgaccttgtgatctgcccacctcggcctcccaaagtgctgggattacaggagtgagccactgtgcccggcctaactcaggctttcaatggtcctatggctggaggtgtaggctagtaactgatacaattgtcttttgtctcccagtgagmcagaggctcgccaagtacaaaatgctttctaaaatcaactcaggtgatggatccactgggagcgtgaggtctattgctggtgtcctttaggaaaattggagagtttatgctggaaactcggacaagccaactcagctatctttggtataagataatagtgatactctcatcgcacattggttagaccgtatttattatattttatcatctgtcacttcacctcagtgacagtaatcagattaagacaacactactactctcaaataaatcaagcttagaatctcagcattgctcatttag

SEQ ID NO: 109478 - DNA, 601 bp, Human
gagggaactagctcggagtcacattgctagagagcagtctagaatctagatctcttgactcttcagtcagagcttttcctgccattttgtatatcagataaattccagagaaaaacatggaagaaacaaatatatataacttggccaaatggtagattgttcagtttacatggaggtccatatctgttctttcgaaataggtcttttcatacgaatctttctccctctcaaattccagtgttcgtacatctcatccccaagcatatagaacatgtttattacacacctttgtttaaaatckccatagagaatcctgtttgggaaccctttcctgcagatgcggatgccctccaggacaccgttacaccgcagctggtgcagaacaaggctgtgttccatagcccctgggaacagaagcgagatatcagccttacacagaatttcttaaaaactgagcaccacctagcgagccagcaggtgtctcacctggagttttggtttcattgggaattatacaacgcacaaaatgagggtgagtagttcttaaatttgacatcagcttgttcaggttttcctaagagaaaaaaaaaatgacatttgc

SEQ ID NO: 109479 - DNA, 601 bp, Human
gctgtgtcaagaggacgaaaaggccagcatctgtcagaactgatgcattaccttggtatgtccaaatttgtactgagtgtggtcaatatcaatggatgccagaagcttttcacaggctttcttgctgtcaatgaattgtccctcagggattgcactggcattcagcactcggtatctgcattgtagacatggaaatcatcacagactgttggcaaagacacaaaccttggagaacatgtagttcaggcctctcttcctataggcagaaggccaaggtcccaggagatgagggaactagctyggagtcacattgctagagagcagtctagaatctagatctcttgactcttcagtcagagcttttcctgccattttgtatatcagataaattccagagaaaaacatggaagaaacaaatatatataacttggccaaatggtagattgttcagtttacatggaggtccatatctgttctttcgaaataggtcttttcatacgaatctttctccctctcaaattccagtgttcgtacatctcatccccaagcatatagaacatgtttattacacacctttgtttaaaatcgccatagagaatcc

SEQ ID NO: 109480 - DNA, 601 bp, Human
gattagtttggccaggcggtcatcccgcatctcttccagggttcccagcaagccagccttgaagaacaccttatggggcagaagggtgacatgagtcagtttcctagagaagctgtgtcaagaggacgaaaaggccagcatctgtcagaactgatgcattaccttggtatgtccaaatttgtactgagtgtggtcaatatcaatggatgccagaagcttttcacaggctttcttgctgtcaatgaattgtccctcagggattgcactggcattcagcactcggtatctgcattgtagacayggaaatcatcacagactgttggcaaagacacaaaccttggagaacatgtagttcaggcctctcttcctataggcagaaggccaaggtcccaggagatgagggaactagctcggagtcacattgctagagagcagtctagaatctagatctcttgactcttcagtcagagcttttcctgccattttgtatatcagataaattccagagaaaaacatggaagaaacaaatatatataacttggccaaatggtagattgttcagtttacatggaggtccatatctgttctttcgaaataggtc

SEQ ID NO: 109481 - DNA, 601 bp, Human
ttgcgacattccagtatttcactatatatgaagttctttatgaagcatttcaactaaaaagcaaaaatccccaccaataactcaatttttctaaataaataatcaaatctagaagagttaaaaaaaaaaaaaagattgctaaacacgtacagcttgtacttggagctgcaggtcattcttctcttggaccagagtcaccagtttttcctctagctccttcctttttgcctccgacttggcgagttcatctttggttttctggaattcttccttcatggtggccatctctttctcagtctcygcactcttgaggaggggcttgatcttgaagaagagtttcatccagggccagtgcttgacgttcatgaatgagcgaatgttgtactggatgcagaagatggactccctaaaaacaagacattgcttatttctgagagagactccccttccccaaagagctcatgtctgaacaaagaccctgctggacctcctctgcaccatcttctggaattccacacgcatgaggaaccctctgcacacagcttgtgtccgggtgattagtttggccaggcggtcatcccgcatctcttccagggttccc

SEQ ID NO: 109482 - DNA, 601 bp, Human
gggtcaactcaaggtcatcaatgtctttcttgagctctgagcattcatcctccagtttcctcttcttggccgtcagctcagcattgatctcctcctcatcttcagctctctctgtcacctccttgatcttggcctcgagctggaatttggctttgatcagctgatcgcatctttcctcagcatccaacaaattttcgctttccttaaaaaaaaaagaataataacttcgttgaatgatataaggtttgcgacattccagtatttcactatatatgaagttctttatgaagcatttcaactraaaagcaaaaatccccaccaataactcaatttttctaaataaataatcaaatctagaagagttaaaaaaaaaaaaaagattgctaaacacgtacagcttgtacttggagctgcaggtcattcttctcttggaccagagtcaccagtttttcctctagctccttcctttttgcctccgacttggcgagttcatctttggttttctggaattcttccttcatggtggccatctctttctcagtctctgcactcttgaggaggggcttgatcttgaagaagagtttcatccagggccagtgct

SEQ ID NO: 109483 - DNA, 601 bp, Human
ctctgtggcatgcttctccttctcaaccttggccagggtcaactcaaggtcatcaatgtctttcttgagctctgagcattcatcctccagtttcctcttcttggccgtcagctcagcattgatctcctcctcatcttcagctctctctgtcacctccttgatcttggcctcgagctggaatttggctttgatcagctgatcgcatctttcctcagcatccaacaaattttcgctttccttaaaaaaaaaagaataataacttcgttgaatgatataaggtttgcgacattccagtatttcrctatatatgaagttctttatgaagcatttcaactaaaaagcaaaaatccccaccaataactcaatttttctaaataaataatcaaatctagaagagttaaaaaaaaaaaaaagattgctaaacacgtacagcttgtacttggagctgcaggtcattcttctcttggaccagagtcaccagtttttcctctagctccttcctttttgcctccgacttggcgagttcatctttggttttctggaattcttccttcatggtggccatctctttctcagtctctgcactcttgaggaggggctt

SEQ ID NO: 109484 - DNA, 601 bp, Human
ccagctgaaaaaggcaccatttccttttgggaacaaatgctttgcaagaggacccttgagggctcttccaaccctggagttctgggactcccgatgagcattatttacttacgtcttccacttgctgttccagtttgctcttggttttgttcaaagaattgactttgtcttcttcagcttggaggtcatccaaggcctgctggtgcgcctcttggagggccttcttctctctggttaactttgcaattgtttcatctaacccagagagttcctcagtaaggtttttaacctaagaagaatycgcaagcaattataagcttaaagtttagtttgcaatgactatatcaagctagacacacctacaataagaataccttgttctctgtggcatgcttctccttctcaaccttggccagggtcaactcaaggtcatcaatgtctttcttgagctctgagcattcatcctccagtttcctcttcttggccgtcagctcagcattgatctcctcctcatcttcagctctctctgtcacctccttgatcttggcctcgagctggaatttggctttgatcagctgatcgcatctttcctcagcatcca

SEQ ID NO: 109485 - DNA, 601 bp, Human
gtctactcggagcttcttttcttgttctagggagctttccagctgaaaaaggcaccatttccttttgggaacaaatgctttgcaagaggacccttgagggctcttccaaccctggagttctgggactcccgatgagcattatttacttacgtcttccacttgctgttccagtttgctcttggttttgttcaaagaattgactttgtcttcttcagcttggaggtcatccaaggcctgctggtgcgcctcttggagggccttcttctctctggttaactttgcaattgtttcatctaacccrgagagttcctcagtaaggtttttaacctaagaagaattcgcaagcaattataagcttaaagtttagtttgcaatgactatatcaagctagacacacctacaataagaataccttgttctctgtggcatgcttctccttctcaaccttggccagggtcaactcaaggtcatcaatgtctttcttgagctctgagcattcatcctccagtttcctcttcttggccgtcagctcagcattgatctcctcctcatcttcagctctctctgtcacctccttgatcttggcctcgagctggaattt

SEQ ID NO: 109486 - DNA, 601 bp, Human
aaatgcagagggctcctacctgcaactctttgattttcttctgaaactggaggcccagtgtctgctcatcttccactttgctttgaagttgacaatattcaaaatctttcctgtgaagagaaatgtagaatgcatgaagacaaaatacacagtaacttgcaaaatggaagccagtggttgaagggcatacttcttgagcctttcgtccagctgttgcttgtcattctccagatctaatatggactcttgagcaagcttcaagtctccttccaatttccttttgttcctttccaggtctackcggagcttcttttcttgttctagggagctttccagctgaaaaaggcaccatttccttttgggaacaaatgctttgcaagaggacccttgagggctcttccaaccctggagttctgggactcccgatgagcattatttacttacgtcttccacttgctgttccagtttgctcttggttttgttcaaagaattgactttgtcttcttcagcttggaggtcatccaaggcctgctggtgcgcctcttggagggccttcttctctctggttaactttgcaattgtttcatctaacccagagagt

SEQ ID NO: 109487 - DNA, 601 bp, Human
ttgttgagctctatctgcgtggaggtgacgcctcccgcctcctccagccgctcgctcagctcctccagctcccgggcatagtcgctgcgctgtttctctgtcttcgcgcgggtggccctctccgcctctatctcctcttccagctcctcaattcgagcctgtggagggcagccgttcaccccgtgggcagtgggttcaccgcggggactctgattgccaagaacaggctggtttcccttcccattagacaaactgagtcttagactcccctccaatgaatactgcaaatttcctttcacakgaattttttctgccccaacatggtaattactcctgcagtgaccaaacctgaacattttccaccaactaaatgttaacttttagttgttaacttaaatactttaattatggattaaagtatttaatcagatgttttggggaaatggttcatcatggccaggccagcctagcagaaagggaaccatgaggcaggtggccccacagtcttgcccactttctctaaatggcttatagcagacagcacccagctcactgtaagtggcctcacatggaagagagaaatgcagagggctcctacctg

SEQ ID NO: 109488 - DNA, 601 bp, Human
aaactgaaagcagaactgataaggtattgttgtaggccaggtgcagtggctcacgcctgtaatcccagcactttgggaggctgaggcaggcagatcacaaggtcaggagtttgagaccagcctggccaatatggtgaaaccccatctctactaaaaacaaaaattagccgggcgtggtcatgggcacctgtagtcccagctacttgggaggctgaggcaggagaatcactggaacccaggaggtggaggttgcagtgagccaagatcatgcctcaatctcaaaaaaaaaaaaaaaaaaaaagatattgttgtaaactactggaaggtgggactgatgtctgtcaaaaaaaaaatccattgagaagaactgtaaatgtaaacgttaccaggagcacctaataactcccatcagacctccccagtggcaggtgtttccagctgtttattgatttgttatcgacaaatacatagggaaatacttagagctttatatctctagttagactcttgggggaatagggtaagttcaagtttatatgcttacatagaggtaagagaaaaacatagaatggggctttatggctccagacgtgaatccccc

SEQ ID NO: 109489 - DNA, 601 bp, Human
atttattcactcattcactcaccaactttctattatgtgtagggcactgtgctaagatctggggagacagaaaatgataagatatggtttcttcttcagggagaaggtatatggttcatgaaaaggaaactgaaagcagaactgataaggtattgttgtaggccaggtgcagtggctcacgcctgtaatcccagcactttgggaggctgaggcaggcagatcacaaggtcaggagtttgagaccagcctggccaatatggtgaaaccccatctctactaaaaacaaaaattagccgggcgyggtcatgggcacctgtagtcccagctacttgggaggctgaggcaggagaatcactggaacccaggaggtggaggttgcagtgagccaagatcatgcctcaatctcaaaaaaaaaaaaaaaaaaaaagatattgttgtaaactactggaaggtgggactgatgtctgtcaaaaaaaaaatccattgagaagaactgtaaatgtaaacgttaccaggagcacctaataactcccatcagacctccccagtggcaggtgtttccagctgtttattgatttgttatcgacaaatacatagggaa

SEQ ID NO: 109490 - DNA, 601 bp, Human
cagggtcttgttctgtcacccaagctggtgtgcagttgcgtgatctcagctcactgtaacctctgcctcctggaaagcaatcctcccatctcagcctcccaagtagctgagaccacaggcttgtgccaccatgcctagctaatttttattttttttgtagagataaggttttgctatattgcccaggctggtatcaaactcctgggctcaagtgagcctcttgcctcagtctcccagagcgctgggactacaggcgtgcaccactgtgcccagcctacatttctgagtatgtgaggaggaragaggtttttccccgatgggttctctcaaaccttcagctgtccctggacactcctgaggtgtttgagggtctccgccgcctggcggttggcgtggctcagctggatctcgatttcattcaggtccccctccatcttcttcttgagccggatggcttcattcctgctccgcacctcggcgtccagggcgctctgcatggtttccactgttctctggtagttcctcttcagctgctcgatctcttcatccttctcggcgatctttctatcaatttctgatttcacttgtgtcaattcaagct

SEQ ID NO: 109491 - DNA, 601 bp, Human
ctaaagaaaaaggacaggccaggcgcggtggctcacgtctgtaatcccagcactttgggaggccaaggcgggtggatcacctgaggtcaggagttcaagaccagcctgctcaacatggtgaaagcccatctctactaaaaatacaaaaaattagctgggcgtggtggcagatgcccgtattcccagctactccggaggctgaggcaggagagttgcttgaacccaggaggaggaggttgcagtgagccgagatctcgccattgcactccagcctggtcaataagagtgaaactccatctcrggggtgggggaagaaagaaagaaagaaaaaggacaacgggtgagactgtgatgaagcacactctgccaccctggaagagggccagagctacacccagtagataaaataacctaatcaatgaggcaatgagaactttagcgacaggctgggaaacagtttcttccctttcttaagctggcctcctttgaaactctcccctgccccagggaaattcttttttcattaccaccaatatatattttcaaaggagcttgagacttagagtagtctgacttgatactcagcctcatagatttgggg

SEQ ID NO: 109492 - DNA, 601 bp, Human
agaacatgtggtgtttggttttctgtttctgtgttagtttgctgagaatgatggcttccagcttcatccatgtccctgcaaaggacatgatatcattcttttttatggctgcatagtattccatggtgtacatgtgcaggatggcggtttttattgtgactcacagaccaggattctagcgagggtccagtcagctaagtgactttaagcactttctcttcctgagcctgagactccccagctctaaagtaaagggttctctgaggttccttccagctaagaagtttctacagtccctggrggggggctcctcccagctcagcgactcaccctgctggaggtgaagtctcgagtcttagcgcggagcttgttgacttgagattctgcgatatccgcacgttcctcggcctcctccagctcatgctgagcctttcggaatttggtgagatgagcattggcttgttcatcctaaaaccaaagagcccaggcaggttatatcagcacgcgcctctctcagaactcaccacgggaaacagcacggtctgcctgccgcagtcagcacctatctcacttacagcctcctccgcctgcctcttgtagg

SEQ ID NO: 109493 - DNA, 601 bp, Human
gtatgtcctcatttgtgatgtcatgggcaaattatggttttctagttaaaggaagttggattaacttctgattataaagttaacggaaggtggactggtgaacactgctgtaagtagataattcaatggagaagaaaatttagaaataattttattttgaaatatgtatagtttatgttttctagttgtaagttaaccttcctaatatgtttgaagactaaaagtaaaagcattactactggccaagtgcagtggctcatgcttgtaatcccagctgtttgggaggctgaggcgaatggawcagttgaggccaggagttcaagaccagcctggccaacgtggcgaaactctgtctctactaaaaatatatatatattaaaaaaaaaaattagccaggcatggtggtgtgtgcctgtaatcccaggtacttgggagactgaggtgggagaatcacttgaacctgggaggtggaggttacagtgagattgtgccactgcacttcagcctgggcaacagagtgagactgtctcaaaaaaaaaaaaaagaaaaaaaaagaagacattactattaatgctccacaggcatggtctatgtgtaggag

SEQ ID NO: 109494 - DNA, 601 bp, Human
tattttgaaatatgtatagtttatgttttctagttgtaagttaaccttcctaatatgtttgaagactaaaagtaaaagcattactactggccaagtgcagtggctcatgcttgtaatcccagctgtttgggaggctgaggcgaatggaacagttgaggccaggagttcaagaccagcctggccaacgtggcgaaactctgtctctactaaaaatatatatatattaaaaaaaaaaattagccaggcatggtggtgtgtgcctgtaatcccaggtacttgggagactgaggtgggagaatcrcttgaacctgggaggtggaggttacagtgagattgtgccactgcacttcagcctgggcaacagagtgagactgtctcaaaaaaaaaaaaaagaaaaaaaaagaagacattactattaatgctccacaggcatggtctatgtgtaggagtaaaatcaggcattgcatgccagtatttgattatctctatactggattaaaaacaaaacaaaatgattgctttgaaaacccatgcaataacgtacacttttcccttgttaacattcatgattgattcatttttgaagcagagatttattaat

SEQ ID NO: 109495 - DNA, 601 bp, Human
gaagactaaaagtaaaagcattactactggccaagtgcagtggctcatgcttgtaatcccagctgtttgggaggctgaggcgaatggaacagttgaggccaggagttcaagaccagcctggccaacgtggcgaaactctgtctctactaaaaatatatatatattaaaaaaaaaaattagccaggcatggtggtgtgtgcctgtaatcccaggtacttgggagactgaggtgggagaatcacttgaacctgggaggtggaggttacagtgagattgtgccactgcacttcagcctgggcarcagagtgagactgtctcaaaaaaaaaaaaaagaaaaaaaaagaagacattactattaatgctccacaggcatggtctatgtgtaggagtaaaatcaggcattgcatgccagtatttgattatctctatactggattaaaaacaaaacaaaatgattgctttgaaaacccatgcaataacgtacacttttcccttgttaacattcatgattgattcatttttgaagcagagatttattaataaattacctactgtgggagaatggcgtgaacctgggtggtggagcttgcagtgagccgag

SEQ ID NO: 109496 - DNA, 601 bp, Human
gtgctatatttgcctcagcagatatctgtatccattcatcagtccatctgatatttcaaagtaagctcaaaacattagttcacattacttgtataaactgcaatatatctatcttttttatttttaaattaaattaaattaaaaaaaaaattttttttttgagacagagtttcgctcttgttgcccaggctggagtgcagtggcatgatcttggctcactgcaaccactgcctcccaggttcaagtgattctcctgccttagcctcctgagtagctgggattacaggcgctcgccaccacrcccagctaattttttgtgtttttagtagagacgagggttcatcatattggccaggctggtcttgaactcctgatctcaggtgatccacctacctcagcctctcaaagtgctgggattacaggcgtgagccaccgtgcccagcctaattttttttgacagagtcttggtcttgtcgctcaggctggagtagtgtgatcttggctaactgcaacttccacctcctggattcaagagattctcctgcttcagcctccagagtagctggggctacaggcacccaccaccttgctgggctagttt

SEQ ID NO: 109497 - DNA, 601 bp, Human
atacagtgaaacttaagaatcttaagtgtacttttggatgagttttgatcattgcttccaatttggtaatccaaagccctatacaaatatacacataaacatcattacagacagtcactggacacttcttcctattcagtccttccctgaattttttgagacagggtctcaacttctgtcactcccaggctggagtgcagtggctggatcacggcttactgcagccttgacttcctgggctcaggtgattcttccacctcagcctcctgagcagctgggaccataggcatacaccaccacrcgtggcccatttttttatttttagtagagacggagtctacttctgaggcactgttttgtttttttattcacattcatataaagtaagttaaaatgtgatttttaaaataaccctccttccttttttattttttttgaggtagggtcttactctgttgtccaggctggagtgcagtggtgcgattacagctcactgcagccttgaccacctgtgcttaagcagttctcccaccttaacctcccaagtagctgggactacaggtgcgtgccaccatgcctggctaatactgtttatttttgt

SEQ ID NO: 109498 - DNA, 601 bp, Human
ccctgaattttttgagacagggtctcaacttctgtcactcccaggctggagtgcagtggctggatcacggcttactgcagccttgacttcctgggctcaggtgattcttccacctcagcctcctgagcagctgggaccataggcatacaccaccacgcgtggcccatttttttatttttagtagagacggagtctacttctgaggcactgttttgtttttttattcacattcatataaagtaagttaaaatgtgatttttaaaataaccctccttccttttttattttttttgaggtaggktcttactctgttgtccaggctggagtgcagtggtgcgattacagctcactgcagccttgaccacctgtgcttaagcagttctcccaccttaacctcccaagtagctgggactacaggtgcgtgccaccatgcctggctaatactgtttatttttgtagagacgagatctcactgtgttgcccaagttggtctcaaactcctgactaaagcgatccacctgtcttggcctcccaaagtgcgaggattacaggcctgagccacagtgcccaaccaaagtaaaccttcttttgagagttatgc

SEQ ID NO: 109499 - DNA, 601 bp, Human
attaccaagtattggcttctattctatgaataaattataatttgttcattcttctttgtcagatatatccttagtaaatattttctcccagtctgtggttttttgttttttgtttttaattttttgagacagagtctcactctgttgcccagactggagtacagtgacgcgatcttggctcactgcaacctccgccttctgggttcagttggttcttgtgccccagcctcccgagtagctaggaccacaagcgcacaccaccagtcccagctaattttttgtaatttagtagagatgaggwtttgccatgtaggccaggcagatctggaactcctgacctcaggtgatccacctgcctcggcctcccaaagtgctgggattacaggcatgagccaccatgcctggccctcatttattttctttttgatatcttttggcaagcggaagttttgtcattttgatgaaatacaatttattagttttttgttttatagtgaatggttcctcttctctgtcttaaaaaatctgcttcctctcaaatcatgaggataatcttatttattttagaagctttacatttacatctgtgatccatctcaaa

SEQ ID NO: 109500 - DNA, 601 bp, Human
ctcggcctcccaaagtgctgggattacaggcatgagccaccatgcctggccctcatttattttctttttgatatcttttggcaagcggaagttttgtcattttgatgaaatacaatttattagttttttgttttatagtgaatggttcctcttctctgtcttaaaaaatctgcttcctctcaaatcatgaggataatcttatttattttagaagctttacatttacatctgtgatccatctcaaattaattttagtgtatggtgtgatagggattgagtttcatatttttacatgaatatrtacacttctagctctattgttgaaaacacttttctttcctcggtgttgctttggagtctttgtcaaaaatgaaatgaccaggcagggcatggtggttcacgtctgtaatcctagcactttgggaggcagaggtgggcagatggcttgagcccaggagttcaagaccaacctgggcaacatggtgagaccctgtctctacaaaaaatacaaaagttagccaggcatggtggtgtgcacctgtattcccagctagttgggaggctgaggtggggggatcacctgagctttggggaggtttta

SEQ ID NO: 109501 - DNA, 601 bp, Human
ttctttttgatatcttttggcaagcggaagttttgtcattttgatgaaatacaatttattagttttttgttttatagtgaatggttcctcttctctgtcttaaaaaatctgcttcctctcaaatcatgaggataatcttatttattttagaagctttacatttacatctgtgatccatctcaaattaattttagtgtatggtgtgatagggattgagtttcatatttttacatgaatatatacacttctagctctattgttgaaaacacttttctttcctcggtgttgctttggagtcttkgtcaaaaatgaaatgaccaggcagggcatggtggttcacgtctgtaatcctagcactttgggaggcagaggtgggcagatggcttgagcccaggagttcaagaccaacctgggcaacatggtgagaccctgtctctacaaaaaatacaaaagttagccaggcatggtggtgtgcacctgtattcccagctagttgggaggctgaggtggggggatcacctgagctttggggaggttttaggctgcagtgagctgtgattgcaccactgcattctagcctgggcaacaaagtgagaagttg

SEQ ID NO: 109502 - DNA, 601 bp, Human
tccttctgtttactctgggttatttcctcatttttagcttactaaaggtgggacctgaggtcattgattctacagcttgctctttgaatacagagttagaggaaagataatgttattaagacattaataaagaagggaaaatgtatttactgtttattaagtggaagtagattgtgttcagtaggctgaggaggaggaagaggaggagggagggactggtcttgctgtcttggagataacagactggagaggtggaggggaggcggaagaggcagggacacttggtgtaaatttttttttyttttttttgagatagggtctcaacttccgtcactcccgggctggagtgcggtggctggatcatggcttactgcagccttgacttcctgggctcaggtgactctcccacctcagcctcccaagcacctgggaccacaggcatacaccaccacgcctggctcatttttgtattttgagtagagatagagcttcactatgttgcccaggctggtctctaacttttgggcccaaatgatccgcctgccttggcctcccagagtgctggggttatgggcttgagccactgtgcccagccaacttg

SEQ ID NO: 109503 - DNA, 601 bp, Human
cacctgggaccacaggcatacaccaccacgcctggctcatttttgtattttgagtagagatagagcttcactatgttgcccaggctggtctctaacttttgggcccaaatgatccgcctgccttggcctcccagagtgctggggttatgggcttgagccactgtgcccagccaacttggtgtaacttttattgaaaaaatttgtgtttaagcggacatgcacagttcaaactcatattgtcaactattaacattttaaagtgatcattttccctctaagctctacttaactgtgctatacraatgttgatgtattttatcatttggttcaaaatgttttctaattgcccttgtgggccttctttgacccattgatttatttagaagtagtggtttaatttttacatatttgaggttttcctaggtccttttctgtaattgattgctgagttaattctgtatcatcagtgaacatttttgatatattttcactgctttcctttttattgagatctctttatggtccagcacgtgttctgtcttggtgagtgtacagtgtgtacttgaaaggagtgtgttttctgaagttgttgggtgtagtg

SEQ ID NO: 109504 - DNA, 601 bp, Human
taacctgaggctttttgccactactggtggaaatctacactgctcgcccttttaagtctttttttatcctctaagtttcctctccagtcactcattcttattctctgccctcctgctaaccaagtcatttattccaccttctggattttgctaatgccatccacgtagtgtcaacgttcctctgttctcccagttacctataaaccggtggttggctgtagtagtttcttaagattcaggcttaatttcaggaatgggaaagatccactatttcataggttgtgtggtgtttttttaatcraaaaccactttaaaagttttaatttttggtcatgttagcagctaatgctcagtgcctacatccactaattagcagttgtaaaatggtgatagtctaactcagtagttttccaagtacagtttgggacttgtaagggatccttgagaccttttcagaggttctttaaagttaaaaaaaaaaatttaataatactgagactcagtttgctgtttttttactcctgttttcatgggtatacagagttttccagaagctacataacataaaaatgcggaagcagatgagaaatcagctggctcc

SEQ ID NO: 109505 - DNA, 601 bp, Human
gaaagaaaactgtttcttccccacctcttggtttatttacatagaatattgtacaaatgtggtttacttcaggggcttgttttgaatttgtgctaattctctctgttccttggccaatgactacattctaaacctcggtcagctgcctcacaaatgcatgccttcagtcaccaggacaacaagacaatagagtatcagtacaaatagatcactatgattgagtcctagattgaactaaataatggatgagtgtatttgttttaagaggtggctggtattgatgatatccttaaaccatagwtaatccacaaacaattcttacttcatatcaagacaaaatataaagttcttaatcatttctgaaggttatatgaccaaacaagctagccctcttctgctactcccttgctcaactccttgtttgttccaggtgtattctggaaaatgtaaaaaatgtaaagctttttctgtgtgtacatctatatgtgaggtagggaggcaagaacacacctttggttaatttttccttgaaaccttgcatatcagattcataatatctttgggagtgagaatgctttgctttaagaggcgtcacaaagta

SEQ ID NO: 109506 - DNA, 601 bp, Human
aaatataaagttcttaatcatttctgaaggttatatgaccaaacaagctagccctcttctgctactcccttgctcaactccttgtttgttccaggtgtattctggaaaatgtaaaaaatgtaaagctttttctgtgtgtacatctatatgtgaggtagggaggcaagaacacacctttggttaatttttccttgaaaccttgcatatcagattcataatatctttgggagtgagaatgctttgctttaagaggcgtcacaaagtaagtttagaacaattggaatggaaacactgttgggattttttttttttttctttttaggaaataattctaaagctcatccaaaagaacagaaaagtaaaactagttgggaataatttgtaaaattatttactgtttgtaaatagtcaataattaaagcaacctgaaactagtgcaaggataggcacggatctgtagattagatcctgagatatactgtaaccttcatatattataaatgtggatgatcttgtaaaacaaaagaatttcagcattcagtgtggaagttggttattcaatgaatggaaaattaactagaatgttacctgacatgataca

SEQ ID NO: 109507 - DNA, 601 bp, Human
ttcataatatctttgggagtgagaatgctttgctttaagaggcgtcacaaagtaagtttagaacaattggaatggaaacactgttgggattttttttttttttctttttaggaaataattctaaagctcatccaaaagaacagaaaagtaaaactagttgggaataatttgtaaaattatttactgtttgtaaatagtcaataattaaagcaacctgaaactagtgcaaggataggcacggatctgtagattagatcctgagatatactgtaaccttcatatattataaatgtggatgatyttgtaaaacaaaagaatttcagcattcagtgtggaagttggttattcaatgaatggaaaattaactagaatgttacctgacatgatacaccaaaatttcagaaaaattttagcattaaaatgtaagtcataaaggaagccataaacatgtagaaaacagtctcaaaagatctacctgcaaaatgtttattaatcccaagggggacaaacagtgactttaaatggataaagatacattttaaccaaataatccaagtatacaccagtactgggacaaattgatgttgtgtatctttcttca

SEQ ID NO: 109508 - DNA, 601 bp, Human
gggtgggtaacagtaaaacacaaagagtgattactatagaaaatacagccaaatagccaactacatatttagcatttgaatgcagaagaactttatagactgaaagcaatggaagaagtcacaaagtaaaaactgatatatttaactagataaaacaaggaaactcgtgaaaggcagagtaaataaaattaaaaggcagagcccttgttctgtgccaggcaccataccatacagggtaatttacttatgttatcttagtttgagatagttgggcagatgataatcttccttgaaactactrtgacttcactaataataagtcttaaatttataaagctctttgtaatttacaaagttcattcataaataacctgtgtgttgaggggggtagggaggggtgcttactgtactcatgctccttactgaaagaagagaaggcttattgccctgggaaaaccacgaaacacagcaccacacatacacacacacacatgcacacgcacacacatccacacccctgattgtaccaggaatggacacctaaccctggggctagtgacttatcaggtcctgtttcttcagaaattgaattaaggttcac

SEQ ID NO: 109509 - DNA, 601 bp, Human
acctattaatctttcaccaaaacttattctggtactttttctcctatattatcaagtgaatcagtatgtataataaattggctctcagatagtccttgctgttgggaagttcttcctccaggggaaagtttttgcccatctctctatgttattccctgtgcacattctaatatgtttttgtttgtgcaggcatcattcagtttatgtattgtttagatatgcctctaaaacaggtttttattatcctatttaaattgttactagtcttggatgctgggatggtagcatagtccatggttgyaggtatgttaggggttggcacactttttctgtgagagtcagatagtaaatattttaggctttatgggtgccataaggtctttgttgcagttaatgctgatgttgtagctgaaagtagtcatagacaatacgtaagcaagtgggtgtgactgtgttctaagaaaactttatctacacacataggccccagatttagcccagtttgctgatccctggctgtatatgacgtgagaatttggatcagtgaatttattatttctacctaaataagttggggaactaaatgttctaggtcagtgtg

SEQ ID NO: 109510 - DNA, 601 bp, Human
gtgaatttattatttctacctaaataagttggggaactaaatgttctaggtcagtgtgtatattttagatggaacaaaagaaaaaagagaatttctattgtgcatacatttgagggctgttaaggaagttgctttcactcatacaccaggtattaagtgcttactgtgtgtcaggtaccaagcatacaaatagtgttgaatcagagaggaggttcctgcctcatgacatagcatttaaaaattatgagataaaggtagtgaaaataatgtgagagtgcgtatctgcgatttggtagagggrttattgtccctttggattgggtggttagggaagactttctgaggaggccagtaggctggaaagagtttagaaattagtttggagggctaatcaggggtcacattctgttaagcctaataggctgtgatgaagaatttgatttttacgttaaggaagctgttataaggtagtttgtgcttaaataaattacttttaaagaaaccctaggacaaaataaacaagtcggatttcatatcgcctaagtctgatactaccttacctgtccatttatgtggctggttcacaaaggcactatgcctc

SEQ ID NO: 109511 - DNA, 601 bp, Human
cctaagtctgatactaccttacctgtccatttatgtggctggttcacaaaggcactatgcctcagagatctcacatacagcttgtgtgtgcctatttttagttactcagttgcataagttctaattcttgctagcacattttataaaaccaaatgttaagatagagtatactgtaaagttcctaaaaaagatgtatgtaaatgcaaaaccatcagtttctcttgtataaagcacatgtggatagtgtttttgtttgtgcaggcatcattcagtttatgtattgtttagatatgtgtcagtsagaaatactaatcagctggtggtctagcaatacagtcaaagtaatgtaggctggatccgtgtaggaaatgttaataatgtacttaataatgtacttgtttttccagtattttacttgagtcatggcatatatttgagattatttctctgagtatggactttttctccctcgtttattccttttagggcaaaataatatgttggtaatagaattttgtataggtccacggtacctgtttagagagcttctaatggtatttactgtttgttaatatttatttttgttcagtttttctacttc

SEQ ID NO: 109512 - DNA, 601 bp, Human
caaaaagtggatattgattacttgttcatcaaattttcagtttttaaactattctgttatttgttcctgtgttttatgggcagaattattaagtgctgtgattatatcttacatacaaaaggaggcaggattacctagaggattactccatctctactaatagagaaaggacaaaaaagaaagtatgaaatctagttggatgtatgtagattggcttagtgaaaaaagattctctaaattccagatcctctgtcctttccttattcttttatctttctatatagaggttataagcagagtyatgccatgtggtttattctttttatcctttttatgaaaataaggttttctccaaataaaggtgaatatccatttcaacaagtttccactccaatttgctgtccccctcaaggattactgatataatactgattcttacctttccttttatatatgagtaattgggaatgagtatggaggtttcctatttttgttattcataactgagtttgttaaattgctagccctgtatatatttattatcatgagttggctgctgtgctggatagctgctatctgcacttctcactccagtcttttc

SEQ ID NO: 109513 - DNA, 601 bp, Human
tattctgttatttgttcctgtgttttatgggcagaattattaagtgctgtgattatatcttacatacaaaaggaggcaggattacctagaggattactccatctctactaatagagaaaggacaaaaaagaaagtatgaaatctagttggatgtatgtagattggcttagtgaaaaaagattctctaaattccagatcctctgtcctttccttattcttttatctttctatatagaggttataagcagagtcatgccatgtggtttattctttttatcctttttatgaaaataaggttttytccaaataaaggtgaatatccatttcaacaagtttccactccaatttgctgtccccctcaaggattactgatataatactgattcttacctttccttttatatatgagtaattgggaatgagtatggaggtttcctatttttgttattcataactgagtttgttaaattgctagccctgtatatatttattatcatgagttggctgctgtgctggatagctgctatctgcacttctcactccagtcttttccctgctctggctccaagcagctggtctgtctggatatacaaatgggctt

SEQ ID NO: 109514 - DNA, 601 bp, Human
agttggatgtatgtagattggcttagtgaaaaaagattctctaaattccagatcctctgtcctttccttattcttttatctttctatatagaggttataagcagagtcatgccatgtggtttattctttttatcctttttatgaaaataaggttttctccaaataaaggtgaatatccatttcaacaagtttccactccaatttgctgtccccctcaaggattactgatataatactgattcttacctttccttttatatatgagtaattgggaatgagtatggaggtttcctatttttgktattcataactgagtttgttaaattgctagccctgtatatatttattatcatgagttggctgctgtgctggatagctgctatctgcacttctcactccagtcttttccctgctctggctccaagcagctggtctgtctggatatacaaatgggcttcttgtccctgctttctagttgggttcagctggtggggaacattttcagctgattgaaggaaaggaggagagagaggttaggatttttacttttcatgacttcttcctgtgggatttctgtagcctggccgcatccttccattga

SEQ ID NO: 109515 - DNA, 601 bp, Human
aaataaaggtgaatatccatttcaacaagtttccactccaatttgctgtccccctcaaggattactgatataatactgattcttacctttccttttatatatgagtaattgggaatgagtatggaggtttcctatttttgttattcataactgagtttgttaaattgctagccctgtatatatttattatcatgagttggctgctgtgctggatagctgctatctgcacttctcactccagtcttttccctgctctggctccaagcagctggtctgtctggatatacaaatgggcttcttrtccctgctttctagttgggttcagctggtggggaacattttcagctgattgaaggaaaggaggagagagaggttaggatttttacttttcatgacttcttcctgtgggatttctgtagcctggccgcatccttccattgaagtttccagttcctatcaggcagctgacatttttctttcttcccctgctttactgccaatgggtagtgatatgccctgctgttactaaccctgggatataacactctcacttgtgatttccttacaacccacctatgcttcgtaacagtctccttattaa

SEQ ID NO: 109516 - DNA, 601 bp, Human
ttagttcttccataatatctggctttgagtattgccagtttattgaacacttaatatggcacagcccattatttgaagcattatggggaatccaaaagtaaatgagacacatgctccgtgattctactactaggcagtttggaatgagtttcctgtgagagctacaaaatgctagaagttcagaggagggagagtgctctgtcaagaccactatgattgtgtctgcagcaggaatgaagggagatctacagcttcctgtattttcctggtaagaccacccttcccagtcattgcttatttyatcactccatagcccatcactgcaaaccacttaagagaccaggcccaaaagtaatataactaatacaattttttttgttgttttttgagacagtcttgctctgtcacccaggctggagtacagtggcacgatctcagctcactgcaccttctgcctcccgggctcaagcaattctcctgcctcagccttctgagtagctggaattacaggtgcatgccaccatgcccggcttatttttttgtgtgtgttcttagtagagacggggtttcaccatttcgtccaggctggtctttacctcct

SEQ ID NO: 109517 - DNA, 601 bp, Human
aggcaaggaaagatgaataaaattacaggtagaaagtaagtttccatctggtggcctagatgttactaaagcattggttttcaaactttagcccacttcagaataacctggaggacttgataaaacagattgctgggttctacctagagggactgatttcacatgtcttgggttgctcctgaaaatttgcatttccaacaagttcttagttgacactgatgttgcttgctgatttacggaactgggaatcacatattgagagttacttcacttgagtaagaattcaactgtcaagagtgtyaagattggttaggattttgatctataaatataggaaatagctgctgtggggcaatataataggaaattagagccgattaataactttgagggactttgacagtgagacagtttgaatttgtagaggactcaagcagctatttttaatgacttttttctctagcagtgtgaccttccagagagcaggaacagaaccacagcagttagtaaacaattttgagggaatcctgcaggctgcttatgtcaaatagtttatcatcaagcactccatctttgctttgcgttacgagtgccaagatgg

SEQ ID NO: 109518 - DNA, 601 bp, Human
ggtttctgcctgaggagagtcccatgtagttctttgtaagtggctaaatattggacaagctgggtctcttaaaggtctgtagtatttctggcagtaagttgtactaatgttcctggatgtctgtacttctcaggcgttgccagtgaaatgttttcataatggattgtgccttactctagttctcactcgttttaactgtcacttcctaaatgactttatagtatctgtactgagcctggaataggaaggaaccacaagaaatatatatatagacagacagacacggagtctcactctgtcrtcaggctggagtgcagtggcgcaatctcggctcactgcaacctctgactcccgggttcaagcgattctcctgcttcagcttctggagtagctggggttacaggcatgcgccaccatgcccagctatttgttttttctgtatttttagtagaggtggggtttcaccatgttggccatgatggtctcgatctcctgacctcatgatccgcctgccttggcctcccatagtgctgggattacaggcgtgagccaccacgcccgacccacaagaaatgttttgaaacagatttggggacatgat

SEQ ID NO: 109519 - DNA, 601 bp, Human
atatattttcattgtgcaaccctttgtaatgaatccactgatctgcttttcatcgctgtagactggtttacattaaaaatttaaatgaatggaaatatgcagtatatacgttttggtgggggggtgcacatgtttctttcagcataatcttgaggtttattcatgtttcttgtattaatggttttctccttttaattgctgaataatgttcttctttggatattctcccatttgtttattcacttgtttatgaacaattgggtgatttccagtttggggttattatcagtaaagctgctayaaatatttatgtacagtctgagtgtggaaaagtgcttttatttttcttgaataaatacctagaagtagaatggctacatcatatgctaggtctatgtttaactcttgagaaactgccaaatgttttccaaagtgcttacaccattttacattctaaagaattccggttgttccacattgttaccaacacatgatgcagtcacactttgttttcagcttttctagtagtatatgcatgtctgtcttgtggagtctcagtgtcttttttttttttttttttttttaaagacagagttttgct

SEQ ID NO: 109520 - DNA, 601 bp, Human
agtgcaatgacatgatcttggctcactgcaacctccccttcctgggttcaagccattcttctgactcagcctcctgagtagctgggattacaggcatgcaccactacgcctggctaatttttttgtatttttagtagagatggggtttcaccattttggccagtctagtcccgaactcctgacctcaggtgatccgcctgcacccggcctcagtgtcattttaatttgcattttatgcatgactaatgatagtgggctgctgatatctttggtgaagtgtttgttcagaccttttgccccygctttaaacaagtgttggctgggcatggtggctcgcgcctgtaatcccagcactttgggaggctgaggcgggcagatcgcttgagctcatgagttcgagaccagcctgggcaacatggtgaaacaccatctctacaaaaaatacaaaaaattagccacctgtggtgctgcactcctgtagtcccagcttactcaggaggctgaagtgggaggatggcttgagcctgggaggcaataagctgagattgcaccactgcactccatcctgggtgatagagacagaccttttctcaaacaaaca

SEQ ID NO: 109521 - DNA, 601 bp, Human
ttggctgggcatggtggctcgcgcctgtaatcccagcactttgggaggctgaggcgggcagatcgcttgagctcatgagttcgagaccagcctgggcaacatggtgaaacaccatctctacaaaaaatacaaaaaattagccacctgtggtgctgcactcctgtagtcccagcttactcaggaggctgaagtgggaggatggcttgagcctgggaggcaataagctgagattgcaccactgcactccatcctgggtgatagagacagaccttttctcaaacaaacaaaaaccaaaacaagkgttgggttatctgtcttttataattgagttgtaggaattctttatatattccagtttcaagttcttatacattttacaaatacttttgatcagttggtgtcttgatttttgtactttttaagtttttttgaagaatagttttttattttgatgaagtctgctttatcagtttttctctttatagttctttttgtgctattttatttcatttctcttttggtttttctgaaagttaaatatctcagattctcattttttagctattggaccaaaaatgcataggagacagctataaagcta

SEQ ID NO: 109522 - DNA, 601 bp, Human
gaggcgggcagatcgcttgagctcatgagttcgagaccagcctgggcaacatggtgaaacaccatctctacaaaaaatacaaaaaattagccacctgtggtgctgcactcctgtagtcccagcttactcaggaggctgaagtgggaggatggcttgagcctgggaggcaataagctgagattgcaccactgcactccatcctgggtgatagagacagaccttttctcaaacaaacaaaaaccaaaacaagtgttgggttatctgtcttttataattgagttgtaggaattctttatatatyccagtttcaagttcttatacattttacaaatacttttgatcagttggtgtcttgatttttgtactttttaagtttttttgaagaatagttttttattttgatgaagtctgctttatcagtttttctctttatagttctttttgtgctattttatttcatttctcttttggtttttctgaaagttaaatatctcagattctcattttttagctattggaccaaaaatgcataggagacagctataaagctaatagtgtgtttgccttatatttgtgtttattgttacaattttaaagtgtt

SEQ ID NO: 109523 - DNA, 601 bp, Human
aaaattaattccaacaggttgtacatatagctagtaagccccttgctatggaatagggactatatctataaagctagtgttcagctactgagggttcttcatttttagctatatgagcacaatttaagttactaagactcattaactatgaacttttggttatttctttaatagtattgcatagtggatactttcatcttgggaggttaacaagatggggcagagagtcaaaatagagggaataaataatggggaagtaacgagcttcttgtttgcttgaggaactctgtttcaacccaakagaatctgttcagagcctgttttggtcctgagggaacatttgttgtggtttacagcagaggtctttaccttcattcaggagcacattagctctgacttgcatgctctatcaaaatttgtattcttactactttccaaaatagactacatttttctttttttttggagactgagttttgcttttgtcacctaggctggagtgcaatggtgcgatctcggctcactgcaacccccgcctcctgggttcaagcaattctcatgcctcagcctcccaagtagctgggattacaggcacccacca

SEQ ID NO: 109524 - DNA, 601 bp, Human
ttggttatttctttaatagtattgcatagtggatactttcatcttgggaggttaacaagatggggcagagagtcaaaatagagggaataaataatggggaagtaacgagcttcttgtttgcttgaggaactctgtttcaacccaagagaatctgttcagagcctgttttggtcctgagggaacatttgttgtggtttacagcagaggtctttaccttcattcaggagcacattagctctgacttgcatgctctatcaaaatttgtattcttactactttccaaaatagactacatttttctttttttttggagactgagttttgcttttgtcacctaggctggagtgcaatggtgcgatctcggctcactgcaacccccgcctcctgggttcaagcaattctcatgcctcagcctcccaagtagctgggattacaggcacccaccaccacgcctggctaattttttgcatttttagtagagacagggtttcgccatgttggccaggctggtcttgaactcctgacctcaggtgatccacctgcctcagcctcccaaagtgctgggattacagttgtgagccactgtgcccggcctaaaata

SEQ ID NO: 109525 - DNA, 601 bp, Human
cattcaaactataacgcaaatacctagaaacctcaaataattacagtttatgttattttttttctttcctgagaaacaggataataagagttatacaaatagagacttcaagtggtgggacaggtgaccatcattaagagggccaggacctgtatgtttttaatccagactgctgcacacctgtaacatacagctagcaagcagtgaaattggtttctaacatggaataagcactatccagatgcagcatctctaaaaatactcactgtaactatacttaaaacagtgatgatggtgttayccaaagggattttgaaactgttcttttgaccagttctcaaaatcactttctgtgttatactagaagacatcaggtatgaaaatagattaaaatacaccagtaaaatttaagttcgggaaagaagaaaatcctagaaggtgggttgatagtaaaaatatggtagcatattactttgccaggtgagtcttttgaaccaataactatcatttgattttatcctttgataagacttggctatactgaagaatttgtattagtagtatgctaaattatgggaaaatataacttcttgtattcatt

SEQ ID NO: 109526 - DNA, 601 bp, Human
tgggacaggtgaccatcattaagagggccaggacctgtatgtttttaatccagactgctgcacacctgtaacatacagctagcaagcagtgaaattggtttctaacatggaataagcactatccagatgcagcatctctaaaaatactcactgtaactatacttaaaacagtgatgatggtgttacccaaagggattttgaaactgttcttttgaccagttctcaaaatcactttctgtgttatactagaagacatcaggtatgaaaatagattaaaatacaccagtaaaatttaagttcrggaaagaagaaaatcctagaaggtgggttgatagtaaaaatatggtagcatattactttgccaggtgagtcttttgaaccaataactatcatttgattttatcctttgataagacttggctatactgaagaatttgtattagtagtatgctaaattatgggaaaatataacttcttgtattcattctcatacatcttttatctctcccatttacttgaaagcagttgtttgtgattattatgtagtttagtgacagtgaacacttagttaacacgtataccaggaattgttctcagtgct

SEQ ID NO: 109527 - DNA, 601 bp, Human
aaagctctcacataatcccacacctagaggtcaggattgcctatgtttggacattattatatccttgctacctctcctttcttgactcgcctcctcacataaatcatgtgtttatatgactggaatcaaatctgaaagacctgtgaagtttcctctttccatgtcaaagcagagtagctatgagtattgtattatcgtaaattttttttccttgatagatgttgggtttgtttcccagtttttgtgaaattataaagagaggactgtggttaacatccatgtgtacatgcatctgtatacrcttaccaattcttaaggatgtttctggaagtggcacttctggtgcacaaagcacacctatttatatattttagtaggtagcaataaaaaattgtaaagttcacacttagctcataggtgaataaaaccttaatttgcatttttgtcaggttaaaagtgttttcatttttgtgtctcctgtcttctgtgaattgcttcttttgttcatttaaaatgggatgatcttattcttacagatgtaataagcctttatattttaggctgttaactgtaatattacaaatgttttcctacctcatct

SEQ ID NO: 109528 - DNA, 601 bp, Human
gtgttgctttttaatcacagaagagattatatttaatgtcggttggcatgacctctttccgtggaaaaatggggaaaggatgtaatgtctattttttattctttatgaaattgaaaatattcaaaagtaattggatactctaacgtttatgtgctaatcactcatggctaatcttgtttcatttgtcattccactcactgtcatattattttgaagcaaattttagacatagtattagtttatccttaaatattgtgtatatcaatctataaaacatactttttttgttaaatataaccayattagtagcatcattccctaaataatagtagtaataataattcattaggattcaaatgttcattatagttcagatttttccatacacatacatacgtacatatgtacatacatgcatatatacatacatacagtttgtttgaatcagattttcaacaaggtccacagactgcaattgtgagacatgtctcttaggtctcttagttcataagatttttcctgtattccttctttttcctcctctgtaattagtgaagaaatttgcttatttgtcctatacagttttcagtagtctgaatta

SEQ ID NO: 109529 - DNA, 601 bp, Human
tggtgccctgtaacaagttcctatgttctatttcttgttattaggttgttggatccagagacttaatcagttacaggttcttcctattaggaggatgggtggctggggatattcttactacttgggatttaagaggcatgtaattttggattgtgtttttataatgttagctcttggtgctcagtacccgagtccattgcataaaaataatgatgttctgaatttattccttcacttattagctgaaatactatttaaaaatctttatctggtggcatgatttgtttaggaaagtcagaayacatgattcttttccatcagatatcagaataatgagttgatttcctagcattttataatggtgacttttttctttagtatcattatgacttcatagattaaaacatttgctacatctcagtttgctgtcattattatccttagtagtactcaaattagcccaccttaggagtaggaacattgtgaggttggttcctatagatacaactcattcattcattcatttatttgaggtggagtctcgctctctcgccgaggctggagtgcagtggtacaatcttactgcgacctccgccacctg

SEQ ID NO: 109530 - DNA, 601 bp, Human
ggtttagattcatttcctaacagcttggtgatttcttgagtctttacagttgcttctttatgcttaaacagtgtaaaagcatacatagtatttgtgttggaaatgcgtatggaatctattttggatgccagtaagctgtgatgtttatatcatggaaagtttaccagtctgcattttgagtgattaaataagtatcaaaccaaatgtagaacattaatttaggaatttagtcattttatagctttattttgataatttaaaactttgctttatattattttggcacatgtgtatgaggtattggctaaagcttactcttttatttgtcatagattatgtaagttaaattatggacaagaaaaattcaagactgtatctttgtaaaagatgtatttcacaattttatgagcataacagaatccagtgctgatagaatggacttcctgtttgtattttagaacttactttgccttattttacttacctgtgagattgtgatggtttttcgttttctttcaatttgatgacctggcttctttttggataatgataatatgaagtatattatacataatcacactccaaaatatgctgtttggga

SEQ ID NO: 109531 - DNA, 601 bp, Human
gccagtaagctgtgatgtttatatcatggaaagtttaccagtctgcattttgagtgattaaataagtatcaaaccaaatgtagaacattaatttaggaatttagtcattttatagctttattttgataatttaaaactttgctttatattattttggcacatgtgtatgaggtattggctaaagcttactcttttatttgtcatagattatgtaagttaaattatggacaagaaaaattcaagactgtatctttgtaaaagatgtatttcacaattttatgagcataacagaatccagtgstgatagaatggacttcctgtttgtattttagaacttactttgccttattttacttacctgtgagattgtgatggtttttcgttttctttcaatttgatgacctggcttctttttggataatgataatatgaagtatattatacataatcacactccaaaatatgctgtttgggatagtttgaaaaattgtagaaaaacttctctccagccacatttctttctagcaagcaataagggaaccttttgttttaaatattaataaaaacattttctaaggacatgctttagaaggaaactggc

SEQ ID NO: 109532 - DNA, 601 bp, Human
aaccttttgttttaaatattaataaaaacattttctaaggacatgctttagaaggaaactggcgtaatttttatatgtctcatttgtgtatttgctttaaaaaggagtcctaggatgacatggatctcttttttcaggaaaggttgtactgagaaggataagaaattttgggtttcttttgcttaagttgttggagttgtggtagatttcccttctcctgtgttacctgagctgcaaaatcccagaaaacatggagaacctctttccccgtaaccctccagataagaagcgatttcccccmtgaccagataaggaccccaactctcttttttcacctcttgcgtttgagtgctggtaaaaagagttggtgggagagccaataaatagagtaaaacttgtgtaatttatgaatatattctggttttatctccattttaggattattgaaatgtaatgcaaaattactgataaccaccaaattcttttgtaaatttgcaacttatttcttgttccctttgtttttctctctttaaatgcagtttgtgagtcttcacaggtaatgttggacttttctttgtagccctattggccaaaaatggtt

SEQ ID NO: 109533 - DNA, 601 bp, Human
ttcaacagctcccttaaaatgcactttgaaaacaatagccatcatttaattgtaggatatgcagtaaaggaaaagaatcttatattttgatcagattgatagaaagtggttaatcttaactgttttgttccttgtctgaagaaagaatgaaatagctacatgtaggctgtgagtcaggctgcctgagaggagttgttttttagtctgaagttcttaattacaaatgactgctcagattaccttttttttctttactttatttgacttttggtttcattacaggagaataaaatgtatatgyctgttacaagaagaaactactgaattactcatttatttttccttctactatggttgataccatcttttgacgttttgccttggagtagtttttagttaaatactaggtcatggtttaactgaaatgtctttttccagagcctttccaagcattcagaatccttagttttccatatatagttcagaaagtcattgattgccaatttcttctcatcctgatattcttgttaattttaaaaaaaattaggtgaaaattttatcctgaacagtttgatacgactgatggaaccattaatggcaa

SEQ ID NO: 109534 - DNA, 601 bp, Human
gaaagtggttaatcttaactgttttgttccttgtctgaagaaagaatgaaatagctacatgtaggctgtgagtcaggctgcctgagaggagttgttttttagtctgaagttcttaattacaaatgactgctcagattaccttttttttctttactttatttgacttttggtttcattacaggagaataaaatgtatatgtctgttacaagaagaaactactgaattactcatttatttttccttctactatggttgataccatcttttgacgttttgccttggagtagtttttagttaaawactaggtcatggtttaactgaaatgtctttttccagagcctttccaagcattcagaatccttagttttccatatatagttcagaaagtcattgattgccaatttcttctcatcctgatattcttgttaattttaaaaaaaattaggtgaaaattttatcctgaacagtttgatacgactgatggaaccattaatggcaaatgataattattcacatatgccagtctggttcattagcattgttttgtagggaaactttttcttttgtagataatttagtgtgacttaaaagccagaagcc

SEQ ID NO: 109535 - DNA, 601 bp, Human
tttttctttactttatttgacttttggtttcattacaggagaataaaatgtatatgtctgttacaagaagaaactactgaattactcatttatttttccttctactatggttgataccatcttttgacgttttgccttggagtagtttttagttaaatactaggtcatggtttaactgaaatgtctttttccagagcctttccaagcattcagaatccttagttttccatatatagttcagaaagtcattgattgccaatttcttctcatcctgatattcttgttaattttaaaaaaaatkaggtgaaaattttatcctgaacagtttgatacgactgatggaaccattaatggcaaatgataattattcacatatgccagtctggttcattagcattgttttgtagggaaactttttcttttgtagataatttagtgtgacttaaaagccagaagcctttagtcttcatgtgagcattcaggctgaggtatagtatttgtggatgtgtgttgctgggtggggtcattattgggttcagaaaaagtcatcttctacagaaagacgcatgaagctagaaataaaattcacctactgaatttg

SEQ ID NO: 109536 - DNA, 601 bp, Human
aaacaaagcatatctgtcagatgaatttgctgagggctgctagtttgcgtcctatgatctatcttcctgtctcatgaatatgtgtttttctttgaagaggaatgacaactattagcaagactcaggctcattaatttggggtcttaagttccacactaagttgactcctttgtactttttgaaatacgattattcaagaaacagctttaccattgtgttacattctgcttagcttggatttctttgtacagagattgcctgagtgtccagacagtaatttttgtattactgaatttattastgttgaatttgcaaagttgtgttttccaaagtttcattctgcagcacttataatcgattgttgaagatagtgaatagatcagtacctagaagtaaaaatggatacaagtactacaaagtcctgtcttgcctatttaataggtattctattaatgtttggggctctgaattatatgctataatttctatgctagcattcattgtttcttaaattttaatgagtttaaaattgcaggcttctaatagaatatgaatatcttcaatttatttggtgatcttgtcctttttttaaatttttata

SEQ ID NO: 109537 - DNA, 601 bp, Human
cattgtgcttaaatgtttactttacaaaacaaaactctctaaatgtagttttgaaaaattagtctaaacttaaattctgtaattatctgactttaaaatggttctatcttcaaaagctctggggaaacctgaactctttatttttttctatgttcatttgtttttctgcattatttggtatattgtctgtttgacaacatccattctcctccttttcctgcgcatgaatcttccttatatctaccatgcacacaggacagaggcatgacactactataagtatttctctctctctgtctcttttttttttttttttggcaatcctcctgcctcaggatggaatacaggcacatgccaccactcccagctaaattttttttttttttttggtagcagctgggtctcactatgttgcccaggctggtcttgaactcctggcctcaagttatcctcctgccttgacctcccacagtgctgggattacaggtgtgagccactgtgcccagccagtactataagttttttaaggttcatagaatccattgatttaggctgacattatacctcttaataaaggaagctggttgcttctgtagagcta

SEQ ID NO: 109538 - DNA, 601 bp, Human
aattctgtaattatctgactttaaaatggttctatcttcaaaagctctggggaaacctgaactctttatttttttctatgttcatttgtttttctgcattatttggtatattgtctgtttgacaacatccattctcctccttttcctgcgcatgaatcttccttatatctaccatgcacacaggacagaggcatgacactactataagtatttctctctctctgtctcttttttttttttttttggcaatcctcctgcctcaggatggaatacaggcacatgccaccactcccagctaaattttttttttttttttggtagcagctgggtctcactatgttgcccaggctggtcttgaactcctggcctcaagttatcctcctgccttgacctcccacagtgctgggattacaggtgtgagccactgtgcccagccagtactataagttttttaaggttcatagaatccattgatttaggctgacattatacctcttaataaaggaagctggttgcttctgtagagctaaaaatgtaagtaattttcggggcaacaagcctgagaaaaatttttatatgtttattagacaagagtagatta

SEQ ID NO: 109539 - DNA, 601 bp, Human
ctactataagtatttctctctctctgtctcttttttttttttttttggcaatcctcctgcctcaggatggaatacaggcacatgccaccactcccagctaaattttttttttttttttggtagcagctgggtctcactatgttgcccaggctggtcttgaactcctggcctcaagttatcctcctgccttgacctcccacagtgctgggattacaggtgtgagccactgtgcccagccagtactataagttttttaaggttcatagaatccattgatttaggctgacattatacctcttartaaaggaagctggttgcttctgtagagctaaaaatgtaagtaattttcggggcaacaagcctgagaaaaatttttatatgtttattagacaagagtagattaatgatcacttcagtcaaacttggaaatagttttctgtgcaggaattggtgtttaaacattgaatactctttccataaattgtgctgttttcgtaaactcatggaacccttatttagatttttggctgattacttttctttcaacttttaactctgtgtattgtcttaaagccttttctttcaattttcttttttgttt

SEQ ID NO: 109540 - DNA, 601 bp, Human
aaatttgatcagtgtatattttttttagaatgtataaaaacctgcttgatagaaagtgttcgtgtttttttaatagaagttcatgcattctgttttaaaattatctgtagttgtcttttctatcactttaatatataactgtgtatatatactgttttgatttctgaaactaaagtttagaaataaagaactaatatcccaaaaatgtaggatcaaaagcatagaatgaaatatactggttttagtcttttgatagtactttaaggaggtctctataatagagaacagattttaaagatgkaacaggatatatataatagtggccattaggtgaattgtggtttataaagtcaaaaattgctataatgtattatgtactgtaattttaatgccttgaactatatggtacggcatgattttacagtggacatcttgatattgtatacacattaaactattatgtggaattaaatagtagctcttcaagtgaagtaagtataaatgtcaacgaccatcttttaaggaattttggatcaccgtaacacattttacacattgttaatcgctacccctgggattgtttaaactgtttcgtcatgga

SEQ ID NO: 109541 - DNA, 601 bp, Human
gaagttcatgcattctgttttaaaattatctgtagttgtcttttctatcactttaatatataactgtgtatatatactgttttgatttctgaaactaaagtttagaaataaagaactaatatcccaaaaatgtaggatcaaaagcatagaatgaaatatactggttttagtcttttgatagtactttaaggaggtctctataatagagaacagattttaaagatggaacaggatatatataatagtggccattaggtgaattgtggtttataaagtcaaaaattgctataatgtattatgyactgtaattttaatgccttgaactatatggtacggcatgattttacagtggacatcttgatattgtatacacattaaactattatgtggaattaaatagtagctcttcaagtgaagtaagtataaatgtcaacgaccatcttttaaggaattttggatcaccgtaacacattttacacattgttaatcgctacccctgggattgtttaaactgtttcgtcatggagccacaaaagtttgaaatcctcctagtaagatactttgcatcttgtttgcagtctgttcagggagaactagtgaa

SEQ ID NO: 109542 - DNA, 601 bp, Human
tcaaaagccattgccagtcattgattttaatgttgtaagattgcttataggacatttaatttaggaagaaatgatcatacagtctatgagagggtactaggaaaagcttagaaatttcaagtgctctgtttattctgttacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcrgacaaatatgcagcacttgctaatttagacaatatcttcagtgccgggcaaggtatcaagctttaagcaaaacaaatacaaatttgtgttaaacagtgctcttaatttggttgtatttattaaaatctgaacatgctacacttttctcagttgttgtatagaaattttgtctgcactgtcattttgagtaaaatgttcacttgacacattttagacctgaaatatcaactacaaaactgaagacatagggactgatttgtaaactttcagtcttactagttgagaaaaattttattttgt

SEQ ID NO: 109543 - DNA, 601 bp, Human
tttggttgtatttattaaaatctgaacatgctacacttttctcagttgttgtatagaaattttgtctgcactgtcattttgagtaaaatgttcacttgacacattttagacctgaaatatcaactacaaaactgaagacatagggactgatttgtaaactttcagtcttactagttgagaaaaattttattttgtcctagaaggcgtgctttacttttctttggctataaagagccaagaaaccccattggcagagctgaatggaggattatttggtggtttctgtaatatatttacttcraacaattttccgttaacatcttggtgggttttttatatttaaaaaaaaaaattcatgaattttacagtatagtcttgtatccagttttatcttaaggctagtagcctctacaaatgcatgtggcactggtgaatagcaggtgtgtgttgctaaatggaattctccattctgatctctgggcctgttttcctcctctccaaaatgaggataattctaagcattaaactcatggagttgtgttctaagtattattgcatgttaaggcatatagaacagtgcctagcacatagtaagtcctca

SEQ ID NO: 109544 - DNA, 601 bp, Human
aaaacaaaaaacacatgttaacactgtgaaattatattttgaggtaccctttgatcctagcactttgggatgccgaggtaggtgggttgcttgaagcccaggagttttgagagcagcctgggcaacatggcgaaccccgtttctacaaaaaataaatggtggcagacacctggagtccttcctagctactcaggaggctgaggtgggaggattacctgagcctaggaggtcgaaattacagtgaactgtgattgcgccaccacacttcagcctagctgacagagtgagacttctagctcamaaaaaaaaaaaaaaaaaaaaggaggtacccttattgcataatagttctatgtgaaattcggaaagttttatcagtatatttctctttttgtttgttggtttgttttagacagattctcactctgtcacccagactggagtgcagtggcttaatctttgctcactgcagcctctacctcccggattcaagcgattctcatgactcagcctcctgagtagctgggattacaggtgcgtgccaccatacccggctaatttttgtatttttagtagagatggggttttgccatgttgaccagac

SEQ ID NO: 109545 - DNA, 601 bp, Human
cattagttgatgcagtttcttcctagcatcgatggtctttacagtttggcatgtttttgcagtgactggtaccggttgttctttctatgtttagtacttccttcaggagctcttgtaaggcaggcctggtggtgacagaatctctcagcatttgcttgtctgtaaaggattttatttctccttcacttatgaagcttagtttggctggatatgaaattctgggttgaaaattcttttttttaagaatgttgaatattggccaccactcttttctggcttgtagagtttctgctgagagatmccctgttagtctaatgggcttccttttgtgggtagcccgacctttctctctggctgcccttaacattttttccttcatttcaagcttggtgaatctgacaattatgtatcttggcgttgctgttctcagggattatctttgtggtgttctctgtatttcctgaatttgaaggttggcttgccttgctatattggggaagttctcctggataatatcctgcagagtgttttccaacttggttccattctccccgtcactttcaggtataccaatcagacgtagatttggtcttttcacata

SEQ ID NO: 109546 - DNA, 601 bp, Human
tgaatttgaaggttggcttgccttgctatattggggaagttctcctggataatatcctgcagagtgttttccaacttggttccattctccccgtcactttcaggtataccaatcagacgtagatttggtcttttcacatagtcccgtagttcttggaggctttgtttgtttctttttactcttttttctctaaacgtctcttctcactttatttcattcatttgatgttcagtcactggtaccctttcttccacttgattgaatcagctactgaagcttgtgtatgcttcacatagttctygtgccatggttttcagctccatcaggtcatttaagatcttccctacgctgtttattttggtttgccattcgtctaatctttcttcaaggtttttagcttccttgcgataggtttgaacatcctcctttagctcggagaagtttgttattaccgatcttctcaagcctacttctgtcagttcgtctaaagtcattctctgtccagctttgttccattgctggcgaggagctgcagtcctttggaggagaagaggcactctggtttttagaattttcagcctttctgctctggtttctcccc

SEQ ID NO: 109547 - DNA, 601 bp, Human
cagaacagcaaatattgcaaaacagcaaatgttgctgcctgatccttcctctggaagcttcgtctcagaggggcacctggctgtatgaggtgtcaatcggcccctactgggaggtgtctcccagttaggctactgcgggggtcagggacccacttgaggaggcagtctggccattctcagatctcagactccatgctgggagaaccattgctctctacaaagctgtcagacagagacgtttaagtctccagaagtttctgctgccttttttcagctatgccctgcccccagtggtggagtytatagaggcaggcaggccttgttgagctgcagtgggttccacctagttcaagcttcctggccactttgtttaccaagtcaagcctcagtaatggcgggcgcccctcccccagccttgctgccgcctcgcagttcaatcaagactgctgtgctagcagtgagcaaggctccatgggtgtgggacctgctgagccaggcgcgggatataatcttctggtgtgccgtttgctaagacctttggcaaagtgcagtattagggcgggagtgtcccgattttccaggtaccgtctgtcacagcttc

SEQ ID NO: 109548 - DNA, 601 bp, Human
cgcgggatataatcttctggtgtgccgtttgctaagacctttggcaaagtgcagtattagggcgggagtgtcccgattttccaggtaccgtctgtcacagcttctgttggctaggaaagggaattccctgaccccttgcacttcccgggtgaggtgatgccccgccttgcttcggcccacactccgtgggctacacccactgtccaaccagtcccagtgagatgaacccagtacctcagttggaaatgcagaaatcacccttcttctgcgtcactcacgctgggagctgtagactggagcygttcctattctgccatcttggaactcccttctggggctgtagctttttaaaaaactgtaatattacatagtaactctcattaggagattagcctattgtggcctaattttcagattctatgatatttagtgtttttcccccctcagagcccttaaatctaattaatagaggttaaaataatttttaaatagtaggaaatttttataactcttaggtctctcctttgtcactgaatggatagtcattatttcctaccatttattttaatgaatgaatggtttcaaagattttttttcccta

SEQ ID NO: 109549 - DNA, 601 bp, Human
gatatttagtgtttttcccccctcagagcccttaaatctaattaatagaggttaaaataatttttaaatagtaggaaatttttataactcttaggtctctcctttgtcactgaatggatagtcattatttcctaccatttattttaatgaatgaatggtttcaaagattttttttccctaaggaaaggtacttaccaaaatgcagagcttattggatggcatctggccctcagatctttgtttattacctaggtggaaaccaatttgctaagattaatgaatttgccttaaaggttcaaarttcagtaatggctgatctgatattaatacccagaatgcttctgaaccaacactgtttttgttccagtacagttgcctccatatttatacttcagtttcacattgatgaaacatacacaaattaacattatgcactattccttatatctaaatacttagtaggctcacttcacttgcctagcatactcaggaagtgaggattaatacaaaaaagggttggaggtagctgagcaaaagcaaagaaaaaaccctaagtagaaagttaccttgggctgtgaaggatatattttgtttatagaat

SEQ ID NO: 109550 - DNA, 601 bp, Human
cttgggctgtgaaggatatattttgtttatagaattgctgctgatttgctctccttgtgctctttccctctcaatttactcttaatatttggacatctctaatatttaataatctacaattggtattttaaaaaggagccagaaatgaaaattgttgccaatgtggtaatcaaaacaagaaagacaggaaagttgtaaaaattaacacaacagaaaaattaagcttaatagcagtctggagaaaatatttgcaaatcctacatctgataagggacttgtattcagaatgtgcaaagaactygtaacgactaaataataaaaagacaccccaattaaaaagtgagcaaaatatttgaatagacatttctctaagaaggtatacagatggccaataaaagaaaagacagtgatgaacaatgtaaggaggtagagaaaatagaaacctcgtatattgcttgtgggaatataaaatggtacaaccccttggaaaacattttggcagttcctcaaaatggtcatcatggagttaccatataacctaacagagtgccactattaggaatataccaaagaggaatgaaaacatagatctgcacaaaaa

SEQ ID NO: 109551 - DNA, 601 bp, Human
atttggacatctctaatatttaataatctacaattggtattttaaaaaggagccagaaatgaaaattgttgccaatgtggtaatcaaaacaagaaagacaggaaagttgtaaaaattaacacaacagaaaaattaagcttaatagcagtctggagaaaatatttgcaaatcctacatctgataagggacttgtattcagaatgtgcaaagaactcgtaacgactaaataataaaaagacaccccaattaaaaagtgagcaaaatatttgaatagacatttctctaagaaggtatacagatrgccaataaaagaaaagacagtgatgaacaatgtaaggaggtagagaaaatagaaacctcgtatattgcttgtgggaatataaaatggtacaaccccttggaaaacattttggcagttcctcaaaatggtcatcatggagttaccatataacctaacagagtgccactattaggaatataccaaagaggaatgaaaacatagatctgcacaaaaatttgtacacaaatgttcataccatcagtatttatcatcgctaagaagtagaaacaacccaagtgcccgtcaactgatgaaaccaaa

SEQ ID NO: 109552 - DNA, 601 bp, Human
aaaaagtgagcaaaatatttgaatagacatttctctaagaaggtatacagatggccaataaaagaaaagacagtgatgaacaatgtaaggaggtagagaaaatagaaacctcgtatattgcttgtgggaatataaaatggtacaaccccttggaaaacattttggcagttcctcaaaatggtcatcatggagttaccatataacctaacagagtgccactattaggaatataccaaagaggaatgaaaacatagatctgcacaaaaatttgtacacaaatgttcataccatcagtatttaycatcgctaagaagtagaaacaacccaagtgcccgtcaactgatgaaaccaaatgtcgaatagtcatacaatgacaaattacttgataataaaaagtgatgaagcattgatacatgctacaacatggatgaaccttgaaaacattctgctgagcagaagaaactcgtcacaaaaggccacatatttgtggtggccatttgtatgaaatgtccagaattggaaagaaaaagtagatcaatgattgccagggggtagggttttagtagtggtggggcagcatgggaagtgacagctgataggt

SEQ ID NO: 109553 - DNA, 601 bp, Human
gttcataccatcagtatttatcatcgctaagaagtagaaacaacccaagtgcccgtcaactgatgaaaccaaatgtcgaatagtcatacaatgacaaattacttgataataaaaagtgatgaagcattgatacatgctacaacatggatgaaccttgaaaacattctgctgagcagaagaaactcgtcacaaaaggccacatatttgtggtggccatttgtatgaaatgtccagaattggaaagaaaaagtagatcaatgattgccagggggtagggttttagtagtggtggggcagcatgggaagtgacagctgataggtatcacatttcttttgagggggatgaaaatattctaaaattagattctgatggtggttgtacatacctgtgaatatatttaaagaatcattgaattctgtaagtgaatgaattgtgtgtagtatgtgaactatatttcagaaagctgtaaaaagtctaaaaaaagtttagagcagttcaggaccagagcttggggggcatctttgttgcagactgaggtatagtgattaatattggttaacagtcactgttggctaaaagtcagtttttgccagtgcgttt

SEQ ID NO: 109554 - DNA, 601 bp, Human
catacaatgacaaattacttgataataaaaagtgatgaagcattgatacatgctacaacatggatgaaccttgaaaacattctgctgagcagaagaaactcgtcacaaaaggccacatatttgtggtggccatttgtatgaaatgtccagaattggaaagaaaaagtagatcaatgattgccagggggtagggttttagtagtggtggggcagcatgggaagtgacagctgataggtatcacatttcttttgagggggatgaaaatattctaaaattagattctgatggtggttgtacatmcctgtgaatatatttaaagaatcattgaattctgtaagtgaatgaattgtgtgtagtatgtgaactatatttcagaaagctgtaaaaagtctaaaaaaagtttagagcagttcaggaccagagcttggggggcatctttgttgcagactgaggtatagtgattaatattggttaacagtcactgttggctaaaagtcagtttttgccagtgcgttttgtgaaacatgtctcctgtaatgttgttagcaaaattctgtggaaaagtgttctatgtctaaatacatatgagaaatgctggaa

SEQ ID NO: 109555 - DNA, 601 bp, Human
gtctaaaaaaagtttagagcagttcaggaccagagcttggggggcatctttgttgcagactgaggtatagtgattaatattggttaacagtcactgttggctaaaagtcagtttttgccagtgcgttttgtgaaacatgtctcctgtaatgttgttagcaaaattctgtggaaaagtgttctatgtctaaatacatatgagaaatgctggaataaacacagtttaatcaatgtcattaatgcaagactgctctgagcctgtaaagtgctttaagataaagtagataaggccgggtgcagtkgctcacgcctgtaatcccagcactttgggaggccgaggcaggcggatcacgaggtcaggagatcgagaccatcctggctaacacggtgaaaccccgtctctactaaaaatacaaaaaattagctgggcatggtggtgggcacctgtagtcccagctacttgggaggctgaggcaggagaatggcgtgaacccgggaggtggagcttgcagtgagccgagatcacaccactgcactccatcctgggcgacagagcgagactccgtctcaaaaagaaaaaaaagaaagtagataaatataag

SEQ ID NO: 109556 - DNA, 601 bp, Human
cggatcacgaggtcaggagatcgagaccatcctggctaacacggtgaaaccccgtctctactaaaaatacaaaaaattagctgggcatggtggtgggcacctgtagtcccagctacttgggaggctgaggcaggagaatggcgtgaacccgggaggtggagcttgcagtgagccgagatcacaccactgcactccatcctgggcgacagagcgagactccgtctcaaaaagaaaaaaaagaaagtagataaatataagggccacattaatttttcacaggcccttctccctcagttaaccttttttttttttgtatttggaacacagtgacacttttttaagttagcaagaaagttacattcattgagtatttattgcaaagcactctaattcgttgttacatttattcttcacagcagctttgtgaagtatagatactattgtctctatccctccacctcatttgcaaatgaggaaactgaagcttataaaataaagtaacatcatgcagccagaaaatgacagaaccacaactcagaaccattcaattttttaatcattcttatgccaatttaaaaagtattctaattttaaatccatg

SEQ ID NO: 109557 - DNA, 601 bp, Human
cctgtaaataccgcttacctttctcttgaactagaatatttaataatttttcccttgtaatacttaattagttcatttgagttatttgtgtatttctagttaatgtgctgatttgtaaataaaacaatctagcattgttcatgcactctctcccaagacttggttttgatcctaaatgtagatgctggataatctcatatgatcctatgaatagcgtatttagatgtagcttatgatgcctacaaagcattttttaatgactgtaaaaaagttgatgcctatttgtttaaaaaattgattwcatcactgtttcttaatttgttatttattattctaatctcccctttattttaaacagtataaatattacaggtcatgaagatggttgaaattaaaagtcttattttgtgaatgtgtttttgttatgtattatgctacccccttagcaacagtacactcgaattttataactttttaatgaaacaagtatacttttattttaacaatagttatctataaattaattgacgttggtctctttatggctttccataaggcctttctggagcaatgcattctcaagtgtttcctcacgctcatt

SEQ ID NO: 109558 - DNA, 601 bp, Human
actcgaattttataactttttaatgaaacaagtatacttttattttaacaatagttatctataaattaattgacgttggtctctttatggctttccataaggcctttctggagcaatgcattctcaagtgtttcctcacgctcattttggtaggtggccacaattaatatctagatttgtgtggcaatttgtctacctgcttgtggaagcttctgctagtgttctggatccctgcatgtggaattaagtttttttccatgttttaaaatggagtgggcatggatgtgtggcattgggattrcattgtatttaaaattacatggaaatgtttttagtgatttatgtgtaaatgctgaaaagcattactgcttacctacatggtcatattagaatgttaatagccattttgattctttttcttgagtttgaattcatggtactttgagtgacgcctttttgatataccaaaccattttactgcattattccatggagtttggttttgcttaactgtattcaagttttgcttttaagtgctctcttaaagtgatttgtcaaagttacgtcggtgcattgtctgttatgaagccctcctgttacc

SEQ ID NO: 109559 - DNA, 601 bp, Human
ttttagcgaactattcttcagcggtttaaaatttttttttgcaggaacacatattatgttatgacagatacttcaggagataaaattttggctgttattttactgcatataacaaaacaaaactaaaaacaaaaatgtatactagtatacatattaattgcatgatctttaaaacacaagactactgtttagacttgaatttataatttgagaaattgtcttgggatttcaaacaacagctttagtagttagtttcattctggtcattgtgttttagaagaataaaatttctacaagttaygttaaactgtgtagcactaaaactcattaactttgttggaattttggaattaaccctgcctttaatgtacatcttagtatttttcaaggtaaatgatgtctttttacatttacaatgttgtgagaaactaaacatatcctgttgtatgtaactgatcagcccttctcttctgtcagcggcaacctttggcactgcatccatgagcatgcccacaggattcggcactcctgctccctacagtcttcccaccagctttagtggcagctttcagcagcctgcctttccagcccaagcagcttt

SEQ ID NO: 109560 - DNA, 601 bp, Human
attgtcttgggatttcaaacaacagctttagtagttagtttcattctggtcattgtgttttagaagaataaaatttctacaagttacgttaaactgtgtagcactaaaactcattaactttgttggaattttggaattaaccctgcctttaatgtacatcttagtatttttcaaggtaaatgatgtctttttacatttacaatgttgtgagaaactaaacatatcctgttgtatgtaactgatcagcccttctcttctgtcagcggcaacctttggcactgcatccatgagcatgcccacrggattcggcactcctgctccctacagtcttcccaccagctttagtggcagctttcagcagcctgcctttccagcccaagcagctttccctcaacagacagctttttctcaacagcccaatggtaagatctaacatttggcgagctgtaagttcattttatgtatcctttttatatcataatgttgtgtgcttgggcaggaagacttttctaaagaatactatagtattatctactgagtgtttacacaaaaataaaagcctttggtgatttggacctcagaaagctaagtgattttacaa

SEQ ID NO: 109561 - DNA, 601 bp, Human
ttaaaaatctgaaatatgggctgggcgtggtggcttacgcctgtaatcccagcactttgggaggctgaagtgggcggatcatctgagctcgggagttcaggaccagcctgaccaacatagagaaaccccgtctctactaaaaatacaaaattagccaggcgtggtggcacatgcctgtaatcccagctgttcaggaaggccgaggcaggagaattgcttgaacccgggaggcggaggttgtggtgagccgagatcgccattgcactccagcttgggtgacaagagcgaaattccatctcaaaaaaaaaaaaaaaaaaaaaatctgaaatatggaccctggaagagccataaataataaaaatatttcctacaaaatactgtgatgtttacatagaaatcattgtgttgtctgcacagcctgttccaaatagtcacaagctcgtctagtaatgaaattctataaattttagttattgagacaagttagaatgaaagagctgaatgaaagttctcttggccaggtgtgatggctcacgcctataatcccagccctttgggaggccaagacaggtggatcagtcgagtccaggagattgagacc

SEQ ID NO: 109562 - DNA, 601 bp, Human
ccattatgtgtgatccttttctgaccttttaaaaaattagttgcaaatcaaagcattgatagtttttaaaaaattagttgcaaatcaaagcattgacagtagatcagctattttataatatgaaacttatctgctttcttgtcaaaataacactttatgagaggccctaggaattagtgaacataaaagagaggtcttaagagtcagaagttttgtttgaatcacacgtgcttttctaagaccattctaagattcttcttagaatctattacaagaactgtttgaagtactggatatgaargacgtagcacagttcatgacacatagtagtttgatatagcttattgccaataacaaatattattgccaataatttaaaaaataattcttaaccaaaaagtctaattaaaaaaattaaattcagtttaatgtttttatattttgtacatgcactacttttgtctctttatttatttgtcttatgttttcctttagactggtgcaccaacaggacaatttccaacaggaagctcatcaaccaatcctttcttatagccttatatagacaatttactggaacgaacttttatgtggtcacatt

SEQ ID NO: 109563 - DNA, 601 bp, Human; identical to SEQ ID NO: 17806

SEQ ID NO: 109564 - DNA, 601 bp, Human; identical to SEQ ID NO: 17807

SEQ ID NO: 109565 - DNA, 601 bp, Human
agaagaatgactggtacagcaataccaagaccttaagttctagcacctgggtatatacttgtgctttcttttgcaggagatccagggcagcctggaccacctggagaacaaggacccccaggaaggtgcatagagggtcccaggggagcccaaggacttccaggcttaaatggattgaaagggcaacaaggtaggaggagggcctcaaaactggccaccagaagggcaggagacatgagactcctgctctgtgctttgctgcttaacatgggaactgtccagccacaagtcctgaccactrttcaatgagaaatacttcagaagtgtaaaccttgctgttatgggtttgttgcacacagtagtgtgtaccacctataaaggaagaaacttgaagttaatatagtgagttgctttgtgtcttttatgcaagaaaaatatgaatgctgaagacagagattggtgtgtgtttacatatatttatatacatattaaattctcagaaaacattttacctttaatattttcataaatatattaaagtggtaagtttatccttattattaaaatagggtaaatgtatgcaatgataccagtttaaaaa

SEQ ID NO: 109566 - DNA, 601 bp, Human
aaaagaggacttaaatgttgaataagattcagatgaacaaataaaattcttggcttaaaatctttccaaggctccctgtgctttgagaagtgaaacttcttggactgacatacaagtttattcaccacttgcacttggcctgtctctccagccacatgacatttatgtactcaataattaccttttacttaataatacctatggactaggcattttgctatgccttgattatacagaggtgaacaaagcagactttagtttcctagtcatgatgaaagttacggtttagtgggggaaagasacataatgggtccataaacattttccatttaggctaggtagtaagtatcttacgctttgtggctcacatatggtccctgttgcatattcttctttgcttttgtttttaacaaccttttaaaaatgtaaaaaccgccaggcgtggtggctcacgcctgtaatcccagccctttgggaggccgaggcgggtggatcatgaggtcaagagatcgagaccatcctggccaacatagtgaaaccccaactctactaaaaatacaaaaattagcgggcgtggtggcacacgcctgtaatcccagct

SEQ ID NO: 109567 - DNA, 601 bp, Human
atgagctttccagctgggcagaactggattcaaatccaagtgttattaactgattgacactgtgattctggcctttgacttacctaatactttataaattataattttaatacatggattgagaatagaatcatctagatgagaatactgtagtggataacactttgtctttactattaaaaaatgaagaggtatttaggctgctaattcttaaaatgttgttttaaagagtacatattaagatcattgctagtgttcattgaggaataacttatgccaggcactgtgctaatgcttgacrcatattatttcatttaatcctcttctttaagagacagaagcccaaatccgcccatgctcttaacatatatgctatatgctgtactacagtaatatgccatcggtttaaaccaggatgtggatgggtctgacaaaattttaacatgaatttttgatgcctggttttttgttttgggtttttttttttttttttgagatggagtctcgttctgtcgcccacgctggagtgcagtggcacgatctcagctcacttcaacctctgtctcccaggttcaagtgattttcctgcctcagcctccca

SEQ ID NO: 109568 - DNA, 601 bp, Human; identical to SEQ ID NO: 17808

SEQ ID NO: 109569 - DNA, 601 bp, Human; identical to SEQ ID NO: 17809

SEQ ID NO: 109570 - DNA, 601 bp, Human; identical to SEQ ID NO: 17810

SEQ ID NO: 109571 - DNA, 601 bp, Human; identical to SEQ ID NO: 17811

SEQ ID NO: 109572 - DNA, 601 bp, Human; identical to SEQ ID NO: 17812

SEQ ID NO: 109573 - DNA, 601 bp, Human; identical to SEQ ID NO: 17813

SEQ ID NO: 109574 - DNA, 601 bp, Human; identical to SEQ ID NO: 17814

SEQ ID NO: 109575 - DNA, 601 bp, Human; identical to SEQ ID NO: 17815

SEQ ID NO: 109576 - DNA, 601 bp, Human; identical to SEQ ID NO: 17816

SEQ ID NO: 109577 - DNA, 601 bp, Human; identical to SEQ ID NO: 17817

SEQ ID NO: 109578 - DNA, 601 bp, Human; identical to SEQ ID NO: 17818

SEQ ID NO: 109579 - DNA, 601 bp, Human; identical to SEQ ID NO: 17819

SEQ ID NO: 109580 - DNA, 601 bp, Human; identical to SEQ ID NO: 17820

SEQ ID NO: 109581 - DNA, 601 bp, Human; identical to SEQ ID NO: 17821

SEQ ID NO: 109582 - DNA, 601 bp, Human; identical to SEQ ID NO: 17822

SEQ ID NO: 109583 - DNA, 601 bp, Human; identical to SEQ ID NO: 17823

SEQ ID NO: 109584 - DNA, 601 bp, Human; identical to SEQ ID NO: 17824

SEQ ID NO: 109585 - DNA, 601 bp, Human; identical to SEQ ID NO: 17825

SEQ ID NO: 109586 - DNA, 601 bp, Human; identical to SEQ ID NO: 17826

SEQ ID NO: 109587 - DNA, 601 bp, Human; identical to SEQ ID NO: 17827

SEQ ID NO: 109588 - DNA, 601 bp, Human
atctctgaaatctgttcattttttccctccatttataaaaaggggtcaatttatcatttgctctatagctatttgaattcgaaaaagattccacaaaatttgagttgcacacaggcgctttctgaagcagattaaacttgtccttgtgacacttcagagcttggactgcagtgacttcaggtgcttgtaagattcgtggacctgtggggaaaggagagagaagaactactaataaagagtttgccatgttaaatagtatactgttttttgtttttgtttttgttttttttttgagactgartcctgctctgttgctcaggctggagtgcagtggcacaatcttggctcactacagcctctgcctcccagactccagcgatcttcccaccttagcctcccgagttgctagaactacaggtgtgtgccatgacacctggctgctatttgtatttttttgtagagatgggggtttaccatgttggccaggctggtctagaactcctcaattcaagtgatccacccacctcagcctcccaaagtgctaggattacaggcgtgagccactgtgcccagcctgtggttgtttctgaagagtccttat

SEQ ID NO: 109589 - DNA, 601 bp, Human; identical to SEQ ID NO: 109588

SEQ ID NO: 109590 - DNA, 601 bp, Human; identical to SEQ ID NO: 36481

SEQ ID NO: 109591 - DNA, 601 bp, Human; identical to SEQ ID NO: 36482

SEQ ID NO: 109592 - DNA, 601 bp, Human; identical to SEQ ID NO: 36483

SEQ ID NO: 109593 - DNA, 601 bp, Human; identical to SEQ ID NO: 36484

SEQ ID NO: 109594 - DNA, 601 bp, Human; identical to SEQ ID NO: 36485

SEQ ID NO: 109595 - DNA, 601 bp, Human; identical to SEQ ID NO: 36486

SEQ ID NO: 109596 - DNA, 601 bp, Human; identical to SEQ ID NO: 36487

SEQ ID NO: 109597 - DNA, 601 bp, Human; identical to SEQ ID NO: 36488

SEQ ID NO: 109598 - DNA, 601 bp, Human; identical to SEQ ID NO: 36489

SEQ ID NO: 109599 - DNA, 601 bp, Human; identical to SEQ ID NO: 36490

SEQ ID NO: 109600 - DNA, 601 bp, Human; identical to SEQ ID NO: 36491

SEQ ID NO: 109601 - DNA, 601 bp, Human; identical to SEQ ID NO: 36492

SEQ ID NO: 109602 - DNA, 601 bp, Human
acatcctatacctttgaatttcctttaaaagatagtgacataatctaaagggcattgaaggtctagtagagtttaagataatcatgctataggcaatatttaaagtgattaatagtaaatttgctttactgatttgtatatttaattcataattgtttctttacaggtttctttacctccagaaagaagaatattggccccttgaattctggaagttcattgaagagtctgaaattagggacttatttcaaatttggacatggctagtcgaggcgcaacaagacccaacgggccaaatackggaaataaaatatgccagttcaaactagtacttctgggagagtccgctgttggcaaatcaagcctagtgcttcgttttgtgaaaggccaatttcatgaatttcaagagagtaccattgggggtgagattttcttttttccctgcttcatttaatcgaatcatacattgacagaaaatattttgatgttccaattgtgtgattatgaatagctaaataagtcatagagtgaagaaaagagctgttcagcttaccttagctttaaaacttgcctttatctttgttaaaatgatgtgttttta

SEQ ID NO: 109603 - DNA, 601 bp, Human
gtttaaaatgaatagtaaaaaaggtaaccttaaattctgatctatataactgaagtatttgcaaataattatacttacttgtaaaattaaatgtaattaaatactgctagatgtacttttttttggtatttaagagatgggatcttgctgtcgcctaggctggagtgcagtgtccggatcatagctcactgcagactgcagcctgaaactctaggctcaaatgatcttcttgccttagcctcccaccaagtagttggacctaagggtgcatgccaccatgccaggcaagtttttttttttctttttttttttttttttaagagtcagagtctcgctgtgtttccaggttggtcttgaactcctggcctcaagtgagcctccagcctcaacctcccaggtagctgtgattacaggtgctccctgctgagatgcatatgtaagaatgctcctaagctgagggaagagaaaaagtgattaatggaaagggacataacaggaaaatggaacctgaagaaaaagatgaaagaagaagggaaagagtaggcactgacaagggtggttatggtgggacagagatgaggggaaggtaagatgcagggtg

SEQ ID NO: 109604 - DNA, 601 bp, Human
aactcctggcctcaagtgagcctccagcctcaacctcccaggtagctgtgattacaggtgctccctgctgagatgcatatgtaagaatgctcctaagctgagggaagagaaaaagtgattaatggaaagggacataacaggaaaatggaacctgaagaaaaagatgaaagaagaagggaaagagtaggcactgacaagggtggttatggtgggacagagatgaggggaaggtaagatgcagggtgaaaaggagacaacaaacagtacagtattgtcaagagaggacgtgaaatgggaaaaytgaattttagctggacatggtggtgcattcctgtagtcccaggtatttggaggctgaggcaggattattttagcttgggagttcaagtctagcctgggcaacataatgagaacccatctcttaaaaaaaattgactttaatcaaagaaacctataattatatagcagtgggacaagatagcctcttttgggcctctgtttcatctgtgaaatgatgcttttcaattagatgatgtgtggcaagagccacacggtttgagattcacaatattttgcaagtgatatataattaagcaatgct

SEQ ID NO: 109605 - DNA, 601 bp, Human
gctgaggtgggcagatcgcttgagtccaggagtttgagaccagcctggccaacatagcaaaaccccgtctttacaaaaaatacgaaaattaaccgggcatggtggcacacacctgtagtcccagctactgagaaggctgaaatgggagaattgcttgaactgaagaggcggaggttacagtgagccgagactgcaccaccacactccagcctgggtgacagtgagaaccctgtctcaaaaacaaaacaaaacaaagaatccctgttgcctcaccatacttcatgcatcctacccctatagyacttctgatgaaattgcgtgccgtagatttagcaatttagagaattctagcttgtttgtatgggtttaaagtttgcatgacatttatgtttctattgttggtctaaagttagcccagagattagcagggagcagcaggctcagagagttgtcttccttctttacttggtactgcatctctaggcttggtagctcttcagtaaatactctcaaaaaatacttatttttaagaagacatttatgtgatatttataaacaaattaatcctcagtggttagaatatgcagtgaaatagcaagca

SEQ ID NO: 109606 - DNA, 601 bp, Human
gctgaaatgggagaattgcttgaactgaagaggcggaggttacagtgagccgagactgcaccaccacactccagcctgggtgacagtgagaaccctgtctcaaaaacaaaacaaaacaaagaatccctgttgcctcaccatacttcatgcatcctacccctatagcacttctgatgaaattgcgtgccgtagatttagcaatttagagaattctagcttgtttgtatgggtttaaagtttgcatgacatttatgtttctattgttggtctaaagttagcccagagattagcagggagcagyaggctcagagagttgtcttccttctttacttggtactgcatctctaggcttggtagctcttcagtaaatactctcaaaaaatacttatttttaagaagacatttatgtgatatttataaacaaattaatcctcagtggttagaatatgcagtgaaatagcaagcagacaatcctttttttctcttctgagaaaagtgcttcataccacagttacaattttgtatgcactaatcaaaaaatgtgttataaactctaaagtttagatgatggaactgtacatgaaaataacattcctcttgc

SEQ ID NO: 109607 - DNA, 601 bp, Human
gttctgtgatttttgtacattagcttagaacagtggtcctcaaagagcattcccacttccagaagtagctgcattaactaggaacttgttaaaatgtagaatcccgtgttgaatcaaaacatttgggtgggaccaacaatctaggttttaataagttttccagatgattctaatggcatgttacgtttgagtagttgattttacattggtactaacattgattcacccatacatggaataattggggggtttttttgaggtgtggtgtttgtcagatttttaaaaacattgttgactgggygcggtagctcacacctgtaatcccaacactttgggaggctgaggcgggcggatcacgaggtcaggagttcgagaccagcttgccaatgtgatgaaaccctgtctctgctaaaaatacaaaaattagccaggcatggtggcgtgcgcctgtagtcccagctacttgggaggctgaggcaggagattcgcttgaacccaggaggcggaggaggttgttgcaatgagccgagatcatgccattgcactccagcctgggtgtctcagcgagactccgtcttaaaaaaaaaattgttcatgcaac

SEQ ID NO: 109608 - DNA, 601 bp, Human
ggcatgttacgtttgagtagttgattttacattggtactaacattgattcacccatacatggaataattggggggtttttttgaggtgtggtgtttgtcagatttttaaaaacattgttgactgggcgcggtagctcacacctgtaatcccaacactttgggaggctgaggcgggcggatcacgaggtcaggagttcgagaccagcttgccaatgtgatgaaaccctgtctctgctaaaaatacaaaaattagccaggcatggtggcgtgcgcctgtagtcccagctacttgggaggctgrggcaggagattcgcttgaacccaggaggcggaggaggttgttgcaatgagccgagatcatgccattgcactccagcctgggtgtctcagcgagactccgtcttaaaaaaaaaattgttcatgcaactaacctagtttgagaattacatgtattatgtactgctcacattacatgttatctgtatctctttataggagaatgccttcctgttagccacctgccagacatctttaggaaagtatgatccctctgtccaatcaagagtattctgctttttctctacttagggagtacccatag

SEQ ID NO: 109609 - DNA, 601 bp, Human
gctcacattacatgttatctgtatctctttataggagaatgccttcctgttagccacctgccagacatctttaggaaagtatgatccctctgtccaatcaagagtattctgctttttctctacttagggagtacccatagttttcagtcatctgtaccactgctgctctcctttcttgtcacaaatgatcaaggcctgataatacacaaaattaattaagaaatttagtgtaggccgggcgcagtggctcatgcctgtaatcccagcactttgggagggtgccagcacactggcagatcaygaggtcaggagttcgagaccagcctggccaacatggtaaaaataccagaattagctaggcgtggtggtgggtgcctataaccccagctactcaggatgctgaggcaggagaaacatttgaacccaggaagcggaggttgcagtgagccgagatcgcgccattgcactccagcctgggcgacagggcgagactccgtctcaaaaaaaaggaaatttagtgcaattattaactcttaagtgaagtgctgtttctacttacatatttaacatccatctaaattggttagcatggccaactagt

SEQ ID NO: 109610 - DNA, 601 bp, Human
caatattgaattaccttgatttagtcacctcacaatgtgtacatgtatcaaaacatcatgttaatatacatatgtatatattgtaaatacataacgatttttatttttcaacaataccttaataaagctggggggaataaagttacttcctaaacagaaaagctagccagaaaatttaaatccaaataactcatgtttttccagtagtagaaagctttctacaattgcccttcacttgttagccttcagaatgacttctttgtataattataatctgtgcatttatttaatgtgcttttayctttttgcatgtgcacattgttaaaagtgcttttgagaaaggatagaagacctagagaccaaaccaccagcatgtggtttttgattcgtgagaaaaattgtgtgtttgaagtattcattctactttctgatacattgatagttaaaatttgtggaagttaatcatttggtttcaagcaaaataataatatctttgttaatcatattttctcctaaaaagtacatattcagaatttgagaggttgttacccagagaagttggtagagatttgatatttcaaatttatatcacaacctaaaa

SEQ ID NO: 109611 - DNA, 601 bp, Human
ttccagtagtagaaagctttctacaattgcccttcacttgttagccttcagaatgacttctttgtataattataatctgtgcatttatttaatgtgcttttatctttttgcatgtgcacattgttaaaagtgcttttgagaaaggatagaagacctagagaccaaaccaccagcatgtggtttttgattcgtgagaaaaattgtgtgtttgaagtattcattctactttctgatacattgatagttaaaatttgtggaagttaatcatttggtttcaagcaaaataataatatctttgttmatcatattttctcctaaaaagtacatattcagaatttgagaggttgttacccagagaagttggtagagatttgatatttcaaatttatatcacaacctaaaaaaatctttcggtagtcttaattattccccaatttcttaggttaaaatattatcatatgtggctacttaaacattcccgtgagctgggagtcagtatgcatggttctaatcctcacatgctttcataagcatttatgtgaactctgtttacacatttgtaacacgagagtattgaactctaggtaaggattcttgtagg

SEQ ID NO: 109612 - DNA, 601 bp, Human
agaggttgcagtgagctgagatcacaccactgcacttcaacctgggtgacagggcgctgaggtaggggagactgagacatgagaattgcttcaacctgggaggcggaggttgcagtgagctgagatcgcaccactgcacttcaacctgggtgacagagcgagactctgtctcaaaaaaagaaaaaaggattcttgtagagcagatgttcttataaactgtgtactcttctcattaaacaatacagtcaatacaatttaacttttgttttcttaaaatgtatttcaagatttggaatcattatgagcatcagtttttgccttgccgtgcttaatgtgttgatgtcctctggtgctttggaagtattcaagctgtttggtagaatgattttgccaaatagctcttagtgaactgctactgattcactaatttactgcttttatttgttatatatgggaaatattaggttgtctaaagcaaatcaaaataaaaccagaaatcatctctgatgattctaaaactagaaatcagggacaacttcttggtatagtttgagagacagattgagtgaacattgtaatctggtgctatatattaaaggtt

SEQ ID NO: 109613 - DNA, 601 bp, Human
aggttgcagtgagctgagatcacaccactgcacttcaacctgggtgacagggcgctgaggtaggggagactgagacatgagaattgcttcaacctgggaggcggaggttgcagtgagctgagatcgcaccactgcacttcaacctgggtgacagagcgagactctgtctcaaaaaaagaaaaaaggattcttgtagagcagatgttcttataaactgtgtactcttctcattaaacaatacagtcaatacaatttaacttttgttttcttaaaatgtatttcaagatttggaatcattatgagcatcagtttttgccttgccgtgcttaatgtgttgatgtcctctggtgctttggaagtattcaagctgtttggtagaatgattttgccaaatagctcttagtgaactgctactgattcactaatttactgcttttatttgttatatatgggaaatattaggttgtctaaagcaaatcaaaataaaaccagaaatcatctctgatgattctaaaactagaaatcagggacaacttcttggtatagtttgagagacagattgagtgaacattgtaatctggtgctatatattaaaggtttt

SEQ ID NO: 109614 - DNA, 601 bp, Human
aaaattttgcttttagaatagaataagaattcttacttgatagaaacatgggaaattttggcaaactgtttctcccttttttaggtcatataccataataacctgacattgcatatacataatcttgtttatgaagtatgctgagtaaatttatgataggatagtatcatttggagttacatcaaaagccttttcagcaaacctctttgtgaaggagaataaagatgtgtgagagtaagaaaagcaataagagtacttctaaaggtttttgtttttgagatggggtctcgctctgtgctakactggagtgcagtggcatgatcatggctcactgcagcctcaacttctgggctccagccatcttcccacctcagcctcctgagtagctgagaccacaggcatgtgtgcccctgcccccggctaattttgtatttttggtagagatggctattctccatgtttcccaggctggtcgcgaactcctgagctcaagcaatcaacctgccttagcctcccaaagtgctgggaatacaggcgtaagccactttttcaggcatcattttttgtcttttaattcattggctaccttgatgtatatgta

SEQ ID NO: 109615 - DNA, 601 bp, Human
cattttttgtcttttaattcattggctaccttgatgtatatgtaaactttagttacctagttgctaaattcctcaagatgaaagttaagtgttactgaagtcatatgttggactttgaaaataagaatgctctacaaatcagaatatctgaagtaagtgttgctaaacagcattcatcctccgtttgaggaaaggtagaagcaggatgaagaaccggttagttattcatggttttttaagccttaagtgttcgcagtagtagttgttggatattctttgggccccaaagaagaagtgggtratcttgatacatgactagtcactgcataattatcagacaccttcagcttttctcagtcaaaaaactgttctttatctttgcataaaactagagccagaatatattccacctagttactatcgtttttatttgaggtataacatgaatagaattttctcctctattgcattcataagtaatttgtaaattttagaaaaatgtgacttctaggaaataaaggataatttaaagataggacacttacaataattacttgttatgtgatacattcctagaacttaaacaggattttcagaagtt

SEQ ID NO: 109616 - DNA, 601 bp, Human
tatctgaagtaagtgttgctaaacagcattcatcctccgtttgaggaaaggtagaagcaggatgaagaaccggttagttattcatggttttttaagccttaagtgttcgcagtagtagttgttggatattctttgggccccaaagaagaagtgggtaatcttgatacatgactagtcactgcataattatcagacaccttcagcttttctcagtcaaaaaactgttctttatctttgcataaaactagagccagaatatattccacctagttactatcgtttttatttgaggtataacatsaatagaattttctcctctattgcattcataagtaatttgtaaattttagaaaaatgtgacttctaggaaataaaggataatttaaagataggacacttacaataattacttgttatgtgatacattcctagaacttaaacaggattttcagaagtttcatctgtaccttaccatggctatatgggaaggtactaattttatagacaaggaaactgaagcaataaaggttaagtatatgcttgaagttttgcaactaggtgacagctgggattaaagacatctttctgaaatgccattcat

SEQ ID NO: 109617 - DNA, 601 bp, Human
ttaaagacatctttctgaaatgccattcatgttctggaatgtactgtgtatgtgtgtatttctccttgcaagaacctatcagactagaaaatttggctcatagttagagtacacatgacaagtgttctgttaaataatatgtagtatttgacaggtaggggccttcttgctatgtatcacttaaggaaaataatgtgaaagtattttgagaacaaaagaatataagacgattatttaaattgtccatattcctaaattatcaccaccattttcatttttatgccatcatcatgtgtcacaygctatattttaactgcctttaatcaaatgcattaatttgttcatgtgagtcaaaattcaagaggtttataaggtttaccatgaaaaatctccccctcatcttctatctagcccactcaattctttttcccaaagatgatgttactttgttatatatccttgcaaagttactactatactcaaatctatatattcttgtctccctttttacaaaatttgaaatatgtcagatgtactgtaatacactttttatttttcactttaatgctgttctagttatctattgctgagacacaaatga

SEQ ID NO: 109618 - DNA, 601 bp, Human
tcagactagaaaatttggctcatagttagagtacacatgacaagtgttctgttaaataatatgtagtatttgacaggtaggggccttcttgctatgtatcacttaaggaaaataatgtgaaagtattttgagaacaaaagaatataagacgattatttaaattgtccatattcctaaattatcaccaccattttcatttttatgccatcatcatgtgtcacacgctatattttaactgcctttaatcaaatgcattaatttgttcatgtgagtcaaaattcaagaggtttataaggtttaccatgaaaaatctccccctcatcttctatctagcccactcaattctttttcccaaagatgatgttactttgttatatatccttgcaaagttactactatactcaaatctatatattcttgtctccctttttacaaaatttgaaatatgtcagatgtactgtaatacactttttatttttcactttaatgctgttctagttatctattgctgagacacaaatgactcctccaaaatgtagagacttaaaattattttgtcatctccatggttctggtgagtgggcttagtaggtggttctca

SEQ ID NO: 109619 - DNA, 601 bp, Human
gactagaaaatttggctcatagttagagtacacatgacaagtgttctgttaaataatatgtagtatttgacaggtaggggccttcttgctatgtatcacttaaggaaaataatgtgaaagtattttgagaacaaaagaatataagacgattatttaaattgtccatattcctaaattatcaccaccattttcatttttatgccatcatcatgtgtcacacgctatattttaactgcctttaatcaaatgcattaatttgttcatgtgagtcaaaattcaagaggtttataaggtttaccaggaaaaatctccccctcatcttctatctagcccactcaattctttttcccaaagatgatgttactttgttatatatccttgcaaagttactactatactcaaatctatatattcttgtctccctttttacaaaatttgaaatatgtcagatgtactgtaatacactttttatttttcactttaatgctgttctagttatctattgctgagacacaaatgactcctccaaaatgtagagacttaaaattattttgtcatctccatggttctggtgagtgggcttagtaggtggttctcactc

SEQ ID NO: 109620 - DNA, 601 bp, Human
aagtgttctgttaaataatatgtagtatttgacaggtaggggccttcttgctatgtatcacttaaggaaaataatgtgaaagtattttgagaacaaaagaatataagacgattatttaaattgtccatattcctaaattatcaccaccattttcatttttatgccatcatcatgtgtcacacgctatattttaactgcctttaatcaaatgcattaatttgttcatgtgagtcaaaattcaagaggtttataaggtttaccatgaaaaatctccccctcatcttctatctagcccactcarttctttttcccaaagatgatgttactttgttatatatccttgcaaagttactactatactcaaatctatatattcttgtctccctttttacaaaatttgaaatatgtcagatgtactgtaatacactttttatttttcactttaatgctgttctagttatctattgctgagacacaaatgactcctccaaaatgtagagacttaaaattattttgtcatctccatggttctggtgagtgggcttagtaggtggttctcactctgatcttttccttgctcttgcagttcattacggggcaa

SEQ ID NO: 109621 - DNA, 601 bp, Human
ttggaattaaaggcatgagccaccatgcccagcctgtgtttagtttttctgtgaactattcataacctcatgttatttctatgtagatttctttataatagtcacactactgtgttccatttgatttattaatggtaatatttctcagtacatctatattgtcatattttagtatctggcaatcttctctttttattattttttaactgttccattgttgggcatttaatgtttgcttttttgtttgctgttttaggtaatcacctaataggggatatcttagaatttcacccccccccccgacttattttcgtaagatcaatttctagaggtgattactgaacccaaaggaattttatcctaataaaattgttttgtaggatcaaaagaattctaatcttcatcctttttcatcccttagagatacatccagtttctttgggggttggcatagataattatatcctaggattacaggtttcctctaactgttaataggagtttaaagttttccctctctgtttagtcttcttttctattatgttgtaaaattctcagatatcagaacttttgtttttgttttgagagacaaggtcttcct

SEQ ID NO: 109622 - DNA, 601 bp, Human
catcccttagagatacatccagtttctttgggggttggcatagataattatatcctaggattacaggtttcctctaactgttaataggagtttaaagttttccctctctgtttagtcttcttttctattatgttgtaaaattctcagatatcagaacttttgtttttgttttgagagacaaggtcttcctctgtcacccaggctgaagagcagtggcatgattatggctcactgcagcctccaccccctgggctcaaatgatcctcccacctcaccctcccaagtagatggtactacgtgkgcatgtgccaccatgcctggctaatttatttttaagatggagtcttgctatgttgcccaggctggttttgagctcctggcctcaagcaatcttcctgagacaggaatcccaaagtgctgggattacaggtgtgagccactgtgcccagccaaatattagaacttttaaattcatttagtatgtaagcttactgccaagcatgaaagaatcactttgaaggccagtaatgttttaaaggtctggaagattctcttgagggctaggaagcattatgtgctaggttcttgaaccaggagaaaa

SEQ ID NO: 109623 - DNA, 601 bp, Human
cttcctgagacaggaatcccaaagtgctgggattacaggtgtgagccactgtgcccagccaaatattagaacttttaaattcatttagtatgtaagcttactgccaagcatgaaagaatcactttgaaggccagtaatgttttaaaggtctggaagattctcttgagggctaggaagcattatgtgctaggttcttgaaccaggagaaaaggggtatcactaagaagaagggaaggaatcctggtatgcaaaatagcttgggcgctatccttgcacatttgacaagtttagtgaagtactrttgaactgttcagtaaagtatctgttgcctatagataaaatgtcttttgtagatacttatatatctacctacctatagatatctatatatctgtatctatatatcccttaaagctaagctaatttccttaaccttttctctgttgatatttgtttggtagcctttatctgattctagttaataactcgtaccctgtcatttttttaaaaataccctttgtttttgtaatgtgttctttcattcttcttcccaattcagttttggtacgttcctgttacgtaaatctaatctggtgagcag

SEQ ID NO: 109624 - DNA, 601 bp, Human
gtaagcttactgccaagcatgaaagaatcactttgaaggccagtaatgttttaaaggtctggaagattctcttgagggctaggaagcattatgtgctaggttcttgaaccaggagaaaaggggtatcactaagaagaagggaaggaatcctggtatgcaaaatagcttgggcgctatccttgcacatttgacaagtttagtgaagtactattgaactgttcagtaaagtatctgttgcctatagataaaatgtcttttgtagatacttatatatctacctacctatagatatctatatatytgtatctatatatcccttaaagctaagctaatttccttaaccttttctctgttgatatttgtttggtagcctttatctgattctagttaataactcgtaccctgtcatttttttaaaaataccctttgtttttgtaatgtgttctttcattcttcttcccaattcagttttggtacgttcctgttacgtaaatctaatctggtgagcagagactttcttaggattatgccacttggtgaggcaatcacagggtcttagccctgaaggcgcccatactgactttatcagtttattctaggg

SEQ ID NO: 109625 - DNA, 601 bp, Human
taggttcttgaaccaggagaaaaggggtatcactaagaagaagggaaggaatcctggtatgcaaaatagcttgggcgctatccttgcacatttgacaagtttagtgaagtactattgaactgttcagtaaagtatctgttgcctatagataaaatgtcttttgtagatacttatatatctacctacctatagatatctatatatctgtatctatatatcccttaaagctaagctaatttccttaaccttttctctgttgatatttgtttggtagcctttatctgattctagttaataactygtaccctgtcatttttttaaaaataccctttgtttttgtaatgtgttctttcattcttcttcccaattcagttttggtacgttcctgttacgtaaatctaatctggtgagcagagactttcttaggattatgccacttggtgaggcaatcacagggtcttagccctgaaggcgcccatactgactttatcagtttattctagggagatcaggtttggggcactaacttaatactaacaaactcctaagattaatttaattttatttatttgtttgagacggagtcacccagggtggagtg

SEQ ID NO: 109626 - DNA, 601 bp, Human
tatcagtttattctagggagatcaggtttggggcactaacttaatactaacaaactcctaagattaatttaattttatttatttgtttgagacggagtcacccagggtggagtgcagtggcgtgatcttggctcactgcaacctctgcctccctggttcaaacgattcttgtgcctcagcctcctgaggctgggactacaggcgcatgtcaccacgtctggcttatttttgtagttttagtagagacaaggtttcaccatgttggccgggctggtcttgaactacctcaggtcccaccttkgcctcctaaaatgctagaattacacagacgggagctaccatgcctagccaaaactcctaagatttacttacttacttactttatttatttatttgagacggagtctcgctctgtcccctaggctggaatgcagtggtgtaatctcagctcactgcaacatctgcctcctgggttcacctgtctctgcctctcagatagctgggattgcaggtgcatgccaccatgcccgactaatttttgtatttttagtagagatggggtttcaccatgttggccaggctggtctcgcactcctgacct

SEQ ID NO: 109627 - DNA, 601 bp, Human
acttacacattgggattgtttttttaaaggtactcaaatatgacagtctatattattgtttctctatacacatttatttactaccgaaaattgaaaaaaatagcacatcgaaatttccttttactgcaattcaaatttttgaaaaccagaaaatctgatttattatactctagccaaactacccagtgttttctttacattctttccccacaagttactttacttctgattctttcttttgagacagtctgtcacccagactggaatgcagtggcataatctcagctcactgcaacctccrcctccaggatttaaggtattcttatgcctcagcctcctgagtaggtggtactacaggcacgtgccaccatgcccagctaatttttgtatttttaatagagagccagggtttcaccattttggccaggctggtctcaaactctgggcctcaagtgatcctcctgcctcagcctcccacagtgtgctgggattacaggcatgagccactgtgcccggccttacttccaattcttgatgatggatttcatttcactaacaaggttgtttttaattattaaatagttttaaattctttgagcat

SEQ ID NO: 109628 - DNA, 601 bp, Human
gctgaggcaggagaattgcttgaacccgggaggcggaggttgcagtgagctgagatcacgcccctgcactctagtctgagactcttgtatcaaaaaaaaaaaaaaaaagaagaaggaaaagaaatgtagtcttaagtttatttagtattataacaagcttttttaagatgcagaagtttttcaatctgtgatttcactacaaaggccctatatgtaagcatatatgtaaatagcttagaagcacaggtttgccagtatttaaagctattatcagctgtgggtatgcaatctgtcaagtttytaggtgttttctttttttttcccccctcatttattacttttaactgacacataatagttgtacatacttacggggtacagtgtgacattttgatagatgtatacaagcaggtgttttctatattatgaaaacatttggagaaaaatgattgacttattgtagtccttttctttcagctgcttttctaacccaaactgtatgtcttgatgacactacagtaaagtttgaaatatgggatacagctggtcaagaacgataccatagcctagcaccaatgtactacagaggagcacaagcagc

SEQ ID NO: 109629 - DNA, 601 bp, Human
aatgtactacagaggagcacaagcagccatagttgtatatgatatcacaaatgaggtaagtatggatgcattccacagtaaaactaatttgagtacccacttttggtgttcagaattttgattaaatgttttggaaaatctttttctgatagtcatgacctttctgctgaagcttttgtgaattagaaaatctggttttaaaaaaaaacgaaaatgtctcataatacaatagtcctaataatttctttcccacagtcacttgggacagtcttttaaagccttgtatcacaaagatgcttcstaaccattttttgagcctgtgctcaatggctgtttctttgtttaacaggagtcctttgcaagagcaaaaaattgggttaaagaacttcagaggcaagcaagtcctaacattgtaatagctttatcgggaaacaaggccgacctagcaaataaaagagcagtagatttccaggtatgttaaatttaactctcatttgaaaggcacttttttcctgtatgtttttctttcatgtcaacacttgaattagttataatgtcaaaaccatgcaagtaatagaaaatactgatttttaaaacaaat

SEQ ID NO: 109630 - DNA, 601 bp, Human
ttaaaggggcattcaaacataaaggttctgccaatctgtatccagagttggaaaataataagctaaaaactaataattaaaaaaaatttttttaaggctgagaaaatccagttttgtattacgattgctaattcagaatgtttgctgctgcaaaataggcaagtgcaatcacttaaaaacaaagcaagtcctctatttagacttttttttttttttttaagatggagtcttgctcagttgcccaggctggagtgcagtggcgcaatctcaagctcactgcaagctccacctcctgggcttacgccattctgctgcctcagcctcccaagtagctgggactacaggcgcccaccaccactcctggctaattttttgtgtgttttcagtagagacagggtttcactgtgttagccagggtggtctcgatctcctgaccttgtgatccacccgcctccgcctccaaaagtgctgggattacaggcgtgagccaccacgcccggcatacttagaccttttaaaactgtgcctgttctcttgctctttggcttctctactagaagggcggttgtggctgttctgtatatatcagtgatgaaatagt

SEQ ID NO: 109631 - DNA, 601 bp, Human
taacagttcagaggaacctcagttgtttctttgtccaatgggaaagatcattggttacccctcacaacagctatgaggatcaaaagtaataatatatgtaaactgtaaaagcatgacaaaaatgtagggcagtgatgtaattttcaaaggaatgatttatgatatattcaagattataatattgctgtagaagtcattgaaaattaaatatgaggttgtcatttagtgtttgaagccagtgttagatatttggtttccctttgtcttcattgcagacagtaagtgcaaataaaaattgccrttgagatcaaagagagttttatttagaataagataattctcccccatctctggaactcagtatttgaaagcagatttaatgtaagaaaagattaatcaaggtgggataatgcaagaatttcagacaaaaaaggaaatagtccattataaaattatcttgcacagtgctcttacctctgttgtagcttattatatagttgttgattatagatgattataggaatcaggttgtagtaataagaaagtctccttttctataacaagtttaaagcaggtgtagtgtatttccaagagatatatc

SEQ ID NO: 109632 - DNA, 601 bp, Human
ctaaaacatcaatgaatgtaaatgaaatattcatggcaataggtaagattaatatctctttttaaatgatcaatataagcaaaacaagtgtgaagcatatttggtttgactgtctcttttttaaaaaatttttgggggtgggtttgtgtgtatgtttatgtgtgtgtgtgagagagagagagagattataccacttttctaagtcccttccacaaaacaatattttgttggtaatattgttaaatttgaaagatgattacctattaggttgtaatactgtcagtttaggcagcttcttccrggtgagttaagccttaacctcttaacctgatagttcagacagacagattttgcaaaggtttcgctgggaaatttggataaatattttttttattagattatactttttaaaaatcaaattattggtaaatataactcagaagaacatgacacataagtatacagattgacaaattattttaatgtaaacattataaggaagatgatttcaaagcatagaggcgtaaggagaaaaaaggaaaacaaaacaacatccatactttatattacctcagatggtcatttgatcttacacaatgtt

SEQ ID NO: 109633 - DNA, 601 bp, Human
cggattcaagcggttctcctgcttctgcctcctgaattgctgggattacaggtgcacaccaccacgcccagctaatttttgtatttatagtagagacagggtttcaccatgttggtcaggctggtctcgaactcctgatctcgtgatctgcccacctcggcctcccaaagtgctgggattacaggcgtgagccactacacccagcctaaggtactttctttttttttttttttgaaatggagtcctgctctgtcacccaggttggagtgcagtgggacgatctcggctcactgcaagctcygcctcctggattcacgccattctcctgcctcagcctctcctgtagctgggactacaggcacccaccaccatgcccgactaattttttttgtatttttagtagagacggggtttcaccatgttagccaggatggtctcaatctcctgaccttgtgatccgcccacgtcagcctcccaaagtgctgggattacaggcgcgagccactgcccctggccctaaggtacttttaactgatggtaattgctgtttcagttataagtaatgaagttggagtagtaataagcctccttttttctataa

SEQ ID NO: 109634 - DNA, 601 bp, Human
ccagatgggctttagtttgtacctttttattcaaacatgctaataaagtcatttttcgagttagaaagcagcctacatattttagttttttgtttttttctgaaattagaatgttgcacttcttaaaagaaaatctatgttgtaaatggaattgtggcctttccatttccttcactaggttagtaaattttttttttctttttttttttgttatgaaggaacactttgatagattagtaacttaaatcacacagtgcactcataacaactctaatcaatgcaaggactaaaaagttactcrttctagtttacctccttcatcctcttaatctcactcacctctgatttaaacacttagggaacatgctaaagggatacatgattgattactcaatctggaacctaagttgttattatatacaatatatagtgctattttgtgtcccaggtaccagtgttcaacatttctggggctttgcttgtaaatacatttgactggagatttaccattataatgctatttatgctaccagcccagagccagtcccagagaagtggcccaattgaaggctttctttccaaacttcagtgctcctggctc

SEQ ID NO: 109635 - DNA, 601 bp, Human
caggtaccagtgttcaacatttctggggctttgcttgtaaatacatttgactggagatttaccattataatgctatttatgctaccagcccagagccagtcccagagaagtggcccaattgaaggctttctttccaaacttcagtgctcctggctcccaaatccattgcccaacccagcatctaggattctaaaaatgattgatgctgatgtagaatggaatgtgtagaacaaataaaggataaaaggttcacaatgcaactaggcaatccgatctcaaagcagagtgtattcaatttctsagtaacctgagtcaaagctatggtaaagttagagtcttaccatagtggtctgtccccaagattgatagagatcagtgtgtgcagccactcttaaaatcagtactcttagtcatctttaatattctgcctcccctcaaaaaatgaatttagcacatcaaggatcttatgtattaaaacaaactacagcaatctccaactttacagtggtttgacttacgattttataactcgatggggtgaaagtgatatgcatttagtacattcttaacttactacgggattacatacagaaacccatca

SEQ ID NO: 109636 - DNA, 601 bp, Human
cccagagaagtggcccaattgaaggctttctttccaaacttcagtgctcctggctcccaaatccattgcccaacccagcatctaggattctaaaaatgattgatgctgatgtagaatggaatgtgtagaacaaataaaggataaaaggttcacaatgcaactaggcaatccgatctcaaagcagagtgtattcaatttctgagtaacctgagtcaaagctatggtaaagttagagtcttaccatagtggtctgtccccaagattgatagagatcagtgtgtgcagccactcttaaaatcartactcttagtcatctttaatattctgcctcccctcaaaaaatgaatttagcacatcaaggatcttatgtattaaaacaaactacagcaatctccaactttacagtggtttgacttacgattttataactcgatggggtgaaagtgatatgcatttagtacattcttaacttactacgggattacatacagaaacccatcataaattaaaaatatcataaatcaggctgggcgcagtggctcactacctgtaatcccagcactttgggaggccaaggcgggctatcacctgaggtcaggag

SEQ ID NO: 109637 - DNA, 601 bp, Human
gtgtacattgttctcatgtaaaaccatcagtccacggctgcctgttaaataattttgtctctttctttattccatttttaggccgaggagtcttgtaaatgtaatggctggaaaaaccctaacccctcacccactccccccagagccgacctgcagcaaataattgtcagtctaacagaatcctgtcggagttgtagccatgccctaggtgagttcctaaatcttcaaggaaagtataacgagttcattgtagcgtgagactcttaacttactgaattctgtgggttcaccaaatttgaaygctatgtacctctgtatgagagcaacaacaagagcctctctagtctcacgagtttgctgggaagggcttctcgtgagagacaaatgctgcactgtgtgcagtgactttgtcccttcttcctttcaagagctgagttggactgggggattgccaaataagatgaaacatgacaatcgagctagttagcatgaataatgtgtaacatgtcctgattcattttgggggttggggcctgagggtctttgacctcagggttgaaacctcaaccaactggtttaatgataataatgatcattttta

SEQ ID NO: 109638 - DNA, 601 bp, Human
acattgttctcatgtaaaaccatcagtccacggctgcctgttaaataattttgtctctttctttattccatttttaggccgaggagtcttgtaaatgtaatggctggaaaaaccctaacccctcacccactccccccagagccgacctgcagcaaataattgtcagtctaacagaatcctgtcggagttgtagccatgccctaggtgagttcctaaatcttcaaggaaagtataacgagttcattgtagcgtgagactcttaacttactgaattctgtgggttcaccaaatttgaacgctrtgtacctctgtatgagagcaacaacaagagcctctctagtctcacgagtttgctgggaagggcttctcgtgagagacaaatgctgcactgtgtgcagtgactttgtcccttcttcctttcaagagctgagttggactgggggattgccaaataagatgaaacatgacaatcgagctagttagcatgaataatgtgtaacatgtcctgattcattttgggggttggggcctgagggtctttgacctcagggttgaaacctcaaccaactggtttaatgataataatgatcatttttattat

SEQ ID NO: 109639 - DNA, 601 bp, Human
ttactgaattctgtgggttcaccaaatttgaacgctatgtacctctgtatgagagcaacaacaagagcctctctagtctcacgagtttgctgggaagggcttctcgtgagagacaaatgctgcactgtgtgcagtgactttgtcccttcttcctttcaagagctgagttggactgggggattgccaaataagatgaaacatgacaatcgagctagttagcatgaataatgtgtaacatgtcctgattcattttgggggttggggcctgagggtctttgacctcagggttgaaacctcaacyaactggtttaatgataataatgatcatttttattatttctgttgccctgaactttctggggtgcttcattttatcttcatattccttagttttgtgtatctgatagctctttcttcactgggctgctctttattgtgtttattgaatgtttactggtggtttccctttcaactttcttatctgaccctgcaaaataatcattgtcagtgatggctcagtaggccctgctgcagtcactcaaaaggcctgtgctagtatgttgttctttgtcctaatactagttttatgattaaaatattt

SEQ ID NO: 109640 - DNA, 601 bp, Human
caagagctgagttggactgggggattgccaaataagatgaaacatgacaatcgagctagttagcatgaataatgtgtaacatgtcctgattcattttgggggttggggcctgagggtctttgacctcagggttgaaacctcaaccaactggtttaatgataataatgatcatttttattatttctgttgccctgaactttctggggtgcttcattttatcttcatattccttagttttgtgtatctgatagctctttcttcactgggctgctctttattgtgtttattgaatgtttactgstggtttccctttcaactttcttatctgaccctgcaaaataatcattgtcagtgatggctcagtaggccctgctgcagtcactcaaaaggcctgtgctagtatgttgttctttgtcctaatactagttttatgattaaaatatttaaaaaaatcatatgttgtttgagtagataaaagttgaggaattagtttttcctagatactaaaatttcagtccacgaagaatcttagactattcttactttcctgccttcagttatacagtctcccccaaaatgtcaacaaggccagtttgctgtc

SEQ ID NO: 109641 - DNA, 601 bp, Human
ataatgtgtaacatgtcctgattcattttgggggttggggcctgagggtctttgacctcagggttgaaacctcaaccaactggtttaatgataataatgatcatttttattatttctgttgccctgaactttctggggtgcttcattttatcttcatattccttagttttgtgtatctgatagctctttcttcactgggctgctctttattgtgtttattgaatgtttactggtggtttccctttcaactttcttatctgaccctgcaaaataatcattgtcagtgatggctcagtaggcyctgctgcagtcactcaaaaggcctgtgctagtatgttgttctttgtcctaatactagttttatgattaaaatatttaaaaaaatcatatgttgtttgagtagataaaagttgaggaattagtttttcctagatactaaaatttcagtccacgaagaatcttagactattcttactttcctgccttcagttatacagtctcccccaaaatgtcaacaaggccagtttgctgtccgtgactgcaaggacatagcactcactgggcagaacgttcttgctaaggtacttgctctttccacctg

SEQ ID NO: 109642 - DNA, 601 bp, Human
tgataataatgatcatttttattatttctgttgccctgaactttctggggtgcttcattttatcttcatattccttagttttgtgtatctgatagctctttcttcactgggctgctctttattgtgtttattgaatgtttactggtggtttccctttcaactttcttatctgaccctgcaaaataatcattgtcagtgatggctcagtaggccctgctgcagtcactcaaaaggcctgtgctagtatgttgttctttgtcctaatactagttttatgattaaaatatttaaaaaaatcatrtgttgtttgagtagataaaagttgaggaattagtttttcctagatactaaaatttcagtccacgaagaatcttagactattcttactttcctgccttcagttatacagtctcccccaaaatgtcaacaaggccagtttgctgtccgtgactgcaaggacatagcactcactgggcagaacgttcttgctaaggtacttgctctttccacctgaccattataagtgggtgacttcttatgccatcatttctctagagcttcctgcttacaagaaatggtgtcgcctccaaggttagcatgg

SEQ ID NO: 109643 - DNA, 601 bp, Human
tgatggctcagtaggccctgctgcagtcactcaaaaggcctgtgctagtatgttgttctttgtcctaatactagttttatgattaaaatatttaaaaaaatcatatgttgtttgagtagataaaagttgaggaattagtttttcctagatactaaaatttcagtccacgaagaatcttagactattcttactttcctgccttcagttatacagtctcccccaaaatgtcaacaaggccagtttgctgtccgtgactgcaaggacatagcactcactgggcagaacgttcttgctaaggtasttgctctttccacctgaccattataagtgggtgacttcttatgccatcatttctctagagcttcctgcttacaagaaatggtgtcgcctccaaggttagcatggtgttaggtcgtctgaaattttattttgtactcagagagtatttcaatatttacagagcatacaagtagataatgtgatcttcccaagaagtcatcacattggaataaccttctgaaaatagaaatagtcctgatctcacaaaagcaacacactaataatttcatcattttgttgacttaattggtatctcaaacaa

SEQ ID NO: 109644 - DNA, 601 bp, Human
ttcttactttcctgccttcagttatacagtctcccccaaaatgtcaacaaggccagtttgctgtccgtgactgcaaggacatagcactcactgggcagaacgttcttgctaaggtacttgctctttccacctgaccattataagtgggtgacttcttatgccatcatttctctagagcttcctgcttacaagaaatggtgtcgcctccaaggttagcatggtgttaggtcgtctgaaattttattttgtactcagagagtatttcaatatttacagagcatacaagtagataatgtgatcytcccaagaagtcatcacattggaataaccttctgaaaatagaaatagtcctgatctcacaaaagcaacacactaataatttcatcattttgttgacttaattggtatctcaaacaatgtgagctctgagttttgaagcactcaatacagagcaaaaatttcaaaagttagagaactgtccttgattataatttaccttttttaaaaaacaaaaaataaaataaaacagaacgaaacaaaacaaccactaactctgaatggagtgaatggagtttaggattgcctcaggaaatgtgacgta

SEQ ID NO: 109645 - DNA, 601 bp, Human
taaagcagcttgataggaggttttataatttaggactaaattattggatctatcagcctgagttcaaatcctaactctataaccagtagctgtgagtatgagcacattacttaatctgcctggacctcagttttttcaactctgaaatgggttaatacatagtagtatttaccttgcaggatcattgtgaggattaaatgagataagaaaaaatcttagaatagtacctggcatgtaaatacatgattattggctgatgttgttcgtagtagtggtactataacactatcagggttctttyacttcacacagcagatatatactctgtctagcttaaataagaaaacaatgcatataagaagggtactagtagcttctagaagctgaaaacaatgggaaaacaggttttgatcttgtttggggatctcagctgcagaagttcacagagcttctgttcagtctgctgccactgaatcatttaggattcagctccaactgcctctgtccctgtgagtattggttcaggatttaaataccctgtggaggagcttgtgcctgttatgtgtttaactctgaagtttaccccaagggaactaagaag

SEQ ID NO: 109646 - DNA, 601 bp, Human
gaggattaaatgagataagaaaaaatcttagaatagtacctggcatgtaaatacatgattattggctgatgttgttcgtagtagtggtactataacactatcagggttcttttacttcacacagcagatatatactctgtctagcttaaataagaaaacaatgcatataagaagggtactagtagcttctagaagctgaaaacaatgggaaaacaggttttgatcttgtttggggatctcagctgcagaagttcacagagcttctgttcagtctgctgccactgaatcatttaggattcarctccaactgcctctgtccctgtgagtattggttcaggatttaaataccctgtggaggagcttgtgcctgttatgtgtttaactctgaagtttaccccaagggaactaagaagttggtcctttcccaaatacaggatgctgactcagaaacagcattgatgtttcatgagtataatcccattttattactttagaaaatataataccataaggccgggcgtggtggctcacgcctgtaattccagcactttgggaggccgaggctggcagatcacaaggtcaggagttcgagaccagcctg

SEQ ID NO: 109647 - DNA, 601 bp, Human
gggtactagtagcttctagaagctgaaaacaatgggaaaacaggttttgatcttgtttggggatctcagctgcagaagttcacagagcttctgttcagtctgctgccactgaatcatttaggattcagctccaactgcctctgtccctgtgagtattggttcaggatttaaataccctgtggaggagcttgtgcctgttatgtgtttaactctgaagtttaccccaagggaactaagaagttggtcctttcccaaatacaggatgctgactcagaaacagcattgatgtttcatgagtatratcccattttattactttagaaaatataataccataaggccgggcgtggtggctcacgcctgtaattccagcactttgggaggccgaggctggcagatcacaaggtcaggagttcgagaccagcctggccaacatggtgaaaccccgtctctactaaaaatacaaaaattagctgggcatggtggcaagcacctataatcccagctactcgggaggctgaggcaggagaattgcttgaacctaggaggcggaggttgtagtgagccgagattgcaccactgcactccagcctgagcgata

SEQ ID NO: 109648 - DNA, 601 bp, Human
ttgcgagactctgtctcaaaaaaaaagaaaaaagaaaatataatagtataaaacttttttctattttactcaacacagaacacttctgtgaccagatgtgtgggttttttttttcttcactcaccaagcaattctcccactctctgaacactagctggaggtcccgtaattcatttcggttctgacatgacctacctggagatagcatcacatcccacaggttaagggcacagtcccacaatactgctcccacttcagatgccaattgcaagtcccaggttatgacctttgcttctgacckaccggctataaatcagggttcccatcataccccttccttggtttcaataatttgctaggatggcttacagaactcaaggaaacacttcagtttactggtttaatataaaggatacacagacagccagatgaagggatgcacattgcaaggtttggggaaggggagtgaagcttccttgccctctccaggtgcatgaccccccaggcacctccacatgttcagcaacctggaagcttgagcctgtaatcccagctacttgggagactgaggcatgagaatcgattaaacctgggagcagag

SEQ ID NO: 109649 - DNA, 601 bp, Human
cctggagatagcatcacatcccacaggttaagggcacagtcccacaatactgctcccacttcagatgccaattgcaagtcccaggttatgacctttgcttctgaccgaccggctataaatcagggttcccatcataccccttccttggtttcaataatttgctaggatggcttacagaactcaaggaaacacttcagtttactggtttaatataaaggatacacagacagccagatgaagggatgcacattgcaaggtttggggaaggggagtgaagcttccttgccctctccaggtgcaygaccccccaggcacctccacatgttcagcaacctggaagcttgagcctgtaatcccagctacttgggagactgaggcatgagaatcgattaaacctgggagcagaggctgcagtgagccgagatctcaccactgcagcctgggcgacagagcgagactcccatctcaaaaaaaaaaaaaaaaaatttttttcatacggctttatctctacactttccctcccttacctttcttgtagattgatgggtggggttgaaggttccaatcctttaatcttctaataacctggtctctctggtga

SEQ ID NO: 109650 - DNA, 601 bp, Human
ggaaacacttcagtttactggtttaatataaaggatacacagacagccagatgaagggatgcacattgcaaggtttggggaaggggagtgaagcttccttgccctctccaggtgcatgaccccccaggcacctccacatgttcagcaacctggaagcttgagcctgtaatcccagctacttgggagactgaggcatgagaatcgattaaacctgggagcagaggctgcagtgagccgagatctcaccactgcagcctgggcgacagagcgagactcccatctcaaaaaaaaaaaaaaaaaatttttttcatacggctttatctctacactttccctcccttacctttcttgtagattgatgggtggggttgaaggttccaatcctttaatcttctaataacctggtctctctggtgagcagcttcatcctgggttatctgtgcactatcttaagtcacctcattagcataaactcaggtatgatcaaaaggggctcatgatgaacaataaaagatactcctcctgctcaggaaatcccaagggttttaagagcttgtgacaggaactgggacaaagacgaagtatatttcatactatacca

SEQ ID NO: 109651 - DNA, 601 bp, Human
gatatcttcttaattgttaccgacaaagtacaagttggggtctagggaattctgttaggaattacgcaagcctgaattctcaaatacatttcagttggtatacattgttgttctgttttcacatacagtagtcaccattctgagcatggttgatttactcaccagtaattgtacacacgaaatgaaatattcttgaatttgtcagaacaaaacatactggcttattgattgagatagtatcaattctattgattaaatgttgggtttcttttgcctcagccatatatgttctttggagctstggttttgtgtagtctcctgacaatttctttcatcccagacatctttggtctaccataatttaatactgttctgtgtttcatggacataaaacacaggagtgagatagtctgatcaagtagaaagaacattcagttgggaactaggaagtaataattctagcctgtctgggtatggtggtttgtgcctgtaatggcagctactcaggtcgctgagatgggaggatcctttgagcccaggagtttgaggccaaagtgagctgtgatggggccactgtgtgtgtagcctgggagacagagca

SEQ ID NO: 109652 - DNA, 601 bp, Human
caaaaccaagaaaagaattctagcttggccctgcagtttaccaagttccttaacctttttgctgtttagtatctccatccacagaatgaaatggttggtctagacctatgctgtacaatacggtagccactggccacatgaaatgtgtttactctgaattgagatatactgtaagtgtaaaatacacacagtttttgaagacatcataagcaaaaacaatgcagaatgtctcagtaattatattttatattgattatatgttgaaatgataatattttgaatatgttgggttaatgtattmttaaaattatttctactggaaaatttaaaaatcacattgtatttctattgaattgtgctcgtttagaatattctagttcattctctgaaattatatttgggattggcacaataatattcagtttacaaaaatttgacaaagggatctaacaaagtgctttagttggtcccagcatttctccttattttagtattaataaagatttttcttattttgggactgctatttaaaaagcagcttgggtcttgcatggtggctcacacctgtaatcctagcattttgggaggctgaggcaggtgg

SEQ ID NO: 109653 - DNA, 601 bp, Human
gctgtttagtatctccatccacagaatgaaatggttggtctagacctatgctgtacaatacggtagccactggccacatgaaatgtgtttactctgaattgagatatactgtaagtgtaaaatacacacagtttttgaagacatcataagcaaaaacaatgcagaatgtctcagtaattatattttatattgattatatgttgaaatgataatattttgaatatgttgggttaatgtattattaaaattatttctactggaaaatttaaaaatcacattgtatttctattgaattgtgctsgtttagaatattctagttcattctctgaaattatatttgggattggcacaataatattcagtttacaaaaatttgacaaagggatctaacaaagtgctttagttggtcccagcatttctccttattttagtattaataaagatttttcttattttgggactgctatttaaaaagcagcttgggtcttgcatggtggctcacacctgtaatcctagcattttgggaggctgaggcaggtggattgtttgagcccaggaattcgagaccatcttgggcaacatggcgaaactccacctctac

SEQ ID NO: 109654 - DNA, 601 bp, Human
tagattccttgcttttctgcttgtttacagtagggaatttcttttctgttaacttttaaaattttgagttaggcagacccctcaccctacaaccagaattgattcaaagagactcccagagctttttttttttttttgagaaggagtctcactctgttgcccaggatggagtgcagtggcgcgatctccacgatctcagctcactgcaacttccgcctcccaggttcaagcaattctcctgcctcagcttcccaggtagctgggattacaggcttataccaccacacccagctaatttttrtaattattattattattattttttagtagagagtggattttgccaagttagccacgctggtctcaaactcctgatctcaggtgatccacccgcctcggcctctcaaagtgctgggattacaggcatgagccaccacacctggcctcttttttttttttttttttgccacagagtctggctctgtcacccaggctggagtgcaatggtgcaatctcggctcactgcaacttctgcctcccaggttcaagctattctcctgcctcagcctcccaagtagctgggattacaggcacccaccac

SEQ ID NO: 109655 - DNA, 601 bp, Human
gatggagtgcagtggcgcgatctccacgatctcagctcactgcaacttccgcctcccaggttcaagcaattctcctgcctcagcttcccaggtagctgggattacaggcttataccaccacacccagctaatttttgtaattattattattattattttttagtagagagtggattttgccaagttagccacgctggtctcaaactcctgatctcaggtgatccacccgcctcggcctctcaaagtgctgggattacaggcatgagccaccacacctggcctcttttttttttttttttttgccacagagtctggctctgtcacccaggctggagtgcaatggtgcaatctcggctcactgcaacttctgcctcccaggttcaagctattctcctgcctcagcctcccaagtagctgggattacaggcacccaccaccatgcccggctaatttttgtgtttttagtagagacgggttttatcatgttgaccaagctggtctcaaactcctgacctcaggtaatctgcccgcttcagcctccccaaatgctgggattacaggcgtgagccaccgcttctggcctgagactcccagagatttt

SEQ ID NO: 109656 - DNA, 601 bp, Human
actgcaacttccgcctcccaggttcaagcaattctcctgcctcagcttcccaggtagctgggattacaggcttataccaccacacccagctaatttttgtaattattattattattattttttagtagagagtggattttgccaagttagccacgctggtctcaaactcctgatctcaggtgatccacccgcctcggcctctcaaagtgctgggattacaggcatgagccaccacacctggcctcttttttttttttttttttgccacagagtctggctctgtcacccaggctggagtgcratggtgcaatctcggctcactgcaacttctgcctcccaggttcaagctattctcctgcctcagcctcccaagtagctgggattacaggcacccaccaccatgcccggctaatttttgtgtttttagtagagacgggttttatcatgttgaccaagctggtctcaaactcctgacctcaggtaatctgcccgcttcagcctccccaaatgctgggattacaggcgtgagccaccgcttctggcctgagactcccagagatttttaaggaaggtcaagagttagctttaacaatcacactag

SEQ ID NO: 109657 - DNA, 601 bp, Human
ctagagcttacttcttgagtattatgaagaaaataccagtatttttctcatggatatttcaagtatttaaatcatttaggcagatcatttgactcaacacattttctttgatcatacgacatttgcatagacttgtaccatataattgccccctcagttcccatttatacatgtactgtgcagatgccaaaggacgtaaacatggggcccagctagcacaatgacacagcctcctgaattgagccagcatattcctcttggctggatgtccactgctggctaatgcagcctttcagatgcyggtttcagagttttcaggagctgtgggtcgggcacagcaggagttaaggggataatactggtaatattttctctgctcatttggtataagttatgtctccctgacgtcctctggtcatgaaatcctgtttgatactcccttcaagttcctgcctctagcactggctgaatttaggcttttcctcattattccttgcctgtgtctgctgcagcttctggagttcttatttccattcctgcatacctggctttcccataaagtgatgatacaatgtgatcccattctcctgcttaacccctc

SEQ ID NO: 109658 - DNA, 601 bp, Human
ttcctcattattccttgcctgtgtctgctgcagcttctggagttcttatttccattcctgcatacctggctttcccataaagtgatgatacaatgtgatcccattctcctgcttaacccctctgagcttctcattatcctcagagtgaagggtgatctgtagttgagcaagcaggttcagttcattgaggcctctttattttcaaagcttttctccaattatcttcattgcattttggccatcaggctgctccatgttctccaaaggttctttgaactttctcccacctctgccttagatytggaagctcacaccaccttcaatgcctttccttcattttctgccagggaattctgcttatcctccaaggcttgactgcagaactctgtagagagaataaaggccttcttagagctctgtggcaatgttccttcttatataactataattatataccaatctgtactgaactgtgattaagagttgactttttctctagtttgtaatatatttagttcgttgtgcataattgtgcttattcttttgttggtaaatagtcattgaattcaataatggtaaaatgagggctggttgcatatat

SEQ ID NO: 109659 - DNA, 601 bp, Human
attagtgtatatcaatgctttgtatcaggctcttggaagactatttaaagtaaaagcaggattctttaatgatcaaattcaggtggaggaaagattgtaaaaacacttttaatttgcaaataattaaaaatttacataaaagtcatgagaataataacgaagaatatcccataaatcctttccctagatttacctattagtaacattttattttatttgctgtcattggctcatatatatatatatatatgtataaatgtatatagagagtctcatatatatatatatatgagtctctacrtataaatttgtttttctggaactatatgagaataagttacttatatatcatagcccttcctcccctaaatatttcaatatacagttcctaataataaggttttctttttttgaaatggagacccactctgttgctcaggctggagtgcaatggtgcagtcttggcttactgcagcctccacctcctgggttcaaatgattctcatgcctcagcctcccaagtagctgggattacagatgcctgccaccatgcccagctaatttttttatttttagtagagatggggtttcatcatgttgg

SEQ ID NO: 109660 - DNA, 601 bp, Human
agttcctaataataaggttttctttttttgaaatggagacccactctgttgctcaggctggagtgcaatggtgcagtcttggcttactgcagcctccacctcctgggttcaaatgattctcatgcctcagcctcccaagtagctgggattacagatgcctgccaccatgcccagctaatttttttatttttagtagagatggggtttcatcatgttggccaggctggtctcgaactactgacctcaaatgatccgccctcctcagcctcccagagtgttgggattacaggcttgagccacygcacccggccacggttttctcttaataacctcagttcaattaccaactttagtaaatttaacattaatataatacctttatctaatctactgtttgtattctaattttatctgttgacccaaaaatgttctttataacatattttcctttccattaagcctccactcaagaatcacatatctgtttagttgtcatgtctctttagttttctttaatctggagttcctcagcattttattttatttgttgacttttataacattgacattttgatggaggaatgttttaaattttaaaaac

SEQ ID NO: 109661 - DNA, 601 bp, Human
gttgtttaaggaaagtggtattttaggaagactaccctggcagcagagagaacagtctagggggctattttattatagtaggtttgacattccaatggaagaaaggtaggatggggaaatgcagtgtctctgagagagaatgaggaagctcagtggagtctggtggctggtaatgtgtggaaggtaaaggacactaaaggaatgaatgatgggcttgttggcagaaacagggccagcaagaggtagctgccattttgaggagggccatgaggagttcagtctttgagtcattttccgtgayggtggtgcacctattttgttgggatagggaggatggaaggtggggttcggggaagattggagctggagaagaggttagctggtgatgtgtatttgttgagaacagaaagttcagcgctacttcctcagagattgagttaggtgagagctgaaaaggatttttggtcaaaagggatctgtagttggcctccttggagaggggctacattggagggtctgagaagttggcacatttagacaactacgtatttatatagtgtagtcatagctgttcttgtctggctttcttattacagggaag

SEQ ID NO: 109662 - DNA, 601 bp, Human
gaggatcgcttaagctcaggaggtcaaggctgcagtgagccaagatcgcaccattgcactccagcttggatgaccaagggagaccctgtcttgacactgccccaccccacaaaaatgctgtattggggtgcacacccatgcatattcctcatcatgggtccatcactctgcctttcaattacttttctgtattagaaatgaaaggtgggtggcctctacctctctaattttaagccctttaaactgtcttcctctaggacatttgtgttatttaaaaacaaatagatttttttttttttttgagatggagtctcgcaggctggagtgcagtggcgcagtctcggctggagtgcagtggtgcaatctcagctcaccacaacctccacctcctggattcaagtcattctcctgcctcagcctcccaagtagctaggattacaggcatgtgcccccatgcctggataatttttatattttgagtagagatggggtttcaccatgttggccaggctgcttttgaactcctgacctcgtgatccacctgccttggccttccaaagtgctgagataacaggcgtgagccactgcgcctggctgagat

SEQ ID NO: 109663 - DNA, 601 bp, Human
ggccagaatgcagtggtacaatcatagttcactgtagcctcaaactcctgggctcaagggatcctcttgccttaggttgctaagtaactagggctacagatctgagccaccatacctagctaattaaaaaaaattttttttttgtagagacagggtcttgccatcttaccaaggctggtcttgaactgggctcaagcagtcctcctacttcagccttccaaagtgctaggattacaggtgtgagccactgtgcctggccatttccttagtttttaaggctgaatagtatttgattgtgttsatatactacattctctttatccattcatttgttgggttggacacttaggtaaattccatattttggctattgtgaataatgctgcagtgaatatgggaatgcagatgtctttttgacatactgatttccttttctttggatatatatccagaagtggaattgctgggtcaggtcatatggtagttctgttttggattttttgagacatatccatatggtttaccatactggctgtactaatttacattcccaccaacagtgtgcaagggttccttgtcctcacattcttgccaacactca

SEQ ID NO: 109664 - DNA, 601 bp, Human
cctcaaactcctgggctcaagggatcctcttgccttaggttgctaagtaactagggctacagatctgagccaccatacctagctaattaaaaaaaattttttttttgtagagacagggtcttgccatcttaccaaggctggtcttgaactgggctcaagcagtcctcctacttcagccttccaaagtgctaggattacaggtgtgagccactgtgcctggccatttccttagtttttaaggctgaatagtatttgattgtgttcatatactacattctctttatccattcatttgttgggktggacacttaggtaaattccatattttggctattgtgaataatgctgcagtgaatatgggaatgcagatgtctttttgacatactgatttccttttctttggatatatatccagaagtggaattgctgggtcaggtcatatggtagttctgttttggattttttgagacatatccatatggtttaccatactggctgtactaatttacattcccaccaacagtgtgcaagggttccttgtcctcacattcttgccaacactcatctttcatctttttgataatagctatcctgagcgtga

SEQ ID NO: 109665 - DNA, 601 bp, Human
cctcccaaagtgctgggactcccagtgtgagccactgcgcctggcctactttctttcatcagtgttttatagtttgcagtgtacatatctttcatctccttggctaaatttattcctaggtatttgattgtttttgatgctgttataaatgagattgtttccttgattttttgttttgttttgatagtttgttgttagtatacagaaacatggctgggcatggttactcttgcctgtaatcccaatgctttaggaggtggaaggattgcttgagcccagaatttgagaagaacagcttggrcaacatagtgagaagccatctctattaaaaaacaaacaaaaaaaaaaacaaaacaagaaaaaaaaaacgaatggtactgatctttgtgtgttgattttgtatcctgcaactttactgagtttgtttattagttttaaaagctttttggtggtgtctttagggttttctgtttataaaattatgttatctgcagagacaatttaacttcttcttttctgatttggatactttcatttctttttcttacttaattgctttggctaggacttccaatactacgttgaaaagaagtggcaaggg

SEQ ID NO: 109666 - DNA, 601 bp, Human
tggcctactttctttcatcagtgttttatagtttgcagtgtacatatctttcatctccttggctaaatttattcctaggtatttgattgtttttgatgctgttataaatgagattgtttccttgattttttgttttgttttgatagtttgttgttagtatacagaaacatggctgggcatggttactcttgcctgtaatcccaatgctttaggaggtggaaggattgcttgagcccagaatttgagaagaacagcttgggcaacatagtgagaagccatctctattaaaaaacaaacaaamaaaaaaacaaaacaagaaaaaaaaaacgaatggtactgatctttgtgtgttgattttgtatcctgcaactttactgagtttgtttattagttttaaaagctttttggtggtgtctttagggttttctgtttataaaattatgttatctgcagagacaatttaacttcttcttttctgatttggatactttcatttctttttcttacttaattgctttggctaggacttccaatactacgttgaaaagaagtggcaagggtgggtatatttttcttgttcttaatcttaaaggaaaagctt

SEQ ID NO: 109667 - DNA, 601 bp, Human
tatagtttgcagtgtacatatctttcatctccttggctaaatttattcctaggtatttgattgtttttgatgctgttataaatgagattgtttccttgattttttgttttgttttgatagtttgttgttagtatacagaaacatggctgggcatggttactcttgcctgtaatcccaatgctttaggaggtggaaggattgcttgagcccagaatttgagaagaacagcttgggcaacatagtgagaagccatctctattaaaaaacaaacaaaaaaaaaaacaaaacaagaaaaaaaaaacgaatggtactgatctttgtgtgttgattttgtatcctgcaactttactgagtttgtttattagttttaaaagctttttggtggtgtctttagggttttctgtttataaaattatgttatctgcagagacaatttaacttcttcttttctgatttggatactttcatttctttttcttacttaattgctttggctaggacttccaatactacgttgaaaagaagtggcaagggtgggtatatttttcttgttcttaatcttaaaggaaaagctttcagcttctcaccattgagtgtgatg

SEQ ID NO: 109668 - DNA, 601 bp, Human
cattgagtgtgatgttaattgtgggtttgtcacatacggcctttttgtgttgaggtacagcacattccctctatgcctaatttgttgagagtttttatcatgaaaggatgttgaattttgtcaaatgctttttctgtatctttagagattaccatatgatttttctccttcattctgttaatttgctgtatcaatttattgctgaaccatccttgcatccctgggattaattcctcttgctcgtggtgaaggattcttttaatctgctgttgaattcagattgctggttttctgttgtgtwttttcgcatccatgttcatcagggatattggcctgtaatattcttttcttgtagtttccttgtctggctttggtattagtataatactgaccttgtaaagtgagtttggaagtatgcatccctcttcagttttttgaagtttttttttagagtttcactttgtcataaaggctggagtatagtggcacaagcatgggtcactgcaacctcaatcttgtggggtgggttcaagcaatcctcccacctcagcctcctgagtagctgggactacaggcatgtgacaccacacctgcctaattt

SEQ ID NO: 109669 - DNA, 601 bp, Human
gagagtttttatcatgaaaggatgttgaattttgtcaaatgctttttctgtatctttagagattaccatatgatttttctccttcattctgttaatttgctgtatcaatttattgctgaaccatccttgcatccctgggattaattcctcttgctcgtggtgaaggattcttttaatctgctgttgaattcagattgctggttttctgttgtgtattttcgcatccatgttcatcagggatattggcctgtaatattcttttcttgtagtttccttgtctggctttggtattagtataatrctgaccttgtaaagtgagtttggaagtatgcatccctcttcagttttttgaagtttttttttagagtttcactttgtcataaaggctggagtatagtggcacaagcatgggtcactgcaacctcaatcttgtggggtgggttcaagcaatcctcccacctcagcctcctgagtagctgggactacaggcatgtgacaccacacctgcctaatttttatttatttatttttattttttgtagaaacagggtctcactatgttgtgcaggcttgtcttgaactcctaggcttaagcatttct

SEQ ID NO: 109670 - DNA, 601 bp, Human
atttttctccttcattctgttaatttgctgtatcaatttattgctgaaccatccttgcatccctgggattaattcctcttgctcgtggtgaaggattcttttaatctgctgttgaattcagattgctggttttctgttgtgtattttcgcatccatgttcatcagggatattggcctgtaatattcttttcttgtagtttccttgtctggctttggtattagtataatactgaccttgtaaagtgagtttggaagtatgcatccctcttcagttttttgaagtttttttttagagtttcastttgtcataaaggctggagtatagtggcacaagcatgggtcactgcaacctcaatcttgtggggtgggttcaagcaatcctcccacctcagcctcctgagtagctgggactacaggcatgtgacaccacacctgcctaatttttatttatttatttttattttttgtagaaacagggtctcactatgttgtgcaggcttgtcttgaactcctaggcttaagcatttctcctacctcagcctcctgaagtgctgggattataggcatgagccactgcacttgggctttttgaagagtttga

SEQ ID NO: 109671 - DNA, 601 bp, Human
ttgagatcttttttcttttttaatataggcatttattgccataagcttctttcttagaactgcttttgctgcattttgtaagttttggtatattgtatttccacttctgtttgtcttaagatatttttaaatttcccttttaagttcttctctgacccattggttgttcaggagaatgctgtttaatttcaacctatttgtaaattttccaaaattcctcctgttaatgatttatataggttggtccaaaataattgcggtttttgccattgaaaggaatggcaaaaatgctattattttkgcaccaatccaatactttcctaccagtgtggttggaatagacagttggtatgatttcagtcttttaaaagttgttaagacttgttttatggactatcatctgatctgtcctagagaaaatttcatgtgcacttgagaagaatgtgtattctactctcattgaatggaatgttctgtatatgtctgttaggtccattttctttaaagtatagttcaagcccagtgctttgtcattgattttctgtgtaaatgatttatccattgttgaaagtgtaatattgaagtcccctactattattgt

SEQ ID NO: 109672 - DNA, 601 bp, Human
tcctcctgttaatgatttatataggttggtccaaaataattgcggtttttgccattgaaaggaatggcaaaaatgctattatttttgcaccaatccaatactttcctaccagtgtggttggaatagacagttggtatgatttcagtcttttaaaagttgttaagacttgttttatggactatcatctgatctgtcctagagaaaatttcatgtgcacttgagaagaatgtgtattctactctcattgaatggaatgttctgtatatgtctgttaggtccattttctttaaagtatagttcwagcccagtgctttgtcattgattttctgtgtaaatgatttatccattgttgaaagtgtaatattgaagtcccctactattattgtatttcattctatctctactttcacatatttatttatttatttatttattttttatttatttgagatggagtgttgctctgttgcctaggctggagtgcagtggcatgatctaggctcactgcagcctccacctcacaggttcaagtgatcctctcccatcagcctctcaagtagctgggattacaagcatgtgccgccacatccagcttattttt

SEQ ID NO: 109673 - DNA, 601 bp, Human
caatactttcctaccagtgtggttggaatagacagttggtatgatttcagtcttttaaaagttgttaagacttgttttatggactatcatctgatctgtcctagagaaaatttcatgtgcacttgagaagaatgtgtattctactctcattgaatggaatgttctgtatatgtctgttaggtccattttctttaaagtatagttcaagcccagtgctttgtcattgattttctgtgtaaatgatttatccattgttgaaagtgtaatattgaagtcccctactattattgtatttcattcwatctctactttcacatatttatttatttatttatttattttttatttatttgagatggagtgttgctctgttgcctaggctggagtgcagtggcatgatctaggctcactgcagcctccacctcacaggttcaagtgatcctctcccatcagcctctcaagtagctgggattacaagcatgtgccgccacatccagcttattttttgcattttcagtagagacgaggtttcaccatgttggccccactggtctcaaactcctgacctcacatgatccacccaccttgtcctcctaaagtg

SEQ ID NO: 109674 - DNA, 601 bp, Human
tacaagcatgtgccgccacatccagcttattttttgcattttcagtagagacgaggtttcaccatgttggccccactggtctcaaactcctgacctcacatgatccacccaccttgtcctcctaaagtgctgggattacaggcatgagccactgtgcccagctcagatttattaatgtttgctttatattatattatatatatattttatatatttacagcaaacattaggtgctgtaacattaggtacatgtgtatttacagttgttatatcctcttgatgaattgatccctttatcatyatataatgccctttttggtctctgtatcgttttttgttgttgttgttgtttttgagatggagtctccctctgtcactaggctggagtgcactggtgtgatgtcggctcactgcaatctccgcctcctgggttcaagcaattctcctgcctcagcctcctgagtagctagaactacaggcacgcaccaccatgcccagctaatttttgtatttttagtagagatggggtttcaccatattggacaggctggtctcgaactcctgaccttgtgattcgactgcctcagcctcccaaagtgct

SEQ ID NO: 109675 - DNA, 601 bp, Human
tgggttcaagcaattctcctgcctcagcctcctgagtagctagaactacaggcacgcaccaccatgcccagctaatttttgtatttttagtagagatggggtttcaccatattggacaggctggtctcgaactcctgaccttgtgattcgactgcctcagcctcccaaagtgctgggattacaggtgtgagccaccgtgcccagccagtttttcacataaagtccattttgtctgatataaacatagctgctcctgctccttcaggatcccctaccccttggtgtttaatcctcttaactytctgaaaatgcatttgtttagacatgttagtttgagttccccaagaaacagactctgagacaaggatttgagtgcaagtagtttatttgggttgagagtaggagagttaaaagtgaaacactgaggaaaaggtggccaataaagagtgaattactaagccagctctcactgtgggcaactggtactcaattctgtgcaggaataattgggagctggtgtagaacacttacctcagagttattccatctgaagagtgaggaaatgagtatttataccctaacttctttagtctttggctaa

SEQ ID NO: 109676 - DNA, 601 bp, Human
ggttcaagcaattctcctgcctcagcctcctgagtagctagaactacaggcacgcaccaccatgcccagctaatttttgtatttttagtagagatggggtttcaccatattggacaggctggtctcgaactcctgaccttgtgattcgactgcctcagcctcccaaagtgctgggattacaggtgtgagccaccgtgcccagccagtttttcacataaagtccattttgtctgatataaacatagctgctcctgctccttcaggatcccctaccccttggtgtttaatcctcttaactttmtgaaaatgcatttgtttagacatgttagtttgagttccccaagaaacagactctgagacaaggatttgagtgcaagtagtttatttgggttgagagtaggagagttaaaagtgaaacactgaggaaaaggtggccaataaagagtgaattactaagccagctctcactgtgggcaactggtactcaattctgtgcaggaataattgggagctggtgtagaacacttacctcagagttattccatctgaagagtgaggaaatgagtatttataccctaacttctttagtctttggctaaga

SEQ ID NO: 109677 - DNA, 601 bp, Human
agtcttacatggcagcaggagagagagagcgagcgagcgaggagggacctgccaaacacttttaaacatcagatctcatgagaactcactatcatgagaacagcatgggggaaactgcctccatgatccaatcacttcccagcaggtccctcccttgacatgtggggattgcaatttgagatgatgtttgggtggagacacagagccaaaccatatcagagccttagtttcctcaattgtaaaatgcaattactaataccgaccgcatgggattggggattaaatgtaataaccttaaaasatggactgtatttgagtagaagagatcacaaagggatgagtgaggagagagtcaatggacaggtcacaaaactatagtaagacaacagaacaaagatgcaaaagtgggtttgcagctggatcacggaggatgttgaatgtcaagctaaaataggccgtggggactttgcagcagacagtgaggttttagtgtgtctcaatcagaaaggctgaagaaaaaggccttcagtctttacactgtcatgatattctttggtgaatgagctctccacaggacttagagctatacctttagggagct

SEQ ID NO: 109678 - DNA, 601 bp, Human
gctatacctttagggagcttggttttctgcatctctgaaccaccaacttacaagtcctgcattcatgactaggaccatagagaaccctcttgacatggtggagaatttgcttatatggaaacctaagaagttgaccctattaggaccagtcttgatgctaccagtactgattcttaaaatatacattatttgcatacattagccaccagcccatttttaacgttgggtggggaggctaaggctcaagaacatggtagtctcttaattataggtagattttgtgagaagacttcagtcctayaggagttcagaaattttctcttattaccagtgatcttaaaggattgatggtaagactgatgaaagaggaccgtccacttaaaaatggggaatgtttggtttccaattgaggtcttacatatgtttctttgatcttatcataagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaaggtgagatttta

SEQ ID NO: 109679 - DNA, 601 bp, Human
agcagagggttgggtgggaggagatgtagttggaggagtggctgtaagtcctatctctaatgctttaagaggaggaatcaacatattccaaatttattttggtaacttagccactgttacctgtttctcactgacaccagtcaccgattactgctgccattccccgtagctgcctcttcactagttctacctcagctccatgtgggtcacatccattccctactatagacatacatctcctcaagcttctgattagagccaggactaacgatgtgggaaggaaactggtggtggaaatggrtagcaaaacttcaggttgccaaaaatagatctataaaggaggctgccagaaggaataaccttaaaaaaaaataaacctgctactgagggcatagtagattatgttgtattgtgtaacccttacaaggatgttgaaagcaaaacaaaagcactcagagcttatgggtaggaaaagtttgcctcttctaataagaagcactgtgcttcattttataataactctccttcaactcatttatatttatttgtacttcatttttatatgacaaaaatagctaaattttccagtgagttccctctt

SEQ ID NO: 109680 - DNA, 601 bp, Human
ctgttggaagtgaaggtggtgtcaaggtttccatcctgtcagcctctatttagtttataaccaaccaaacaagccagaaagcattgctctgctttaaagtacatcttctctctctttcttccctccttcatcttaaaataacagtgcaaatatatttgcttgtggaaacacaatccaaaatattcagcattctccccacctcctgcaaaaagtattattcttgggcaaataagttataaataatctattccttagcttctgaaaggcaattcctaaaaacaaaacaaaaataatgattaaatttttttttaattttaacttttttgagacagaatcttactctgtcatccaggctagagtgaagtggtgtgatctcagctcactgcaacctccaccacctgagttcaagtgattctcctgcctcagcctcctgagtagctgggattacaggtgtgtgccgccatgcccggctaatatttgtatttttagtagagatggggtttcacattgtcggccatgcttgtcttgaactcctagcttcaagtgatctcccccctcggccttccaaagtgctgggattacaggcatgagccactgcatc

SEQ ID NO: 109681 - DNA, 601 bp, Human
ttcttgggcaaataagttataaataatctattccttagcttctgaaaggcaattcctaaaaacaaaacaaaaataatgattaaatttttttttaattttaacttttttgagacagaatcttactctgtcatccaggctagagtgaagtggtgtgatctcagctcactgcaacctccaccacctgagttcaagtgattctcctgcctcagcctcctgagtagctgggattacaggtgtgtgccgccatgcccggctaatatttgtatttttagtagagatggggtttcacattgtcggccaygcttgtcttgaactcctagcttcaagtgatctcccccctcggccttccaaagtgctgggattacaggcatgagccactgcatctggcccatgattttttaaaaagaaaaaaagagaaaggcagttcctgtgtctcatgtgtcaataattaaagtaaaaatgtgttacatattttagtagaattaaaaaatttcagtcttagtctgggcacggtggctcacaactgtaatcccagaactttgggaggctgaggcaggcccattacctgaggtcaggggttcaagaccagcctggcaaacat

SEQ ID NO: 109682 - DNA, 601 bp, Human
aataatctattccttagcttctgaaaggcaattcctaaaaacaaaacaaaaataatgattaaatttttttttaattttaacttttttgagacagaatcttactctgtcatccaggctagagtgaagtggtgtgatctcagctcactgcaacctccaccacctgagttcaagtgattctcctgcctcagcctcctgagtagctgggattacaggtgtgtgccgccatgcccggctaatatttgtatttttagtagagatggggtttcacattgtcggccatgcttgtcttgaactcctagcytcaagtgatctcccccctcggccttccaaagtgctgggattacaggcatgagccactgcatctggcccatgattttttaaaaagaaaaaaagagaaaggcagttcctgtgtctcatgtgtcaataattaaagtaaaaatgtgttacatattttagtagaattaaaaaatttcagtcttagtctgggcacggtggctcacaactgtaatcccagaactttgggaggctgaggcaggcccattacctgaggtcaggggttcaagaccagcctggcaaacatggtgaaactctgtctctataa

SEQ ID NO: 109683 - DNA, 601 bp, Human
ttgggaggctgaggcaggcccattacctgaggtcaggggttcaagaccagcctggcaaacatggtgaaactctgtctctataaaaatacaaaaattagccaggtgtggttgtgtgcacctgtaaattccagctacttgagaggctgaggcaggagaattgcttgagtccgggatgcagaggttgccatgagctgagatcatgccactgcacttccaacctggccgacagagtgagacaacgtcccaaattaaaaaaaaaaaaaagtcagtcttagatgttgaacataaacccaatggaaasctgcgtcctaaagttgaagtatatcttagtgcttacaaatgtggcgctggagtctaactacctgggtttaaaactttgctctatcacttactaaatgtgactttgggcaagttaatctgccttgttagtagtagcacctacctcaaaaggttgtaagtattaaatgagataatatatgtgaagaaccatgaagattgtctgttgaaattaaggatgcaaatgcctgctgctattaagaacttttttttatatgcacacttatcccagcttcatcatcttatagataaactgaagttcaac

SEQ ID NO: 109684 - DNA, 601 bp, Human
aggttgccatgagctgagatcatgccactgcacttccaacctggccgacagagtgagacaacgtcccaaattaaaaaaaaaaaaaagtcagtcttagatgttgaacataaacccaatggaaagctgcgtcctaaagttgaagtatatcttagtgcttacaaatgtggcgctggagtctaactacctgggtttaaaactttgctctatcacttactaaatgtgactttgggcaagttaatctgccttgttagtagtagcacctacctcaaaaggttgtaagtattaaatgagataatatatrtgaagaaccatgaagattgtctgttgaaattaaggatgcaaatgcctgctgctattaagaacttttttttatatgcacacttatcccagcttcatcatcttatagataaactgaagttcaacatctccacaatccatcagtttacctccaaattgaaacccccaaatgggccaagttcctaaatggtcttattttaactggggaaaaaaagtaagcaaccagaattatttgtatttaatttttatgaccaatctttagatattcttagaaacatatacaatgacttatctttattgctaa

SEQ ID NO: 109685 - DNA, 601 bp, Human
gctgagatcatgccactgcacttccaacctggccgacagagtgagacaacgtcccaaattaaaaaaaaaaaaaagtcagtcttagatgttgaacataaacccaatggaaagctgcgtcctaaagttgaagtatatcttagtgcttacaaatgtggcgctggagtctaactacctgggtttaaaactttgctctatcacttactaaatgtgactttgggcaagttaatctgccttgttagtagtagcacctacctcaaaaggttgtaagtattaaatgagataatatatgtgaagaaccatsaagattgtctgttgaaattaaggatgcaaatgcctgctgctattaagaacttttttttatatgcacacttatcccagcttcatcatcttatagataaactgaagttcaacatctccacaatccatcagtttacctccaaattgaaacccccaaatgggccaagttcctaaatggtcttattttaactggggaaaaaaagtaagcaaccagaattatttgtatttaatttttatgaccaatctttagatattcttagaaacatatacaatgacttatctttattgctaatttgcttttata

SEQ ID NO: 109686 - DNA, 601 bp, Human
gtctaactacctgggtttaaaactttgctctatcacttactaaatgtgactttgggcaagttaatctgccttgttagtagtagcacctacctcaaaaggttgtaagtattaaatgagataatatatgtgaagaaccatgaagattgtctgttgaaattaaggatgcaaatgcctgctgctattaagaacttttttttatatgcacacttatcccagcttcatcatcttatagataaactgaagttcaacatctccacaatccatcagtttacctccaaattgaaacccccaaatgggccamgttcctaaatggtcttattttaactggggaaaaaaagtaagcaaccagaattatttgtatttaatttttatgaccaatctttagatattcttagaaacatatacaatgacttatctttattgctaatttgcttttataaagatgggcataatacttgaaaggatgaacagatgccccatactcataatttgtatggcacccctggaaggagttgaggtccttgtaagacacagttcagtggtgagacatggtcatcttcaatcttggtggttcatcaggttccatttacccctgagagaa

SEQ ID NO: 109687 - DNA, 601 bp, Human
tgagagctttaaattccagtggcaggaattaagagcagtgtttttgttttgtgggcattgagatgccagaacagttggcctgcattctacggatggaagggaaatgaaaaaaagactgtaacagtgaaagttgcccatttagagctctgcagactttcttcctaaagagcctgtgccctagatgatgcgtatgccgtgcagctgctgtagacagctcctgtcccctggcctcttttgtgcagaatagatcttggtctctcacgtctttaaataagatcctctagagcttcagcacacctayggtggcctggatgggcatgtgccaagtgtgtagggttgcataccaggcctctgggtcaatggaaagccagaaacagtggggagaagagggaagtgcatgggacggtggtgtctgttggaccagcatgggtggcctaggctgcccagaacatgaaaggtgtccatttcttcataactctggccgtggacatgaaggccaatttgggttacctgatagttgcccattttattgacttaaggatttgtttatatatagttaagataaatagaatatggtaacttcctttaaaggctgtgtgtg

SEQ ID NO: 109688 - DNA, 601 bp, Human
gagagctttaaattccagtggcaggaattaagagcagtgtttttgttttgtgggcattgagatgccagaacagttggcctgcattctacggatggaagggaaatgaaaaaaagactgtaacagtgaaagttgcccatttagagctctgcagactttcttcctaaagagcctgtgccctagatgatgcgtatgccgtgcagctgctgtagacagctcctgtcccctggcctcttttgtgcagaatagatcttggtctctcacgtctttaaataagatcctctagagcttcagcacacctacrgtggcctggatgggcatgtgccaagtgtgtagggttgcataccaggcctctgggtcaatggaaagccagaaacagtggggagaagagggaagtgcatgggacggtggtgtctgttggaccagcatgggtggcctaggctgcccagaacatgaaaggtgtccatttcttcataactctggccgtggacatgaaggccaatttgggttacctgatagttgcccattttattgacttaaggatttgtttatatatagttaagataaatagaatatggtaacttcctttaaaggctgtgtgtgt

SEQ ID NO: 109689 - DNA, 601 bp, Human
ctgcattctacggatggaagggaaatgaaaaaaagactgtaacagtgaaagttgcccatttagagctctgcagactttcttcctaaagagcctgtgccctagatgatgcgtatgccgtgcagctgctgtagacagctcctgtcccctggcctcttttgtgcagaatagatcttggtctctcacgtctttaaataagatcctctagagcttcagcacacctacggtggcctggatgggcatgtgccaagtgtgtagggttgcataccaggcctctgggtcaatggaaagccagaaacagtgrggagaagagggaagtgcatgggacggtggtgtctgttggaccagcatgggtggcctaggctgcccagaacatgaaaggtgtccatttcttcataactctggccgtggacatgaaggccaatttgggttacctgatagttgcccattttattgacttaaggatttgtttatatatagttaagataaatagaatatggtaacttcctttaaaggctgtgtgtgtgtgtgtaagagagagagagagagacagacagaaacagaagagagaggagagagagagagacataccaattaagttttt

SEQ ID NO: 109690 - DNA, 601 bp, Human
aatggaaagccagaaacagtggggagaagagggaagtgcatgggacggtggtgtctgttggaccagcatgggtggcctaggctgcccagaacatgaaaggtgtccatttcttcataactctggccgtggacatgaaggccaatttgggttacctgatagttgcccattttattgacttaaggatttgtttatatatagttaagataaatagaatatggtaacttcctttaaaggctgtgtgtgtgtgtgtaagagagagagagagagacagacagaaacagaagagagaggagagagagakagacataccaattaagtttttctttttcttttttttaatgatttctttgcagctcttgagaaagtctattttacaaagaggaaaacctgtggttgaaggctctttggaaaagaaacccccatttgaaaaacctagcattgaacaggtaaaaagattttaaaagccctctttttattggctcaaggctgaagaaatcttttaatcctccttttatatctctatctacggcttccctcctccatacccaggttagagatgtttaccagtctgtggaaattgtcctggaggctttggatcaga

SEQ ID NO: 109691 - DNA, 601 bp, Human
tgttggaccagcatgggtggcctaggctgcccagaacatgaaaggtgtccatttcttcataactctggccgtggacatgaaggccaatttgggttacctgatagttgcccattttattgacttaaggatttgtttatatatagttaagataaatagaatatggtaacttcctttaaaggctgtgtgtgtgtgtgtaagagagagagagagagacagacagaaacagaagagagaggagagagagagagacataccaattaagtttttctttttcttttttttaatgatttctttgcagctyttgagaaagtctattttacaaagaggaaaacctgtggttgaaggctctttggaaaagaaacccccatttgaaaaacctagcattgaacaggtaaaaagattttaaaagccctctttttattggctcaaggctgaagaaatcttttaatcctccttttatatctctatctacggcttccctcctccatacccaggttagagatgtttaccagtctgtggaaattgtcctggaggctttggatcagaggtgtatacctaatttaatacatgatctagcttttgccttttagggttgttacat

SEQ ID NO: 109692 - DNA, 601 bp, Human
tgatgagaatgactactgaagtcatgataccagaatccttaaaaataaatgcatttttatcagtcagttttcagtaaattttattttgcctccaaactctattaaataagaattcattgctcttttatttgaaattagatgagatggaaatattctgtagaaagattaaattaacagtttttttaaaagcccataattttgaatgatatatatattttggtaagcttattgacttcaaacaaatgatagtaaagagtttaaattttagttgtttagttcagtggtaggcatgatagcaggyttttgattagcatttttgtaatgtaaaaacaatatttatctaagaactgcattatatgtgggctactctgctgatagtaaagcaataattattctgcacaacagtcatattttcttgtttcaggggttttgaccttttcagtccatggttttgattttctccttaatgcttcaggatttcagcaggcgtagaatcacaactcacagcctctctgtcttgtcacttttcatccaccgtgatctgaggcaagattccctctggggattgctattttcttttagggaaaaggaagagattttt

SEQ ID NO: 109693 - DNA, 601 bp, Human
tagtaaagagtttaaattttagttgtttagttcagtggtaggcatgatagcaggcttttgattagcatttttgtaatgtaaaaacaatatttatctaagaactgcattatatgtgggctactctgctgatagtaaagcaataattattctgcacaacagtcatattttcttgtttcaggggttttgaccttttcagtccatggttttgattttctccttaatgcttcaggatttcagcaggcgtagaatcacaactcacagcctctctgtcttgtcacttttcatccaccgtgatctgagrcaagattccctctggggattgctattttcttttagggaaaaggaagagatttttgtgaacagagaaatgtctgttattttgctaataaccaccaatcatgctggctgtgtgggtgttcagaattagtatgattgcatagctgcatgaagaaattgccttccctctttttaagggtgtgaataactttgtgcagtacaaatttagtcacctgccagcaaaagaaaggcaaacaatagttgagttggcaaaaatgttcctaaaccgcatcaactattggcatctggaggcaccatctcaacg

SEQ ID NO: 109694 - DNA, 601 bp, Human
attagcatttttgtaatgtaaaaacaatatttatctaagaactgcattatatgtgggctactctgctgatagtaaagcaataattattctgcacaacagtcatattttcttgtttcaggggttttgaccttttcagtccatggttttgattttctccttaatgcttcaggatttcagcaggcgtagaatcacaactcacagcctctctgtcttgtcacttttcatccaccgtgatctgaggcaagattccctctggggattgctattttcttttagggaaaaggaagagatttttgtgaayagagaaatgtctgttattttgctaataaccaccaatcatgctggctgtgtgggtgttcagaattagtatgattgcatagctgcatgaagaaattgccttccctctttttaagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtaatc

SEQ ID NO: 109695 - DNA, 601 bp, Human
ctgcacaacagtcatattttcttgtttcaggggttttgaccttttcagtccatggttttgattttctccttaatgcttcaggatttcagcaggcgtagaatcacaactcacagcctctctgtcttgtcacttttcatccaccgtgatctgaggcaagattccctctggggattgctattttcttttagggaaaaggaagagatttttgtgaacagagaaatgtctgttattttgctaataaccaccaatcatgctggctgtgtgggtgttcagaattagtatgattgcatagctgcatgamgaaattgccttccctctttttaagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtaatcagatgcaagttcttttcctttggccccataaagcctgttacagacctaaaattgtacttgactctataagtatagggctgcctagtta

SEQ ID NO: 109696 - DNA, 601 bp, Human
gctttagtgcctacttttttcctgatttaaagtgggcagtagtatcttttgatagcctgtcaagaccacttgtgcccaggttattttctgtaacagcagataacatggaagaattgtataatttaaaataagctttcctctctgacattgacctagtttcatgtgtaacacacccttttcctctctttctcttcacttttgcaaatatatgcaatttcagttataaagtattttctccttaataattgatatttataggaattgcagatttcttcaaaataagtttttaaattatatcttyatttccgtatctttcattttaggattttacattaacaatagttctgtattattgaaactctgctatattattgaaactcttgtttataataagagttgagacgataagtctctcaaaaatatgtattttttaatcccgtctgtgaacaattgacaaagctgaatatttgtcaaagccagggccctgaatgcatttgcgacttttagcagagaaaataatcgtttcatcaagaaaaaggagaattaattgtgaagcagcttgggagacattagtatattttgttttatttttatttttatt

SEQ ID NO: 109697 - DNA, 601 bp, Human
gttgctgtaagagaacctcaggacctataacgctggttcagcttataacttacagcagttactgtaaatattagaacaaagatgtgccgaaaatgtttgcagtatatcagtctgaaaatgaagttaaacaggattctttgtggaaaagactggacttagaaaatgattgtgttcattacagagctaacttgtaaatatttattccataaaaattaaaagcagactgaacagtagtactgcttaaattacttctctgttctgaagaaaagaaaaatataagtattctttttttgttgttttkttgttttttttttttttgagatggagtctcactctgttgtccaggctggagtgcagtggcgcgactcagctcactgcaacctccacctcctgagttcaggcgattttcctgccttagcctcccaagtagctaggattacaagtgcgtgccaccatgcctggctaatttttgtatttttagtaaagatggggtttcaccatgttggccaggctagtctcgaactcctgacctcaggtgatctgcctacctcgtcctcctaaagtgctgggattaaaggcgtgagccaccttgctcaaccta

SEQ ID NO: 109698 - DNA, 601 bp, Human
tcaggacctataacgctggttcagcttataacttacagcagttactgtaaatattagaacaaagatgtgccgaaaatgtttgcagtatatcagtctgaaaatgaagttaaacaggattctttgtggaaaagactggacttagaaaatgattgtgttcattacagagctaacttgtaaatatttattccataaaaattaaaagcagactgaacagtagtactgcttaaattacttctctgttctgaagaaaagaaaaatataagtattctttttttgttgtttttttgttttttttttttttgagatggagtctcactctgttgtccaggctggagtgcagtggcgcgactcagctcactgcaacctccacctcctgagttcaggcgattttcctgccttagcctcccaagtagctaggattacaagtgcgtgccaccatgcctggctaatttttgtatttttagtaaagatggggtttcaccatgttggccaggctagtctcgaactcctgacctcaggtgatctgcctacctcgtcctcctaaagtgctgggattaaaggcgtgagccaccttgctcaacctaaatattgttacataagt

SEQ ID NO: 109699 - DNA, 601 bp, Human
atgatagtacactatttaattccatgaagaaataacctaaaaagaaagtgtcacaggattatgacttcttaaaatacaactgtccaacagtctgctgaaggaaagtgcaagtaattagtcttagattttgaattgtgtagaacttttgaaagttaaagcttacccccacactggggagatgtttcataagaatacagagtggctgtgtgcagtagctgatgcctgtaatcccagcaactttgggaggctgaggcgagaggatcgcttgagcccaggagtttgagcccagcctgggcaacasaatgagacttcatctctacaaaaataaaaataaaaaactagctgggtgtggtggcatgtgcctgtggtggcatgagcctgtggtcccagcgactctggaggttgaggtgggaggattgcttgagcccgggaggtcaaggctgcttggagctgtccatgatcctaccactgcactccggcctgggtgacagagcacgaccctgtctgaaaaaaaaaaaaaaaaaagaagaagaagaagaaaaagaatacatagcaagttagctagaactaacttgtttttgggaaacagttttatttagcc

SEQ ID NO: 109700 - DNA, 601 bp, Human
tgacttcttaaaatacaactgtccaacagtctgctgaaggaaagtgcaagtaattagtcttagattttgaattgtgtagaacttttgaaagttaaagcttacccccacactggggagatgtttcataagaatacagagtggctgtgtgcagtagctgatgcctgtaatcccagcaactttgggaggctgaggcgagaggatcgcttgagcccaggagtttgagcccagcctgggcaacacaatgagacttcatctctacaaaaataaaaataaaaaactagctgggtgtggtggcatgtgyctgtggtggcatgagcctgtggtcccagcgactctggaggttgaggtgggaggattgcttgagcccgggaggtcaaggctgcttggagctgtccatgatcctaccactgcactccggcctgggtgacagagcacgaccctgtctgaaaaaaaaaaaaaaaaaagaagaagaagaagaaaaagaatacatagcaagttagctagaactaacttgtttttgggaaacagttttatttagccattcttctatgatgtacagcctattgccatgtatactgagcattcattattagacatgtaa

SEQ ID NO: 109701 - DNA, 601 bp, Human
acagtctgctgaaggaaagtgcaagtaattagtcttagattttgaattgtgtagaacttttgaaagttaaagcttacccccacactggggagatgtttcataagaatacagagtggctgtgtgcagtagctgatgcctgtaatcccagcaactttgggaggctgaggcgagaggatcgcttgagcccaggagtttgagcccagcctgggcaacacaatgagacttcatctctacaaaaataaaaataaaaaactagctgggtgtggtggcatgtgcctgtggtggcatgagcctgtggtcycagcgactctggaggttgaggtgggaggattgcttgagcccgggaggtcaaggctgcttggagctgtccatgatcctaccactgcactccggcctgggtgacagagcacgaccctgtctgaaaaaaaaaaaaaaaaaagaagaagaagaagaaaaagaatacatagcaagttagctagaactaacttgtttttgggaaacagttttatttagccattcttctatgatgtacagcctattgccatgtatactgagcattcattattagacatgtaagtctagaacagatttatcaggaagc

SEQ ID NO: 109702 - DNA, 601 bp, Human
cggcctgggtgacagagcacgaccctgtctgaaaaaaaaaaaaaaaaaagaagaagaagaagaaaaagaatacatagcaagttagctagaactaacttgtttttgggaaacagttttatttagccattcttctatgatgtacagcctattgccatgtatactgagcattcattattagacatgtaagtctagaacagatttatcaggaagcatggaaagaacactaggaaacaggagatctgacttctagtctggactttaattaagtaactgggcctcagtccctgtgaactagggcagrtcagtttattcctgaaaaccacaggattttcagttcagcaagtcagtagaatgacatggtcttctgtgttcacatttttaatttctgttcacagaagttacaaatcatcatcatgatgtgaaaaatctgggagttatttgaacagtaagaaaatagcatgcaaataccatctttattagacatacaaaaatgaacgaactatcattttgcttctttttagtagacccgaaatcagtcatgtaggtaaaatcttttctacagttacttctttggaggaatacatgtgctcatgcacgtccg

SEQ ID NO: 109703 - DNA, 601 bp, Human
taccatctttattagacatacaaaaatgaacgaactatcattttgcttctttttagtagacccgaaatcagtcatgtaggtaaaatcttttctacagttacttctttggaggaatacatgtgctcatgcacgtccgtttccttctttctgtctcactgtgtgcaataataatatcaatcaatttattaaaacaacaccagaagtacacacacacacacacacacacacacattctgtctctctcacacacacacacattgactcagcctcattgtcttaatctacagtgaatttaacagaktacaaaataagattaatcttggaagttaagaaaaagctgaaaagtataaattgaggtctataaaatgactttgaggaaatgaatgaaagcccattatttgaacatttttactagctaataacaatctatgctgtcttctaccctgggaagattgaataacctgttaaagcacttttggataactttttaggattttatgataatatttataacctatcatctttgtatcagaaataatgtcagtcttagagccttagacgtttgcagatctctcctcagatggaaatgctgtttagactc

SEQ ID NO: 109704 - DNA, 601 bp, Human
attggatagcagagacatagaatcatccccatcatcagtgaaagctttattggacaataaatctttaaacctttcattgcagaagattggacatattttgttatttttaaaatttaggatctgcataacaacattttagtcagcaatggaccacatataatgacagtagtcctttaagattatgccaaaattttgctgtacctttccatgtttaggtatatttagatatacaaatacttaccattatgttacagtcgtttgtagtattcagtacagtaatatgctgtagaggtttgcagcytaagagcaatagactagaccatagagcaggggtcccccacccctgggccatggtccaccataggtccgtggctcattaggaaccgggctgcacagcaggaagtgagtggtgggcgagtgagcattacagcctgagctccacctcctgtcagatcagtggtggcattagattctcataggagcctgaactctattgtgaactgtgcatgtgagggatctaagctgtacattctttctgagagtctaatgcttgatgatctgaggtggaacagtttcatctggaaaccatcccttctacccc

SEQ ID NO: 109705 - DNA, 601 bp, Human
agactgcaaaagcagggatgaagaggaatagagagctccttcagcgtgatgaacctctatactaaatttcttgtagaataggcatactttggtgctccttgcttcttgcacctgtcagagctccaaggcataaatgatcatttaaatattttaaatggaaggaaatgctgcaaagcaatagaaagttgcagtgctgcaccattggccttggaaatgcatttttaatgctaaaaaccaaaaatttaagctaagcggttggatgctggtgggataggccaagggtgcagttgatgacttctcmtggagcagtaacagcgagaaatgaatgagacagttcattctgtgattatcattccgcctagatcagcgcttggtcaggaaggtaaaaggcgtaatttgaaaaggctggctaggtatgatatagccttccttccccatgccattctgaactgctgatgtagagaatagaatttgagaggaaatattctttgatcaaagattgatgaaacactgttttgtttgagaaactagatttttattattcagatagtgttattagattatggaatttttgtctcagtgaagatagagttttaattca

SEQ ID NO: 109706 - DNA, 601 bp, Human
gctaagcggttggatgctggtgggataggccaagggtgcagttgatgacttctcatggagcagtaacagcgagaaatgaatgagacagttcattctgtgattatcattccgcctagatcagcgcttggtcaggaaggtaaaaggcgtaatttgaaaaggctggctaggtatgatatagccttccttccccatgccattctgaactgctgatgtagagaatagaatttgagaggaaatattctttgatcaaagattgatgaaacactgttttgtttgagaaactagatttttattattcagwtagtgttattagattatggaatttttgtctcagtgaagatagagttttaattcataacaataagttaggttcaaaacaacaaaaataaaatggttttctgacagaaattgactgaagattccttggcagtttaacccaaatcctaaaccttagatagatgtcatgggtaattctgatgggctttggccaaacacccaatatttgcacatatatttcaacaacctgattgtcaaatttttctttagagaaccagtacatgagactaagtcatgacatgaacattttgttgtcctctgtgga

SEQ ID NO: 109707 - DNA, 601 bp, Human
ttttccacttggctttaatgtgtgcctctttccccattcacctatttacaaagtgtttttgtttttgtttttaagttgtgtatctatatttcattctaaaagtgaagaaaatttggttcagggaaaaaatgaagaagaagaccactgatagcttcaccactctgaactatttttagtgcttttagttatttctgtttttcccccatttattggtgaaaaaaattcagtaagcctcagagggacttaggtatctgtatttcttttctctttttttctcttttaattttttattctttttaartcacctgccctattctgataagcatctgtatttctaataaggtttccagatgatttctatgggttgccaaaacttgagatccatttagtttaaagttagcatagtaattaatcactggttccaatcctgatcctgccatttactagttgtgggaatttgatctaaatatttcacttctctgtgccctagtttcttcatctgtgaaatgggtatgaattttatctcatagggtcgttataaagatcaagtgagttaatatacatcaaccacttacaacactgcctatcatgtagtaagagc

SEQ ID NO: 109708 - DNA, 601 bp, Human
gcctatcatgtagtaagagctatatatgtgcgtgacaaataaaaatagaatatataactcatagggttgatgtgaggattcagtaagaagttcttagagcagtgcaggcacaaagcaagcactcgataaatattagtaacttttatgatggtaatgacagtgacagtgcagctatatggagggctgaaatcgtgctctgagattcactgaggaagattaatgcatttctactgatgtaattcatatgtctgtatcctgtgctgtgttaagctatgcagggtcaaaagagtaaacatttgtrtaaatgcatttctgtatttgaatataccagggctgcccaactaaatcataatttgagttgtaattctccattatatttctgattgaaggtttgagacgctgatgttaaggtgattgccacagataattagggctgttatccttacagtagtttttttttaatcttattgctattactcttgtgtctagatttctgtccatgctagaagaagaagtatatagtcaaaactctcccatctgggatcaggattttctctcagcctcttccagaaccagccagctaggcatccaaacaggtaag

SEQ ID NO: 109709 - DNA, 601 bp, Human
agcactcgataaatattagtaacttttatgatggtaatgacagtgacagtgcagctatatggagggctgaaatcgtgctctgagattcactgaggaagattaatgcatttctactgatgtaattcatatgtctgtatcctgtgctgtgttaagctatgcagggtcaaaagagtaaacatttgtataaatgcatttctgtatttgaatataccagggctgcccaactaaatcataatttgagttgtaattctccattatatttctgattgaaggtttgagacgctgatgttaaggtgattgycacagataattagggctgttatccttacagtagtttttttttaatcttattgctattactcttgtgtctagatttctgtccatgctagaagaagaagtatatagtcaaaactctcccatctgggatcaggattttctctcagcctcttccagaaccagccagctaggcatccaaacaggtaagtttccttttacatgaatcagagaacaaccagggaggccaacctgaagtgtaagttgcagttcactgcaacttatacttagctctatagtcaaatgagcttagctctatagtcaaatg

SEQ ID NO: 109710 - DNA, 601 bp, Human
gtcaaatgagcttagctctatagtcaaatgctggctattttcaaacccaattatagtctcagtcgatggctagatacacctaggaatcaagtctcagtctgacctcttaatctatgatgtctgttttatacatcaagttaccaccaggtataatggtggatagtgagtgaaagcggcagtcttgagtctcaggatgtgaactacttccctgtggggcagggcatccttgctattgcttaaatcagccagtggcatcagttggcattttgtgaggaaggaagacagatgccttctggagtcrcagtgatcccagaaagaggatctgaattcctgcctttgacactaggaagactccatggagaggtttggcaagaaatgccaaagcagtttatatctggccatggggaaagacaggatgcaaaattttgacgtcaagagttttttgtagtgctctaggtcaatgtgtattatgggggcttgtgagtattgcctctaatgcctccagcaaagaaaaaatgatttattcttgctttaaaaacaaaattgaagtataatttatatatagtaaaatgtactctttttactgtactgtgttttgaca

SEQ ID NO: 109711 - DNA, 601 bp, Human
tgaaagcggcagtcttgagtctcaggatgtgaactacttccctgtggggcagggcatccttgctattgcttaaatcagccagtggcatcagttggcattttgtgaggaaggaagacagatgccttctggagtcgcagtgatcccagaaagaggatctgaattcctgcctttgacactaggaagactccatggagaggtttggcaagaaatgccaaagcagtttatatctggccatggggaaagacaggatgcaaaattttgacgtcaagagttttttgtagtgctctaggtcaatgtgtawtatgggggcttgtgagtattgcctctaatgcctccagcaaagaaaaaatgatttattcttgctttaaaaacaaaattgaagtataatttatatatagtaaaatgtactctttttactgtactgtgttttgacaaacacatatacttgagtaatgaccactgccatcaaaatatagaacagtggcctccttccagacagattgccttgtacttctctatagtgcattcatagtcctacctccagctctgggaaccagtgatctgtgtttttgttcttacagttttgccttttccagaatgt

SEQ ID NO: 109712 - DNA, 601 bp, Human
gagactgataactttaattcagcataatgcatttgagaggtgatttttgaaaaaggttttcatctgaacctcaagtttaggtgtaaatataactaaatccctacaaaccaaagtactagtgaatgaggaattttatttgaatcatactctttttgtttgagctcattaccaaaaacatgtcaaaaacatctttgtgtcctttttttttttctaacctgagatcgtaatttcatgtatctctggtccaaaacctgtagtgctttggggcctgtctgtgcctattacatgtttcttctacagktgagcagttagcatttagtggacatgttttctgtggttactggacatatcctttgcattgctccctctgtacctgtgctattcactttaccttggatttgatctcacctaactttcaaatggcatttcttctgcaaactcttccctaagttctcccatcccctctagcaaggactggatctcttttcttccagactttcatagagccttgaatatatcctatccatggttctcaaacatggcagcacaatggaatcacccatggaatttgaaatgcactgtatactgttttctgagtgcc

SEQ ID NO: 109713 - DNA, 601 bp, Human
acaaaccaaagtactagtgaatgaggaattttatttgaatcatactctttttgtttgagctcattaccaaaaacatgtcaaaaacatctttgtgtcctttttttttttctaacctgagatcgtaatttcatgtatctctggtccaaaacctgtagtgctttggggcctgtctgtgcctattacatgtttcttctacagttgagcagttagcatttagtggacatgttttctgtggttactggacatatcctttgcattgctccctctgtacctgtgctattcactttaccttggatttgayctcacctaactttcaaatggcatttcttctgcaaactcttccctaagttctcccatcccctctagcaaggactggatctcttttcttccagactttcatagagccttgaatatatcctatccatggttctcaaacatggcagcacaatggaatcacccatggaatttgaaatgcactgtatactgttttctgagtgccattccaagagagtgtgagattattgtcctggggtgtggcctggacattgggacttttaaaaagctccccaggtaattttaatatgcagcaacatttgagaat

SEQ ID NO: 109714 - DNA, 601 bp, Human
tgaggaaatagaagctcagggaggagcaacaaattgcccaagatagaccttgtaagtgatggaattgggtttcacatccgtatctaattcctaaatattacactgtattaagagagccagaactctaaccactacatcacaccatcttggtgtgtgctgccaatatacagcatacacttgtggaaggaatgagtgaagaacagtttcctccctcaggcagtgggggaccaaagttattcagcaggatcaacatagttctcctgtggtgggtctgtggagaggatttctgtgtgtgaaaactccccttgacccttgtttgctcaaaattctccagtctgctcaacttccagccacattgttatctgtcatagtacaggatggagaaggaagaggttgttgcctgtgaccctatgggaattttattcgtttttctgtggctaaggttgtcaccaagttaagttggcgtgtacactttagtattacctgaagccatcagaagtgggctgtcttctcttgttctactgtaattgcaatgtgttctcttgggggaacagaagagtgtaatcatctacttaattagcatgtctgcgtatcgatgcaa

SEQ ID NO: 109715 - DNA, 601 bp, Human
taaatgacattcataaggatgaacctgaaattttacaagatactcagatgtcttctgaatcaccagagctttctctttgttcagaatcactccagtatgctttgaaattcagaaggcctatatattgggagaaaaaaacatagagcctggcactttagtatattctgatttttgacaaaccactggctattcagttagaagtgctatgggttggtatctctcttgcttggtttacttattttattgccttcttggctgctgggaatgtccttgttgactgaactgtggctgtgttgaaacrtagatgaacgttctctctgacaattgtctgtactgccatgctgtgtcctgtatgtgaccagtgttattgagaatgtctgtaccccttgtcacctctcacctcatcagctaccagtcagcaacacagctagcaaagcagcatcctactttgtacaatggccttttctaaaatacaaaatagtccctttttgtttggaaatactgtcaaactcacagagttacaagaagaggacaaagaaatcctgtatattttcagtagagttacaagaaggtgacagagaaatcctgtgtattttatatg

SEQ ID NO: 109716 - DNA, 601 bp, Human
tgtgtgtgtgtgtatgtgtgtgtatatgtatatataaaacttaggggaagagtagagagagagaaaaaaagagaaagagagctatataggccaggcgtggtggctgacacctgtaatcccagcactatgggaggcttaggtgggcggatcacctgaggtcaggagtttgagtttgagaccagcctgctcaacatggcaaaacctcatctctactaaaaatacaaaaagtagctgggagttgtggcaggcacctgtaatctcagctactcgggaggctgaggcaggagaatagcttgaaccrgggaggcagaggaggttgcagtgagccaagattgcaccactgcactccagcctgggcgacaaaagcgaaactttgtctcaaaaaaaaaaaaaaaaaaaagagagagagcgaactatatatataatatatatatttatacgttatatataaatacaaatatatattatatatattttttctcctaaattagttgaaagttacaaacatcatgcccctttagtaattttgatgtctctcatgtattctctaacataaaaactatagttttctgtcagcaaatgtaacattgatatagtatag

SEQ ID NO: 109717 - DNA, 601 bp, Human
tggctgacacctgtaatcccagcactatgggaggcttaggtgggcggatcacctgaggtcaggagtttgagtttgagaccagcctgctcaacatggcaaaacctcatctctactaaaaatacaaaaagtagctgggagttgtggcaggcacctgtaatctcagctactcgggaggctgaggcaggagaatagcttgaaccggggaggcagaggaggttgcagtgagccaagattgcaccactgcactccagcctgggcgacaaaagcgaaactttgtctcaaaaaaaaaaaaaaaaaaaaragagagagcgaactatatatataatatatatatttatacgttatatataaatacaaatatatattatatatattttttctcctaaattagttgaaagttacaaacatcatgcccctttagtaattttgatgtctctcatgtattctctaacataaaaactatagttttctgtcagcaaatgtaacattgatatagtatagttacctaagctatatgctgtcttctgtttttgcctcttgtctcaataatgtggtttattgcaatttttccattgcatcaggaggcatatgatgttggctt

SEQ ID NO: 109718 - DNA, 601 bp, Human
tgatatagtatagttacctaagctatatgctgtcttctgtttttgcctcttgtctcaataatgtggtttattgcaatttttccattgcatcaggaggcatatgatgttggcttgtcccatcattgttggtattaagtttgatcacatggttctggtggtggtcaccagctttctccactgcagtattaccacctttcctttttaatcaaaaaaatacttttgtggggagatattttgagactgtataaatatcttgtcttcatcaaaattatactcacaggttttagcctacacacatgawcttccccaaatcagttatcatatggtggctgccaaatagtgattttttttttttttttttactaactaccataactccgtccttatttctttgttggtgttcttgagcttttctcatctccactaatttatttatgtattcatttattattttatcaatatagactcagatatccttattctatttaatgagttatagtccctgctgtctttactattttgatgccttgtggcttatgttttaaagatgacttattttgtggcattgggcaggagtggggtggtcccatgtgcacttcgt

SEQ ID NO: 109719 - DNA, 601 bp, Human
atgtggtttattgcaatttttccattgcatcaggaggcatatgatgttggcttgtcccatcattgttggtattaagtttgatcacatggttctggtggtggtcaccagctttctccactgcagtattaccacctttcctttttaatcaaaaaaatacttttgtggggagatattttgagactgtataaatatcttgtcttcatcaaaattatactcacaggttttagcctacacacatgaacttccccaaatcagttatcatatggtggctgccaaatagtgattttttttttttttttttactaactaccataactccgtccttatttctttgttggtgttcttgagcttttctcatctccactaatttatttatgtattcatttattattttatcaatatagactcagatatccttattctatttaatgagttatagtccctgctgtctttactattttgatgccttgtggcttatgttttaaagatgacttattttgtggcattgggcaggagtggggtggtcccatgtgcacttcgtttcttgttacctaagaaaggagtcagtcatctaacaccttcttctccttttgccggggca

SEQ ID NO: 109720 - DNA, 601 bp, Human
tgccatattggtcaggctggtctcaaactcctgacctcaggtaatctacctgtctcggcctcccaaagtgctgggattataggtgtgagccaccataccctgctgacttctgcctcattctgtcgtccaaagcaagtcacgtagttgaactcagagttgagaggtggagaagtggaaaaaggtagtctattcctttcgtaggaataactgcaaagtcacatagcaaagagtgtagataccaggagggtaaagaatttggccattaatgtaatctaccacatgggcaaaaatatctcttgakcctagaagcatttcacagttagagaatgttttgaaggttgcatttctgtccacagacttgacgtcagacaaatcttggatgtgaccaaatttttaaataaaagaagtaccatgaaagagggaaagaagaggaccttataatataagaagtgccatatatttagcatatgccaccattccctttcacttccaagggagatatcactaattcatgcagaaactctttaccagtgagcttggattcagcctcagactttttaaaaaaaatcataaacaccattagcagtctaacaagcagagg

SEQ ID NO: 109721 - DNA, 601 bp, Human
ggagaagtggaaaaaggtagtctattcctttcgtaggaataactgcaaagtcacatagcaaagagtgtagataccaggagggtaaagaatttggccattaatgtaatctaccacatgggcaaaaatatctcttgagcctagaagcatttcacagttagagaatgttttgaaggttgcatttctgtccacagacttgacgtcagacaaatcttggatgtgaccaaatttttaaataaaagaagtaccatgaaagagggaaagaagaggaccttataatataagaagtgccatatatttagcwtatgccaccattccctttcacttccaagggagatatcactaattcatgcagaaactctttaccagtgagcttggattcagcctcagactttttaaaaaaaatcataaacaccattagcagtctaacaagcagagggcatatcaagtacaaaccccagctacgaaataaatagttttcagcattactcttagggaatcatggaatttgaggacttattggtcagatgtctgaaaatattgttacttgtctccaaaaacaaacaacaaaaaattgtaaaaaaaagaactcgacaaaagtgat

SEQ ID NO: 109722 - DNA, 601 bp, Human
atgttttgaaggttgcatttctgtccacagacttgacgtcagacaaatcttggatgtgaccaaatttttaaataaaagaagtaccatgaaagagggaaagaagaggaccttataatataagaagtgccatatatttagcatatgccaccattccctttcacttccaagggagatatcactaattcatgcagaaactctttaccagtgagcttggattcagcctcagactttttaaaaaaaatcataaacaccattagcagtctaacaagcagagggcatatcaagtacaaaccccagctaygaaataaatagttttcagcattactcttagggaatcatggaatttgaggacttattggtcagatgtctgaaaatattgttacttgtctccaaaaacaaacaacaaaaaattgtaaaaaaaagaactcgacaaaagtgatttagtaaataatatgtaatacttctggaagaatcgtctacagtcaagttactttatactgttctgctccttttcaactagagatagtgagaatgctatgtggagaatgttatattgagatagcagtgggattcacatgtgaggaaataaattagatctaga

SEQ ID NO: 109723 - DNA, 601 bp, Human
gtgtgtgtgtgtgtgtgtgtatagccaagcccagcacagagattccaatcagtgggtagactcatgaacaagcctgccaagattgaatgagatgagctgaaatcagccacccatcaggaaacatacgaaatgaatgagctatgatagtaagttattatggtttaagactcatttggggttggtttattacatagcaataactaaccaataaagcccaaagcctaatgcaaactgatttccgtacatatatggtggggtgccggtgggggcggggtggaattaacatgactacaaggagaartaatcaaatcaaccaacggttgaggctttaaacaaacaactgagtaattcataggtcaaacagacaaaaatatcagtaaggctcttactgatatccatacaacatgatctgtaagctgaagctaatggagttatagagatcaaaatatgaaaatacacattctttccaagaagacactgcacatttacaaaagattggtcttattttaggtcataaggtaaaaatttcaatccattttgacgttttggtgtcatatggaccatgttctctgaccttgaagagactatattagagagtact

SEQ ID NO: 109724 - DNA, 601 bp, Human
gcagccagctggtagacctcttctgctctcctggccactccagctgtcagaagtggggatgctaatgctgagagttaacatgttatgctaccctggtttgcatttaacctggtggtcagtgtggagagggcaggaacaactgatcaagaggtaattccccttgatgaatatcacatcacaggtccacttactaataatctcacagttgaaggcatcattcccagctttttatcttgaaaaatttcaagccctcataaatgttgcagaaattctgtaataaaaatccatagactctttactkagattcagcagttaacattatgccacatttgctacctctctttctctctgcgcctccccatatgctctttttctttctctccccactccccatgaaccatttggaaccatttcagaattaaaaacacatgtcataatacttcacccctaactatttttgcatgtactgtatctcataaggaagctattctcttacataaccacaatgcagtcattactcttagaaaatttagcctggttacaatattttctaatacagggttggtgaattacagcctgcaagccaaatctggtccactgg

SEQ ID NO: 109725 - DNA, 601 bp, Human
tctcctggccactccagctgtcagaagtggggatgctaatgctgagagttaacatgttatgctaccctggtttgcatttaacctggtggtcagtgtggagagggcaggaacaactgatcaagaggtaattccccttgatgaatatcacatcacaggtccacttactaataatctcacagttgaaggcatcattcccagctttttatcttgaaaaatttcaagccctcataaatgttgcagaaattctgtaataaaaatccatagactctttacttagattcagcagttaacattatgccayatttgctacctctctttctctctgcgcctccccatatgctctttttctttctctccccactccccatgaaccatttggaaccatttcagaattaaaaacacatgtcataatacttcacccctaactatttttgcatgtactgtatctcataaggaagctattctcttacataaccacaatgcagtcattactcttagaaaatttagcctggttacaatattttctaatacagggttggtgaattacagcctgcaagccaaatctggtccactggctgtttttttcaaataaagttttatt

SEQ ID NO: 109726 - DNA, 601 bp, Human
cactccagctgtcagaagtggggatgctaatgctgagagttaacatgttatgctaccctggtttgcatttaacctggtggtcagtgtggagagggcaggaacaactgatcaagaggtaattccccttgatgaatatcacatcacaggtccacttactaataatctcacagttgaaggcatcattcccagctttttatcttgaaaaatttcaagccctcataaatgttgcagaaattctgtaataaaaatccatagactctttacttagattcagcagttaacattatgccacatttgctayctctctttctctctgcgcctccccatatgctctttttctttctctccccactccccatgaaccatttggaaccatttcagaattaaaaacacatgtcataatacttcacccctaactatttttgcatgtactgtatctcataaggaagctattctcttacataaccacaatgcagtcattactcttagaaaatttagcctggttacaatattttctaatacagggttggtgaattacagcctgcaagccaaatctggtccactggctgtttttttcaaataaagttttattgaaacatat

SEQ ID NO: 109727 - DNA, 601 bp, Human
agtggggatgctaatgctgagagttaacatgttatgctaccctggtttgcatttaacctggtggtcagtgtggagagggcaggaacaactgatcaagaggtaattccccttgatgaatatcacatcacaggtccacttactaataatctcacagttgaaggcatcattcccagctttttatcttgaaaaatttcaagccctcataaatgttgcagaaattctgtaataaaaatccatagactctttacttagattcagcagttaacattatgccacatttgctacctctctttctctctgygcctccccatatgctctttttctttctctccccactccccatgaaccatttggaaccatttcagaattaaaaacacatgtcataatacttcacccctaactatttttgcatgtactgtatctcataaggaagctattctcttacataaccacaatgcagtcattactcttagaaaatttagcctggttacaatattttctaatacagggttggtgaattacagcctgcaagccaaatctggtccactggctgtttttttcaaataaagttttattgaaacatattgtctgcagctgtctt

SEQ ID NO: 109728 - DNA, 601 bp, Human
tctttctctctgcgcctccccatatgctctttttctttctctccccactccccatgaaccatttggaaccatttcagaattaaaaacacatgtcataatacttcacccctaactatttttgcatgtactgtatctcataaggaagctattctcttacataaccacaatgcagtcattactcttagaaaatttagcctggttacaatattttctaatacagggttggtgaattacagcctgcaagccaaatctggtccactggctgtttttttcaaataaagttttattgaaacatattgtytgcagctgtctttgcattacaacagtaaatttgaataattgagacagggaatgtgtggcttgcaaagtatgaaatatttattatctggcttttcactgaaaagtttgctgacctctggcctaatataaaaccgtatttaaatttcccatatagccagatgatgtcagttataacctttgttgttgttgaaggatcagttagggattgtgcattgcatttaattcttatctcttcatttgtttagtctcctttaaaacaactccccagccttgttttggtcttttgcagcactgccattgg

SEQ ID NO: 109729 - DNA, 601 bp, Human
gttgattgtttactaaggattagattcaagtaaggcatttttggtaaaaatgctgctgtcatctcattgccttgcatctgagggcatgcaaggcaatgacatttcttaagacatacctgtcttaagacatttctgacagcttccaggaaatgaagaaatggcttggagattatattacagtgttaattttcaatttgtcatgtttctttaaatatttattttatgacattgaggatacttcagagaaccagaatgttgtaatagaaaaatctcttcctaaaattgatctttccatttcctyctagatgtccagtctgtgagggcttaagactatagttttttagggatttagtaacattacagattagctgagtttaggtttttttcagctataaaatggggatttgtactagtctattgcattgctacaaagaaatacctgagactgggtaatttatttttttaaaaaagagctttaattggctcacagttccacagactgtacaagaatggcatcagcatctgctcagcttctggggaggcctcagggaacttatactcatggtgcagggtgaagtgggagcaggcacatcacatggtg

SEQ ID NO: 109730 - DNA, 601 bp, Human
tgattgtttactaaggattagattcaagtaaggcatttttggtaaaaatgctgctgtcatctcattgccttgcatctgagggcatgcaaggcaatgacatttcttaagacatacctgtcttaagacatttctgacagcttccaggaaatgaagaaatggcttggagattatattacagtgttaattttcaatttgtcatgtttctttaaatatttattttatgacattgaggatacttcagagaaccagaatgttgtaatagaaaaatctcttcctaaaattgatctttccatttccttcyagatgtccagtctgtgagggcttaagactatagttttttagggatttagtaacattacagattagctgagtttaggtttttttcagctataaaatggggatttgtactagtctattgcattgctacaaagaaatacctgagactgggtaatttatttttttaaaaaagagctttaattggctcacagttccacagactgtacaagaatggcatcagcatctgctcagcttctggggaggcctcagggaacttatactcatggtgcagggtgaagtgggagcaggcacatcacatggtgag

SEQ ID NO: 109731 - DNA, 601 bp, Human
aagaatatatacatgaggccgggcgcggtggctcagcctgtaatcccagcactttgggaggccgaggcgggcagatcacgaggtcaggagatcgagaccatcttggctaacacggtgaaaccccgtctctactaaaaaatacaaaaaattagctgggcgccgtggcgggctccagaggctgaggcaggagaatggcatgaacccgggaggcggagcttgcagtgagctgagatagcgccactgcagtctggcctgggcgaaagagcgagactccgtctcagaaaaaaaaaaaaaaaaaaaagaatatatacatgagtgctactattgggcctgtaatgagaatttgaatctgtcatctcaagggtccttaaagctcagctggagaggattccttgaagccagaggttggcaaactataacccacaggccacattttgtctgcttactgtatttttaaataaagttttattggaacagtactgcacccattctttaacatattgtctgtggatgcttttgcattatagcagaagaaggagtagttgtgacaaacaccttatggctcacaacgtctaaaatattttctatctggcccttcaca

SEQ ID NO: 109732 - DNA, 601 bp, Human
aatcccagcactttgggaggccgaggcgggcagatcacgaggtcaggagatcgagaccatcttggctaacacggtgaaaccccgtctctactaaaaaatacaaaaaattagctgggcgccgtggcgggctccagaggctgaggcaggagaatggcatgaacccgggaggcggagcttgcagtgagctgagatagcgccactgcagtctggcctgggcgaaagagcgagactccgtctcagaaaaaaaaaaaaaaaaaaaagaatatatacatgagtgctactattgggcctgtaatgagartttgaatctgtcatctcaagggtccttaaagctcagctggagaggattccttgaagccagaggttggcaaactataacccacaggccacattttgtctgcttactgtatttttaaataaagttttattggaacagtactgcacccattctttaacatattgtctgtggatgcttttgcattatagcagaagaaggagtagttgtgacaaacaccttatggctcacaacgtctaaaatattttctatctggcccttcacagaaaactttgctggcccctaatctacactgaatatcatccg

SEQ ID NO: 109733 - DNA, 601 bp, Human
ccccgtctctactaaaaaatacaaaaaattagctgggcgccgtggcgggctccagaggctgaggcaggagaatggcatgaacccgggaggcggagcttgcagtgagctgagatagcgccactgcagtctggcctgggcgaaagagcgagactccgtctcagaaaaaaaaaaaaaaaaaaaagaatatatacatgagtgctactattgggcctgtaatgagaatttgaatctgtcatctcaagggtccttaaagctcagctggagaggattccttgaagccagaggttggcaaactataacscacaggccacattttgtctgcttactgtatttttaaataaagttttattggaacagtactgcacccattctttaacatattgtctgtggatgcttttgcattatagcagaagaaggagtagttgtgacaaacaccttatggctcacaacgtctaaaatattttctatctggcccttcacagaaaactttgctggcccctaatctacactgaatatcatccgtgtacacatataatactccaatttctcaaaatgctttacctgccttttctgtcttgtcttcataacttgtatgtgtatg

SEQ ID NO: 109734 - DNA, 601 bp, Human
ccgtctctactaaaaaatacaaaaaattagctgggcgccgtggcgggctccagaggctgaggcaggagaatggcatgaacccgggaggcggagcttgcagtgagctgagatagcgccactgcagtctggcctgggcgaaagagcgagactccgtctcagaaaaaaaaaaaaaaaaaaaagaatatatacatgagtgctactattgggcctgtaatgagaatttgaatctgtcatctcaagggtccttaaagctcagctggagaggattccttgaagccagaggttggcaaactataacccrcaggccacattttgtctgcttactgtatttttaaataaagttttattggaacagtactgcacccattctttaacatattgtctgtggatgcttttgcattatagcagaagaaggagtagttgtgacaaacaccttatggctcacaacgtctaaaatattttctatctggcccttcacagaaaactttgctggcccctaatctacactgaatatcatccgtgtacacatataatactccaatttctcaaaatgctttacctgccttttctgtcttgtcttcataacttgtatgtgtatgtg

SEQ ID NO: 109735 - DNA, 601 bp, Human
ttggcctacagaacgttttctcccaccagctgccccgaatgccaaaagaatacatcacacggctcgtctttgacccgtaagtggtactttctgttccttcttccttatttcctttttaaatgaaagaggaactgcttagatagtgaaagtcagccatagtcatccaccgaatactactgcacctgtcttgctgtggatacagagcttcaccaagctgattttcatgtctgaaagtgctaagagtaattttcaacaatttacaaattttcttgttaatgatgatgaaactttatattttacrttgctgatgactctcctgtgcttcattctttatagcagtgagagaatgtaacactaagatgttctgctttcttcataatcaaaatattggttttggtatcttaactaggtgccattattgcccaggtctgtgggcaattattgggatataagacaggttaactttgaaaatccattgcttaaaaaaaaaaaacaaaaaactaggccgggcatggtggctcatgcctgtaatcccagcattttgggaggctgaggtgggaggatcacctgaggttgagagtttgtgaccagcctgaccaac

SEQ ID NO: 109736 - DNA, 601 bp, Human
gtggatacagagcttcaccaagctgattttcatgtctgaaagtgctaagagtaattttcaacaatttacaaattttcttgttaatgatgatgaaactttatattttacgttgctgatgactctcctgtgcttcattctttatagcagtgagagaatgtaacactaagatgttctgctttcttcataatcaaaatattggttttggtatcttaactaggtgccattattgcccaggtctgtgggcaattattgggatataagacaggttaactttgaaaatccattgcttaaaaaaaaaaaacaaaaaactaggccgggcatggtggctcatgcctgtaatcccagcattttgggaggctgaggtgggaggatcacctgaggttgagagtttgtgaccagcctgaccaacatggagaaaccccgtctctactaaaaatacaaaattagccaggcctggtgacacatgcctgtaatcacggctacttgggaggctgaggcaggagaattgcttgaacccaggaggcggaggttgtggtgagccgagaccgtgccattgcactccagcctgggcaacagagcgaaactccatttcaaaaaaaaa

SEQ ID NO: 109737 - DNA, 601 bp, Human
catcaaagggcaaatgcaattcagcagtcttacattcatcattctgactggggaaggtgaagacccacatttgcttgaaactgatctctggctcattttcaaggaattctgacagtgtgtctttagatggtgctgttgctgtgtttatcattattctccgctagccaaagtgacaaatgtccagatgtttccaaatgttcaaagtttaagaacttacttaaaggaaaattttatttggcttttcttagggtgaagacctggaaaatatgcccttggtttgtaattttagaaaaagatggcrtaatttttattttcaaagatagctataccaaacaccttgtttggaaatgctgattaaggttgagttggacacttttagggatactaaagggaaactgaaggtatttaatacgaattggatactttgtcttattacttcccagaaaggcaattcccccccataaccatgtaattttctaaagacttgaaggaaggtggccaagcatcacaaactcagaaggaagaacaagaaaagcaatcacttcttgtaagtgacttgaaactgtagttttagaaaatgaagataatgaagattagtctt

SEQ ID NO: 109738 - DNA, 601 bp, Human
ctctggctcattttcaaggaattctgacagtgtgtctttagatggtgctgttgctgtgtttatcattattctccgctagccaaagtgacaaatgtccagatgtttccaaatgttcaaagtttaagaacttacttaaaggaaaattttatttggcttttcttagggtgaagacctggaaaatatgcccttggtttgtaattttagaaaaagatggcataatttttattttcaaagatagctataccaaacaccttgtttggaaatgctgattaaggttgagttggacacttttagggatacyaaagggaaactgaaggtatttaatacgaattggatactttgtcttattacttcccagaaaggcaattcccccccataaccatgtaattttctaaagacttgaaggaaggtggccaagcatcacaaactcagaaggaagaacaagaaaagcaatcacttcttgtaagtgacttgaaactgtagttttagaaaatgaagataatgaagattagtctttcaaaacaaaatagaatggatgagtttagtgtgtgtgtgtgtgtgtgcgtgcatgtgtgtgttttttaatggtaagaacgtgtgt

SEQ ID NO: 109739 - DNA, 601 bp, Human
tgtgtgtgttttttaatggtaagaacgtgtgtgtgtgtgcatgcgtgcgtgtgtgtgtgtgttctaatggtaagaaccaatctttagtagaagtaagaatgtgagaaacagttcttcctttagtttcctggccttttttttttttttttttttgagacggagttttgctcttgttgcccaggctggagtgcaatggcgtgatctcggctcactgcaaactccgcctcctgggttctggtgattctcctgcctcagcctcccgagtagctgggattacaggtgtcagccaccatgcccggcyaatttttgtatttttaacagaaatggtgtttcatcacgttggccaggctggtctcaaactcctgacctcaggtgatcgcctgcttcggcctcccaaagtgctgggattacagttgtgagccactgtgcccagccaatttcctgatctttttactgtcctgtgtcattaatgattaatgaacaacttttgagacatcacactgcccaagatatttacattttcactggcgtatagtctaagataaagattgctgagctctgccaacccagcaacactagacaacatggaagcacttcttca

SEQ ID NO: 109740 - DNA, 601 bp, Human
aaaacacaagataacatatgagaatttatttgaagctcctctcctgattttggaatatcctgtaatctaaaaacaatttgggccaggcgtggtggctcacacctgtaatcccagcactttgggaggctgaggcgggcggatcacctgaggttgggagtttgagaccagcctgaccaacatggtgaaaccccatctctaccaaaaatacaaaattagctgggtgtggtggtgcatgcctgtaatcccagctactcagaggctgaggcaggagaatcacttgaacccaggaagtggaggttgyggtgagccaagattgtgctattgcacttcagcctgggcaacaagagtgaaactccatctcaaaagaaaaaaatattgaatttgatattatatacagctttaaaattatgtagctaatgtttatttaccataataggtatttaaataaacactgaagttaccagatagttagaaaatgatccttttgatggcaggtaaaaataaaggtgtacaaacaaggggaaataggtctggggttaaaatctaaataaacatttgcttataatagctttatgttgtcactgcctctctaaccaaggca

SEQ ID NO: 109741 - DNA, 601 bp, Human
atttttgtcagcttggtacgcatccttccaggtactttggtattgacacatatattggaacttactgaacttacaggtaagaggtgactgtgtgttttgttgttgcttttttcccatttaaataaatggaattcatattgtatgcattgcattactggaaaaaaactttacattgtcctagagacctttcagctttagtgcatatatgtgattgtttaaatttgtatttagataccttaaattaaaatgaatatttacatccttggttactcaggtactcagtagctacatgtgactaatcattaccatattggatagcatagataaagaacatttccataattgcaggaatttctattaatgctgatatatagctactttattctttttatacagtattttataatatggatgcaccataatttatgtaatcatttctctattgaagacatatttgcttatttctggtaattttctatcatcagcaatgttctgtttggaaatgtttccttagacactgagaagcagaattcctatatgaatgaatatggccggtctaaatttaaaaaattatttccagattgtcttctcagtgggtctc

SEQ ID NO: 109742 - DNA, 601 bp, Human
tgattagtggccgggcgcggtggctcacgcctgtaatcccagcactttgggaggccgagacgggcagatcacaaggtcaggagatcgagactatcctggctaacacagtgaaaccccgtctctactaaaaatacaaaaaattagccaggtgtggtggcgggcacctgtagtcccagttattcgggaggctgaggcaggagaatggtattaacctgggaggcagagcttgcagtgacccgagatcgtgccactgcactccagcctgggtgacagagcaagactccatctcaaaaaaaaaaaataaaaaccaaagtgattagtttgataaggtgtcattcagtcatgccatatgaggaatgactatagccttgatggtgcttggcttgggactgggaaagtacggatgggcatgtgtgagagagcataatcttcaaaggcttgaagggctgttaaaagcaggaatgagtctttgtaactctaggagtagaactaaggtcaataagtagaaataacaatgaccagatcttgggtgaacgttaggaaggaattcccaactatatgatgcctgaaaatgaattggtctatctcaccaccaaggaat

SEQ ID NO: 109743 - DNA, 601 bp, Human
gtggtggcgggcacctgtagtcccagttattcgggaggctgaggcaggagaatggtattaacctgggaggcagagcttgcagtgacccgagatcgtgccactgcactccagcctgggtgacagagcaagactccatctcaaaaaaaaaaaataaaaaccaaagtgattagtttgataaggtgtcattcagtcatgccatatgaggaatgactatagccttgatggtgcttggcttgggactgggaaagtacggatgggcatgtgtgagagagcataatcttcaaaggcttgaagggctgtyaaaagcaggaatgagtctttgtaactctaggagtagaactaaggtcaataagtagaaataacaatgaccagatcttgggtgaacgttaggaaggaattcccaactatatgatgcctgaaaatgaattggtctatctcaccaccaaggaattggcctacgttggcggtgttctagcagattgccttttcatgatagatggcaaaagacctctagcctcatatggattagggggttagatagaatgacttccaaagatccttctgaccttgaggtactgtgattccatgagatcatacctgg

SEQ ID NO: 109744 - DNA, 601 bp, Human
gattagtttgataaggtgtcattcagtcatgccatatgaggaatgactatagccttgatggtgcttggcttgggactgggaaagtacggatgggcatgtgtgagagagcataatcttcaaaggcttgaagggctgttaaaagcaggaatgagtctttgtaactctaggagtagaactaaggtcaataagtagaaataacaatgaccagatcttgggtgaacgttaggaaggaattcccaactatatgatgcctgaaaatgaattggtctatctcaccaccaaggaattggcctacgttggmggtgttctagcagattgccttttcatgatagatggcaaaagacctctagcctcatatggattagggggttagatagaatgacttccaaagatccttctgaccttgaggtactgtgattccatgagatcatacctgggaatatatttgagttctttagaaaaatgtgccaccaaattgcagaaaatttatgtgaagatatttgggtctggacacttggatttacttttatctctctttatgaggttccaaaacaatcacattagatttacacgttttctgtaagctttgtcactgaaaaaa

SEQ ID NO: 109745 - DNA, 601 bp, Human
gttctttagaaaaatgtgccaccaaattgcagaaaatttatgtgaagatatttgggtctggacacttggatttacttttatctctctttatgaggttccaaaacaatcacattagatttacacgttttctgtaagctttgtcactgaaaaaacttgatattataaaaatatttcaatgactgagtttattcaacattgttgactacctttagttactttctaatgtcttctggctgattcagagattctgggcttctcagaccttacttggaaaggtctgataagaccaaatttaaaatgytatgtatgtgatgattcagttctttagaagggttgccagtttgtggtgtacagtaaacacttggattactaaatattctagtgaagattagcacttttcatttgcatcttttttttttcttctgagattctcaaataccttaaagataagcagaaattcataatctacattcattctgaaaacttttatattactattcagcaagtgatctttaagattgagctaggaacttgtggccctggtgtgttattttcaaataactagaaacttacattttcaaatgatgatttttatctttga

SEQ ID NO: 109746 - DNA, 601 bp, Human
attgttgactacctttagttactttctaatgtcttctggctgattcagagattctgggcttctcagaccttacttggaaaggtctgataagaccaaatttaaaatgctatgtatgtgatgattcagttctttagaagggttgccagtttgtggtgtacagtaaacacttggattactaaatattctagtgaagattagcacttttcatttgcatcttttttttttcttctgagattctcaaataccttaaagataagcagaaattcataatctacattcattctgaaaacttttatattamtattcagcaagtgatctttaagattgagctaggaacttgtggccctggtgtgttattttcaaataactagaaacttacattttcaaatgatgatttttatctttgaagcaaggattttgattttgttttggttttatagcttattttcaaagttaagaaacgcaagaaagggtgttaatatatttcattcaggaaaggtcctggttggtaaaatatgtaaaagtacaaacttctgaattcaccatcatttcctgatggatttgtaaaaatttttctccccagtctaatgtatttgtttgt

SEQ ID NO: 109747 - DNA, 601 bp, Human
ttcctctcagctcatacctatgctgttaatgctttgacataaatctttttagtattttttctgtgtgtatataaacataaaagttggttcatactgtgtatataataattttggtggtttcctaggattttgttgtagaaatagaaaatatttaaccaatacatttttgactattggtgtttcttgtaggtaatgtgcatgtgtatgggtgtgtgtttgtgtacatgttttgccctcattgatggtaatttgcttagaataaatcaaggtttttgtaatgtgttgctaaatattttaaaartttccatttttgtcagcagtgtataagggggtcaggaaaggagttggtaactgaaaaaaaatttaccacttttccagataataaattgtgtatgtttgaatttatttatgtgaagtttgatttatttttccatgtttatcaattctttgtatttgttccttttttggattgctaattcattttcttttgtccctttttctataaaaatgtttagttgtacattgatttgtgagaactattagtatataactatattaaccttggataatatttgtttcaacattgcttatggctttttct

SEQ ID NO: 109748 - DNA, 601 bp, Human
ttacactgtcaccaaggctggagtgctgtggcatgatcatagctcactgcagcctcaacctcctgggctcaggcgatcctcctgcctcagctacctgtgtaattgtgacctcaggtgcatgccaccatgcccagcaattttttttttttaatcatttgtagagatggtgaggggttgggagagaatcttgctatgttgcctgggctggtcttgaactcttggactcaagtgatcctcctgcctcagtctcccaaagtgctgagattataggcatgagccactgcacccagccagacttctctttttttttaaaaatgtgttcttatgtaattagaaagctttttgtgctctgaagacagataaataatctcctatttattatcttctcattgtttgagatgcattttaacttttatggtaaaactcactgagaacttaattggattgtttcactgaggtcttgagcatcagctttcctcagctgtaactgtagtgcaaagcataagatctcagctatggttcttaaatgacttgtctgtagtcctctttgaggatgatggcaataattacttggaaaataagtttttgttgaaagatgagg

SEQ ID NO: 109749 - DNA, 601 bp, Human
tgtgttcttatgtaattagaaagctttttgtgctctgaagacagataaataatctcctatttattatcttctcattgtttgagatgcattttaacttttatggtaaaactcactgagaacttaattggattgtttcactgaggtcttgagcatcagctttcctcagctgtaactgtagtgcaaagcataagatctcagctatggttcttaaatgacttgtctgtagtcctctttgaggatgatggcaataattacttggaaaataagtttttgttgaaagatgaggcagtgaactgctggygatggtgctgaagttcaagaaattttctgcaaataactgaaatagatacttaaggcaaattatgtttatattataaatatattatttataattttgaatatatactctgaagcagtctgttattatggcttaaagtgtgtaaatgagtatattccaaagcattaatgtcattgaaacaaccacacattgtgactgtctggaatttttttgcctgcaaagaaaggatttcatttcctcagaaacattaagtttctaatcactttatttttttgaccatcttttctttgataatttagatca

SEQ ID NO: 109750 - DNA, 601 bp, Human
caaataactgaaatagatacttaaggcaaattatgtttatattataaatatattatttataattttgaatatatactctgaagcagtctgttattatggcttaaagtgtgtaaatgagtatattccaaagcattaatgtcattgaaacaaccacacattgtgactgtctggaatttttttgcctgcaaagaaaggatttcatttcctcagaaacattaagtttctaatcactttatttttttgaccatcttttctttgataatttagatcaatgttagttattgatttgctgagaatcctrgggaccccctcaccacttttggagaaatttgcaacggtcatatttaattatgtaattcagtacaaaattaaacctaatttttacttaacacctgtttctgttttaaactttttaatatttcttgcattttattagggccatttaaaaaatgttgtcttgcttcctatttacacagttagatttctggtgtttttgaacttcatgggtggttttaagctaatcctcttcagaatagtacaatgagaacttcaaagaagcttgtcttgattcctcacacagtgcctggaacatagttagcac

SEQ ID NO: 109751 - DNA, 601 bp, Human
tttatattataaatatattatttataattttgaatatatactctgaagcagtctgttattatggcttaaagtgtgtaaatgagtatattccaaagcattaatgtcattgaaacaaccacacattgtgactgtctggaatttttttgcctgcaaagaaaggatttcatttcctcagaaacattaagtttctaatcactttatttttttgaccatcttttctttgataatttagatcaatgttagttattgatttgctgagaatcctggggaccccctcaccacttttggagaaatttgcaayggtcatatttaattatgtaattcagtacaaaattaaacctaatttttacttaacacctgtttctgttttaaactttttaatatttcttgcattttattagggccatttaaaaaatgttgtcttgcttcctatttacacagttagatttctggtgtttttgaacttcatgggtggttttaagctaatcctcttcagaatagtacaatgagaacttcaaagaagcttgtcttgattcctcacacagtgcctggaacatagttagcactcagtagatatttggtgtatggtgttcatatgaat

SEQ ID NO: 109752 - DNA, 601 bp, Human
gataatttagatcaatgttagttattgatttgctgagaatcctggggaccccctcaccacttttggagaaatttgcaacggtcatatttaattatgtaattcagtacaaaattaaacctaatttttacttaacacctgtttctgttttaaactttttaatatttcttgcattttattagggccatttaaaaaatgttgtcttgcttcctatttacacagttagatttctggtgtttttgaacttcatgggtggttttaagctaatcctcttcagaatagtacaatgagaacttcaaagaakcttgtcttgattcctcacacagtgcctggaacatagttagcactcagtagatatttggtgtatggtgttcatatgaatgaatttacttgcttttcagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggaggtaagcaggtggttgactcccttaccttctgtacaggccagtcttagctggggtgggtt

SEQ ID NO: 109753 - DNA, 601 bp, Human
tttggagaaatttgcaacggtcatatttaattatgtaattcagtacaaaattaaacctaatttttacttaacacctgtttctgttttaaactttttaatatttcttgcattttattagggccatttaaaaaatgttgtcttgcttcctatttacacagttagatttctggtgtttttgaacttcatgggtggttttaagctaatcctcttcagaatagtacaatgagaacttcaaagaagcttgtcttgattcctcacacagtgcctggaacatagttagcactcagtagatatttggtgyatggtgttcatatgaatgaatttacttgcttttcagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggaggtaagcaggtggttgactcccttaccttctgtacaggccagtcttagctggggtgggttgcatttccttgggtgctgcgtgtatgtgtttactggatagcaaactctcggtttgctgtgg

SEQ ID NO: 109754 - DNA, 601 bp, Human
tgtatgtgtttactggatagcaaactctcggtttgctgtgggttatctagatttcttctctctctcttttttgacacagagtctctctgtcacctagactggagtgcagtggcactatctcactgtaacctctgcctcctgggcccaagcaatcctcgtacctcagcctcccgagtagctaagattacaggtgtgtgctaccatgcccagccaatttttcttatttttagtggagacagcgtttcaccatgttggccaggctggtctcgaactcctgacctcaagtgatccacctgcctcsgcctcccaaattgttgggattacaggtgtgagccatcgctcctggccatagatttctttaaaggtatccttgatctgtttcctttctcggttaccatttctacaagagtcattactttttaaatttgtgtaaaatacaaaatatgtaaaatatggtgacatattttaacttcaccttcaagccattttgcattctggcctcaattattgttcccactcttatctctttactttcatctccaaatactccaagtgcatctatttactattctccaaagtgtctttgtccattagccacccc

SEQ ID NO: 109755 - DNA, 601 bp, Human
ttcgtttagtgcacttttctctaacaaatagcttaggaggacatctgtcttatacccatctttgttttctggtttctactaacctccttaatcccagttcttagttttttgttaggcattatctacctaacagccctaaagctttttacacagtgtctggtgcatagtagttactcattaagtatttttcttttacttaaagtggctcagtcttgttcttgtgtttcctggggaagtgagcaaaggcttttttttttttttggaaaatacaaacaacttttgttgctttttgttcaaagaygtcagcctaagagagaattccaagtaggcacttggaagagttaataaagcacagcgggctcctctctctccctgtctctctgaagagctggctttcctcattgttctctctggagcttaatgagcaggtctggattcagcagcacatcgttccgcattagaggctgctggccaactaaagccatcaccccgctgtcagctgctctttcctcattcctcctcccagcagcactaattcatccccacggtgttagctgagagcaggattcccttggcagagtctgcaaattcacattgtaca

SEQ ID NO: 109756 - DNA, 601 bp, Human
tgattttatcgtcatggtagggagttgaagatattttctagggaggtgaagttaatacactagaacacaatgaaaatatctcctttctgagatgcaagtcaaaaccacaatgtgatactatctcacaccagtcagaatggctattattaagaagttaaaaaaataacagatgttggcaaagctgtggagaaaagggaatgcttatacactcttggtgggaatgcaaattagttcagcccctgtggaaagccgtttggagatttctcaaagaattaaaaatagaattaccattccacacagmaatcctattactgagcatatacccgaaggaaaataaattgttcttacaaaaagatacatgtgcttttatgttcattgcagcgctattcacaataacaaagacatgaaatcaattcaggtgcccatcaaaggtagattggataaagaaaatgtagtacatatacaccatggaatattatgcagccataaaaaagaacaaaatcatgtcctttgcaacagtgtgggtttagctggggccattatcctaagcagattaacacaggaacagaaaacaaaatactgcatgttttctgttataagt

SEQ ID NO: 109757 - DNA, 601 bp, Human
tgatactatctcacaccagtcagaatggctattattaagaagttaaaaaaataacagatgttggcaaagctgtggagaaaagggaatgcttatacactcttggtgggaatgcaaattagttcagcccctgtggaaagccgtttggagatttctcaaagaattaaaaatagaattaccattccacacagcaatcctattactgagcatatacccgaaggaaaataaattgttcttacaaaaagatacatgtgcttttatgttcattgcagcgctattcacaataacaaagacatgaaatcarttcaggtgcccatcaaaggtagattggataaagaaaatgtagtacatatacaccatggaatattatgcagccataaaaaagaacaaaatcatgtcctttgcaacagtgtgggtttagctggggccattatcctaagcagattaacacaggaacagaaaacaaaatactgcatgttttctgttataagtgggagctgaacattggggatatatgctcacaaagatgggaacagtagacactggagtttccaaaagaggcaagagagggagaggagtaagggttgaaaaactacctgtcagg

SEQ ID NO: 109758 - DNA, 601 bp, Human
attacatattcatgctgcagtatttaccagctatatgtttgaaatcaatcaggaagtagatttttttgttttcctttgtgaatgcaattagtgatttctattgttttgtttcgtttttccaaaatttcgttatgatatgtttaatttccggatgggatttttttaggttttttttttttttttttttttttattaaagggataacctcactgtcttggaagtagttacctcagcatattaataattattttacaaaacaaacaaaacatctctcaaaatttctcagtcagtgtgatggctyatgtcatggttgtgttgctttaatagatgatactttaaattgcattattcttttctttcttctcatgacagcctactattatagagctgcttttttgatgcagccagaataggttggaggtccagccttgaaaaatttaaatagtaaagctttaactactgtaggcttttgggactttctggggcccgtttacctgcttctctagtccgaagggaacagttcctagttatgggaagtgaagaggttctgtcacttgactgagtagtgaatgctcagggctgctttcctgtaattctggca

SEQ ID NO: 109759 - DNA, 601 bp, Human
tttttttaggttttttttttttttttttttttttattaaagggataacctcactgtcttggaagtagttacctcagcatattaataattattttacaaaacaaacaaaacatctctcaaaatttctcagtcagtgtgatggctcatgtcatggttgtgttgctttaatagatgatactttaaattgcattattcttttctttcttctcatgacagcctactattatagagctgcttttttgatgcagccagaataggttggaggtccagccttgaaaaatttaaatagtaaagctttaacwactgtaggcttttgggactttctggggcccgtttacctgcttctctagtccgaagggaacagttcctagttatgggaagtgaagaggttctgtcacttgactgagtagtgaatgctcagggctgctttcctgtaattctggcagagcctcctcagagaagcagggcaaaataattggctcttatgctacagatgacaagtgggccctaggggctgtgtgttttctcaatattggcttttctggatgtcagggacaagtaactcaaagatgtttttgtgaatgtcactaaatagacatggt

SEQ ID NO: 109760 - DNA, 601 bp, Human
ttccctaaacacatttccttcctgtgctttacagataattaaaaaactgattgaaagaaaacaggcacaaattcgaaaagtttaccctggactttcatgttttaaagatggagttcgacagattcctatagaaagcattcctggaattagtacgtatagaccttcttttaaaagcgaaattttttagtaatgccgtggtttgtgtttgaaacaatttccagaatgcagtaacttcgaaagctttattgccctgcccgtctctgtgttatctctagtcttttaagaaggcagcaaatgttayccttttatgtcttccctaccacccaatacaaacaaaccaaagggagcttagatgcccccttgtaatagctgttaatatccaccacttattaagagtctgccatttgtagcacagtgcgaattattacacatatgcaaccttgaaagcagggaatcctattttataaatggggaaatcgagttccaaagcagttagatcatttactgttaaagggcacatagccagtaacggtcagaattagaagcagcccagttctgatggccgaacaccttactgtttgcaccatgtctcattgccacc

SEQ ID NO: 109761 - DNA, 601 bp, Human
tttcatgttttaaagatggagttcgacagattcctatagaaagcattcctggaattagtacgtatagaccttcttttaaaagcgaaattttttagtaatgccgtggtttgtgtttgaaacaatttccagaatgcagtaacttcgaaagctttattgccctgcccgtctctgtgttatctctagtcttttaagaaggcagcaaatgttacccttttatgtcttccctaccacccaatacaaacaaaccaaagggagcttagatgcccccttgtaatagctgttaatatccaccacttattawgagtctgccatttgtagcacagtgcgaattattacacatatgcaaccttgaaagcagggaatcctattttataaatggggaaatcgagttccaaagcagttagatcatttactgttaaagggcacatagccagtaacggtcagaattagaagcagcccagttctgatggccgaacaccttactgtttgcaccatgtctcattgccaccatggttgcagcctccaagatctgtgcttgactagtctccccaaacttctaaaaaatactatttgttatgtgtggtggaaatcatataccttg

SEQ ID NO: 109762 - DNA, 601 bp, Human
atagccagtaacggtcagaattagaagcagcccagttctgatggccgaacaccttactgtttgcaccatgtctcattgccaccatggttgcagcctccaagatctgtgcttgactagtctccccaaacttctaaaaaatactatttgttatgtgtggtggaaatcatataccttgtttcatattccctattttacagtagttttcctaagggttcttgtctgtatgttagagttgagttgtgttgggttaaaccataccaaatagttgtttttataggtcaaaagccattgaatatcatttggcaattttgttcagttcaaatccaggttctttttagtatatttaagctttaataaacaaaatcaaacaagcaaaaattttccagaaaaaataagatgttatttggacaagatatatcactttattacatgtgccctctggcagatcttacttttatgctaaatccagaaattctacttccatgtattatctctattaatgacataatagcaaccatatcattgaatgcctacttgtgccacgcatttatctgtttttgtttttttttttgtacattaactactctcaacagggataaaa

SEQ ID NO: 109763 - DNA, 601 bp, Human
atgttttatattgttagtggtataaggaagtaactaattgccattaatttcagtcgtctctcagaagtagacttttattgtcatgcctataatttcttgtttttgataagtattaactatgttattctcttgaccaaaagcacttctcattcagtgtttcactttgttgacgtataggagagacaggctggaaaccgagtggaaaagagaaaaggtaagtatgacgggcaagaggatgttaatggaagtgatttttttttttccccaccaagcaacttaaagaaaaacggcaaactaattrtaatcactaacacaacagttggtgggttttgagtttcctaaaacattctggaatggttccaatttcaggtttttgtaagaatgagctgaatagtaatcagctggcaatagggtaaaactctaatcattgctccttgtttccctttttcctttcaagtaaagagcccagagaccctgaccagctttacagcacgctcaagagcatcctccagcaggtgaaggtgggtgtcctctttattcacctcatgcaaatattttgaaatgatttcccacatggaatttccatattagataccttact

SEQ ID NO: 109764 - DNA, 601 bp, Human
atgcaccgtggcgggtcagtgatggcagagaagtgggtggctgtgttcattagagacattctgcagctgtcgtttagagcccacatgagcttaacgacactagacgcagaaaatccacggtaactgcagacagcactagatttgaaagctggcactttagatataactttgcttatattctaactctttggtgcaaatagaaaaacatcagcttatcctcttgatatgctttgcgtctgtcgtaaataggtattcctttgaataattattcaggataataatgaaagaagttagattaaastacttgactgctgtactttcagagggagaaattctacttaccacaattcttgattttccatgcccttgatgggtactgttaatgtcactgtatatactctttattttacgctttgtctcatatccaaaatcaaacaaaaaaggatgtcttcagaaatgtagaattgtgcagtttggtgctgtgcccacaccactctaaaattaatgattaattgaatcatttgaggtcgctcaaattaaactaatttggcattgtgtgggtgacaaccagttgaaatgttttctttttatcagctatgtg

SEQ ID NO: 109765 - DNA, 601 bp, Human
gtaactgcagacagcactagatttgaaagctggcactttagatataactttgcttatattctaactctttggtgcaaatagaaaaacatcagcttatcctcttgatatgctttgcgtctgtcgtaaataggtattcctttgaataattattcaggataataatgaaagaagttagattaaactacttgactgctgtactttcagagggagaaattctacttaccacaattcttgattttccatgcccttgatgggtactgttaatgtcactgtatatactctttattttacgctttgtctyatatccaaaatcaaacaaaaaaggatgtcttcagaaatgtagaattgtgcagtttggtgctgtgcccacaccactctaaaattaatgattaattgaatcatttgaggtcgctcaaattaaactaatttggcattgtgtgggtgacaaccagttgaaatgttttctttttatcagctatgtggccatatttttggagagagccagagtcttctgtctcttttctacctgtaatctattccaggtgctaagaactgtgaaagtccagcttgggtaatgtagtgagaccctgtctctacaaaa

SEQ ID NO: 109766 - DNA, 601 bp, Human
tttcagagggagaaattctacttaccacaattcttgattttccatgcccttgatgggtactgttaatgtcactgtatatactctttattttacgctttgtctcatatccaaaatcaaacaaaaaaggatgtcttcagaaatgtagaattgtgcagtttggtgctgtgcccacaccactctaaaattaatgattaattgaatcatttgaggtcgctcaaattaaactaatttggcattgtgtgggtgacaaccagttgaaatgttttctttttatcagctatgtggccatatttttggagasagccagagtcttctgtctcttttctacctgtaatctattccaggtgctaagaactgtgaaagtccagcttgggtaatgtagtgagaccctgtctctacaaaaagtaaaaaattagccaggtgcagtggcacacgcctgaggccccagctacttgggaggctgaggttggaggatcacttgagcctgggagtttgaggctgtagtgagctgtgattgcaccactgcacttcagcctgggcactggagggagaccgtatctcaaaaaaaaaaaaaaaaaaaaaaaaattgtggaagtgttaa

SEQ ID NO: 109767 - DNA, 601 bp, Human
ggacaaagttaaagctataaatggtgttcttcagtagggcagtattttttttcttggtattgttcagatgctgagtaaaatatttagtcttgtccccaagattatcttgtatttgaagacaagattgacaaatcagtaattttacattttcccacgatttccttatttgatttttctaataacattacttttctttccccatattctgaaaaactgtttctctcatatggatgggatctaacctgttttacttagggagtcacacactggacatcagctgtatagtctggcccaagcatgwcttcttgttacccatggatggctaggcagggttttgctgcttacccagaattcccaagttaaggggaaaggacatgaaaactgaataatttaatggtgtctctatatttggtaccaccaatatttagtcaccttttttaacccacctcattttgtcaattgaaaaaactctacgaaggccagaggaagaagaatgctatctatagctttagaatagaaaggaagtattcagaattggttatagttattcagaaaagtccagacaccgccataattcttgctttgtttctgctgcatttta

SEQ ID NO: 109768 - DNA, 601 bp, Human; identical to SEQ ID NO: 31754

SEQ ID NO: 109769 - DNA, 601 bp, Human
aaaaaaaatctatagtgattttctgtatgtcctcatttgtgatgtcatgggcaaattatggttttctagttaaaggaagttggattaacttctgattataaagttaacggaaggtggactggtgaacactgctgtaagtagataattcaatggagaagaaaatttagaaataattttattttgaaatatgtatagtttatgttttctagttgtaagttaaccttcctaatatgtttgaagactaaaagtaaaagcattactactggccaagtgcagtggctcatgcttgtaatcccagctstttgggaggctgaggcgaatggaacagttgaggccaggagttcaagaccagcctggccaacgtggcgaaactctgtctctactaaaaatatatatatattaaaaaaaaaaattagccaggcatggtggtgtgtgcctgtaatcccaggtacttgggagactgaggtgggagaatcacttgaacctgggaggtggaggttacagtgagattgtgccactgcacttcagcctgggcaacagagtgagactgtctcaaaaaaaaaaaaaagaaaaaaaaagaagacattactattaatgctcc

SEQ ID NO: 109770 - DNA, 601 bp, Human
atctcaggtttaaaaccatccaattaaaatattaaagcacactattgttattatttaagggatatttatttagtgtctgcatatttatgcacgtctggccttttaagcattttgaaaggaaggtatggtgctatggctcttctaaatattagctgaatctagtcagtagtaacttagtaaagttgaaaatatttagagtatattatttgatgttaactgttggctttcagagaaatacactaacaaaaatgtagaaaatgtagacatgtctttgtgttgaacatatcataatccgtgggtytttttgaatgacagaaaacccagagatttatagaagaagctagatgttgtttgtaactactctgagagtttacttaactttttttacattacatattccaggttacagtgtatttctttctagctgtttgccttaccattctagcttcctgtaatctcttagcttgtttttttcttgccattgtgtgttatcttctaaaaaatcttacttgactcgaattaaaacaatataaatcattagatgcttttgtttcttttttaaagagtttttttgtggagttattcatgcctttagacaagt

SEQ ID NO: 109771 - DNA, 601 bp, Human
atgacagaaaacccagagatttatagaagaagctagatgttgtttgtaactactctgagagtttacttaactttttttacattacatattccaggttacagtgtatttctttctagctgtttgccttaccattctagcttcctgtaatctcttagcttgtttttttcttgccattgtgtgttatcttctaaaaaatcttacttgactcgaattaaaacaatataaatcattagatgcttttgtttcttttttaaagagtttttttgtggagttattcatgcctttagacaagtagataataacaaacttccatcaacacatggctgtctttttattatttttaagcaaatgcgagacataaaatttcatctgtaaactcaactctcatgttatctgtaaatttcaaggactttaaaatatatatggcaacagtgctatttttgtccctatgacaattaacagtaatctagtcatctggtcagtgttttaagttttctgttgttcatcagtatcttacttttcttttttttttcttaatggtttgtttgaatgaggatccaggtaatatccacacatcgagtggttaaaatgggctttaaaa

SEQ ID NO: 109772 - DNA, 601 bp, Human
ctttggctgggcaccatgcctcatgtttgtaatcccagcactttgggaggctgaggcaggcagatcacttgaggccaggagttcgagtctagcttgggcaacatggcaaaaccccatctctactaaaaatacaaaaatttgctgggcgtggtggcgtgtgcctgtaatcccaactactctggaggccaaggcacaagaatcacttgaacccagcaggcagaggttgtagtgagccaagatggcaccactgtactccagcctgggtgacagagtgagactctgtctcaaaaaaaaaaaaaaaggaagaaaaaaagggattggaggctagatggatcacagtgacacctacaaagattggactggaatggacctgtattagtagtatgtggcatagattcaggcagaggtttgtgttaggggcctcaggccaggtagttattctggagctggataatctataacctggggcccctgccggcttaaagtccctgggaaacatagcagctcaggtgacttcagtgccttatgggacacggacgcagcccgagtgctacctggtacacatctgagttgtagtccttttcctgtgtctttttcattg

SEQ ID NO: 109773 - DNA, 601 bp, Human
gcacctgggaccacaggcatacaccaccacgcctggctcatttttgtattttgagtagagatagagcttcactatgttgcccaggctggtctctaacttttgggcccaaatgatccgcctgccttggcctcccagagtgctggggttatgggcttgagccactgtgcccagccaacttggtgtaacttttattgaaaaaatttgtgtttaagcggacatgcacagttcaaactcatattgtcaactattaacattttaaagtgatcattttccctctaagctctacttaactgtgctataygaatgttgatgtattttatcatttggttcaaaatgttttctaattgcccttgtgggccttctttgacccattgatttatttagaagtagtggtttaatttttacatatttgaggttttcctaggtccttttctgtaattgattgctgagttaattctgtatcatcagtgaacatttttgatatattttcactgctttcctttttattgagatctctttatggtccagcacgtgttctgtcttggtgagtgtacagtgtgtacttgaaaggagtgtgttttctgaagttgttgggtgtagt

SEQ ID NO: 109774 - DNA, 601 bp, Human
ttaatcatttctgaaggttatatgaccaaacaagctagccctcttctgctactcccttgctcaactccttgtttgttccaggtgtattctggaaaatgtaaaaaatgtaaagctttttctgtgtgtacatctatatgtgaggtagggaggcaagaacacacctttggttaatttttccttgaaaccttgcatatcagattcataatatctttgggagtgagaatgctttgctttaagaggcgtcacaaagtaagtttagaacaattggaatggaaacactgttgggattttttttttttttctttttaggaaataattctaaagctcatccaaaagaacagaaaagtaaaactagttgggaataatttgtaaaattatttactgtttgtaaatagtcaataattaaagcaacctgaaactagtgcaaggataggcacggatctgtagattagatcctgagatatactgtaaccttcatatattataaatgtggatgatcttgtaaaacaaaagaatttcagcattcagtgtggaagttggttattcaatgaatggaaaattaactagaatgttacctgacatgatacaccaaaatttcaga

SEQ ID NO: 109775 - DNA, 601 bp, Human
ctagttggatgtatgtagattggcttagtgaaaaaagattctctaaattccagatcctctgtcctttccttattcttttatctttctatatagaggttataagcagagtcatgccatgtggtttattctttttatcctttttatgaaaataaggttttctccaaataaaggtgaatatccatttcaacaagtttccactccaatttgctgtccccctcaaggattactgatataatactgattcttacctttccttttatatatgagtaattgggaatgagtatggaggtttcctattttggttattcataactgagtttgttaaattgctagccctgtatatatttattatcatgagttggctgctgtgctggatagctgctatctgcacttctcactccagtcttttccctgctctggctccaagcagctggtctgtctggatatacaaatgggcttcttgtccctgctttctagttgggttcagctggtggggaacattttcagctgattgaaggaaaggaggagagagaggttaggatttttacttttcatgacttcttcctgtgggatttctgtagcctggccgcatccttccatt

SEQ ID NO: 109776 - DNA, 601 bp, Human
gttggatgtatgtagattggcttagtgaaaaaagattctctaaattccagatcctctgtcctttccttattcttttatctttctatatagaggttataagcagagtcatgccatgtggtttattctttttatcctttttatgaaaataaggttttctccaaataaaggtgaatatccatttcaacaagtttccactccaatttgctgtccccctcaaggattactgatataatactgattcttacctttccttttatatatgagtaattgggaatgagtatggaggtttcctatttttgttattcataactgagtttgttaaattgctagccctgtatatatttattatcatgagttggctgctgtgctggatagctgctatctgcacttctcactccagtcttttccctgctctggctccaagcagctggtctgtctggatatacaaatgggcttcttgtccctgctttctagttgggttcagctggtggggaacattttcagctgattgaaggaaaggaggagagagaggttaggatttttacttttcatgacttcttcctgtgggatttctgtagcctggccgcatccttccattgaa

SEQ ID NO: 109777 - DNA, 601 bp, Human
tctttaatagtattgcatagtggatactttcatcttgggaggttaacaagatggggcagagagtcaaaatagagggaataaataatggggaagtaacgagcttcttgtttgcttgaggaactctgtttcaacccaagagaatctgttcagagcctgttttggtcctgagggaacatttgttgtggtttacagcagaggtctttaccttcattcaggagcacattagctctgacttgcatgctctatcaaaatttgtattcttactactttccaaaatagactacatttttcttttttttttggagactgagttttgcttttgtcacctaggctggagtgcaatggtgcgatctcggctcactgcaacccccgcctcctgggttcaagcaattctcatgcctcagcctcccaagtagctgggattacaggcacccaccaccacgcctggctaattttttgcatttttagtagagacagggtttcgccatgttggccaggctggtcttgaactcctgacctcaggtgatccacctgcctcagcctcccaaagtgctgggattacagttgtgagccactgtgcccggcctaaaatagactactt

SEQ ID NO: 109778 - DNA, 601 bp, Human
caagaaacatcaattctttatcacactttgaggatcagtaaacattttttgttgaaaatgttttgtcacttgtaactgttgagctgtaatatgtaaccatataattgtgttgctttttaatcacagaagagattatatttaatgtcggttggcatgacctctttccgtggaaaaatggggaaaggatgtaatgtctattttttattcctttatgaaattgaaaatattcaaaagtaattggatactctaacgtttatgtgctaatcactcatggctaatcttgtttcatttgtcattccastcactgtcatattattttgaagcaaattttagacatagtattagtttatccttaaatattgtgtatatcaatctataaaacatactttttttgttaaatataaccacattagtagcatcattccctaaataatagtagtaataataattcattaggattcaaatgttcattatagttcagatttttccatacacatacatacgtacatatgtacatacatgcatatatacatacatacagtttgtttgaatcagattttcaacaaggtccacagactgcaattgtgagacatgtctctta

SEQ ID NO: 109779 - DNA, 601 bp, Human
cttataatcgattgttgaagatagtgaatagatcagtacctagaagtaaaaatggatacaagtactacaaagtcctgtcttgcctatttaataggtattctattaatgtttggggctctgaattatatgctataatttctatgctagcattcattgtttcttaaattttaatgagtttaaaattgcaggcttctaatagaatatgaatatcttcaatttatttggtgatcttgtcctttttttaaatttttatatatgaccatggtgagacatttgtaaacttaaaaaaagctctattaattaaaccatttttgtattattattttaagtatttcagttattattcagattcacatagttgattaccatttttaatcagtgaatttttccaggatgttttctacatctttgtctgctttcctataactcagtactgtaactcagtactctgaaatagtttcctttgttaatagagtcacttttatagtactgtgcttgaggtcatatacagagtattgtgtccaaatttatcattgcacaaagtgtttttggaaattcttggttactccttagtaaattacctgtaattgggttaaatgct

SEQ ID NO: 109780 - DNA, 601 bp, Human
atttggtgatcttgtcctttttttaaatttttatatatgaccatggtgagacatttgtaaacttaaaaaaagctctattaattaaaccatttttgtattattattttaagtatttcagttattattcagattcacatagttgattaccatttttaatcagtgaatttttccaggatgttttctacatctttgtctgctttcctataactcagtactgtaactcagtactctgaaatagtttcctttgttaatagagtcacttttatagtactgtgcttgaggtcatatacagagtattgtrtccaaatttatcattgcacaaagtgtttttggaaattcttggttactccttagtaaattacctgtaattgggttaaatgctggtagggtttaaaatctgattgctaagtgaattctctataaagtgagttttgatacatagaaacttttcatataattcttaaactcatgtgtcatgtattttcatttatagttttcatattcattaacatatgttgttccttaccatttacagctcagaattctgcaaatgcagattttgcaaactttgatgcatttggacagtctagtggttcgagta

SEQ ID NO: 109781 - DNA, 601 bp, Human
gaaagtaggaatgaaatctaaacctaaccatttgaaagcagatcacatcacactttatgtagaaagttgctggaaataaacaaatcaaatcctgacaatgatgccagatgtagtggctcacacctgtaattccagcactttgggaagccagggcaggtggatcgcttgagcccaggagtttgggaccagcctgagcaacatggtgaaaccccatctctacaaaatacgaaaaattagctaggcatggtggcacatgcttgtcatcccagctactcaggaggttgaggttggggactcaccygagcctgggaagtcaaggctgcattgagtcctgatcgtgatcgcaccactgctctccagcctgggcaagagagccaggccatctctcaaacaaaataaaacaaaaagaaaaacctgacaatgtatcactgcttttggtctataaacctacagagttttttcccttgatgacttaaggtatattgtagcaatattcagagagcaaatagttaaatgaaaagttggcttagttgtgtctaatttaatataaagcagtcaacatttaatattgcaattgactaaaatccttctgaagttctta

SEQ ID NO: 109782 - DNA, 601 bp, Human
actgtaactggggtatgtaaactactctcataagtagaaagactaaaagatgaaccaatcaaaaatagtaactacaaattttcaagacaaatagtacaataagatataaagagaaacaacaaaaagttaaaaagcaggaggacaaagctacactgtagagtttttattagttttctttttgcttgtttgtttatgcaaatagtcttaagttgttatcagcttaaaataatgggttataagatagtattgcaagcctcatggtaatctcaaattgaaaaacatgcaatggatacccaaaaastaaaaaagaaattaaattatatcaccagagaaaatcaccttcactaaaaggaagaaagaaaaggaaaaacactgcaaaaccagaaaagaaataacaaaataacaggagtaagtccttacttatcaatctaaactcttcaaaagagagtggttgaatggatttttaaaaagacccaatgacctgttgcctacaagaaagacattttacctatagagacatacatagactgaaaatgaagggatggacaaagatatgccatgccaatggaaacaaacaaaaaaagaggacttgtagctatac

SEQ ID NO: 109783 - DNA, 601 bp, Human
tgggtcatttaggttgaacaatactctcctatcaagtaagaaatcaagatcaagtaagaaggtgtaagcaatacggtgactaagagtcttggctttagagcaggttgcttgggttaaaatcatagttactatcatcaatagtaaaaaacaaaacaaaacaaacccaaaaaaacactaaaactcattgacctgtctctatgtctttgtttggaggctggtgcaatgctacattcaatgtctccaagaataaatttaagcattgaggttacttcttacctgccttatccatgtaaatgttgtyctagttgcaattattgctcaaaacctacttggtgtgttataatatgataatgaaggaattatgtattttttaattgcttaaccaaggaactcaagaaatttaaatattgcttgttgtaaggttgagaaatttttgaggttacctagttgaaaacagaagtattgcagcttacctgaatgctgactggcaagttgagccctctctgatctactacaatcacagtcatgatggtctgaatcaccaaggcaataaaggtgttgattccaaataccaaggcatagcgttccacattcagattaa

SEQ ID NO: 109784 - DNA, 601 bp, Human; identical to SEQ ID NO: 34012

SEQ ID NO: 109785 - DNA, 601 bp, Human; identical to SEQ ID NO: 34013

SEQ ID NO: 109786 - DNA, 601 bp, Human; identical to SEQ ID NO: 34014

SEQ ID NO: 109787 - DNA, 601 bp, Human; identical to SEQ ID NO: 34015

SEQ ID NO: 109788 - DNA, 601 bp, Human; identical to SEQ ID NO: 34016

SEQ ID NO: 109789 - DNA, 601 bp, Human
gtgttggccccttcgtgcaaatcagaaaaaaaggtgctcttccttggagtgggtgcaggcctaggccaaatgcacaggtctgagagagggccaagctgaattctaacccacttgccctttggctggtatccttgtgcagtgagtaatctgcccaactgtacacagaggccctgtgggcctgggagcagcaatgattgttgctggactcaggagccctggatccccagctccaggcctatgtgcaaacagggaggcatgacccccacttgcctgtgtagagagaggggtgccctggccgggygcggtggctcacacctgtaatccctacactttgggaggccgaggcgggtggatcaccagaggtcaggagtttgagaccagcctggccaagatggcgaaaccctgtctctactaaaaatacaaaaattagctgggcgtggtggcacgcgcctgtaatcccagctacttgggaggccgaggcaggagaatcgtttgaacccaggaggcagaggctgcagtgagcggacattgcatcactgtactccagcctgggtgacagagtgagaccctgtctcaaaaaaaataaaaataaaaaagagag

SEQ ID NO: 109790 - DNA, 601 bp, Human
ggccaactggccaggcgcgatggctcacgcctgtaatcccagaactttgggaggctggggcaggtggatcacttgaggtcaggagttcaagaccagcctggccaacatggtgaaaccccggctctactaaaaatacaaaataataataataataagctgggcatggtggtgtgcacctgtagtcccagctactcaggaggctgaggcaacagaattgcttgaatccggcaggcagagattgtagtgagccgctgcactccagcctgggtgacagagcaagactctgtctcaaaaaaaaaaggggggggcaacgaagcacctggcaggtggcgtcgctgccctttgtgtggcagcggctatttttgcctgattccttcatacagttgagacccggctgcctgtgttggccccttcgtgcaaatcagaaaaaaaggtgctcttccttggagtgggtgcaggcctaggccaaatgcacaggtctgagagagggccaagctgaattctaacccacttgccctttggctggtatccttgtgcagtgagtaatctgcccaactgtacacagaggccctgtgggcctgggagcagcaatgattgttgc

SEQ ID NO: 109791 - DNA, 601 bp, Human
ggaagaacagggaggaaatgctgaagtatccccaagacactgacactcaggccaggactggggaggtccgggtctccaccttctggcctggtgttcttgcctccgtgtaatttccacgcttttgtcttcgtctgcctccctcccccacaccctgccaatggagagacagttatggtttctctggctcggtaagaatcctgtgatacctgacactgtcccctcagttcagcaagcctggggcaggcctctgggtggcactgctgtgggcaccggctgggagtctgggcctggtgaccttgargctgcttggagggggcctggtggacggctgcaatggcatccccagagcttgtcggaaatgcagtcatggctggccttgccctagcccctctgcatgggagtctgcatgaacaagcgccctgggagctgggtgcactggctggtgagcagctttgctctgggactcgtgctcgctggcactgtgcagccaccccttgtcggggctccccgggcaccactggaggccttaccgtgaccctgagaaccaccttagttacacctcaccttacaagtgaatgagctgacacccagagaggcaaac

SEQ ID NO: 109792 - DNA, 601 bp, Human
gcacaggcagaatgtttccagggcagataatgggattcccccgccccacatgtccttctgggactcagtccaccaacactccagcccctacaggagctgacagagccgggcaggagctgggtgcctgaatccagtcgggggtacatctggcttccatggggcccccaggatgagcatgagcttccaggggctcacagtgtaaagaatgtgaggaaaagcagccaggaccctctggaagactgacctgcgtccaaggccactgacctcacaacggcccctgtgactgctggtttgatcagcycctctggttccctctggacggaatggaggattccctagtgtcctctctataacctgcatctcacctgaacccaggtgagcccccgggaacctccaagtcatcatcactggggatacctggtgcttcaagcaggagagaagatctggctaaccgctgggccccgggccccaggcagaatatctccttgaagctctgagcagccccagggtgcaccagccttccacacttctgcttttggtatttcccaggggctcagctcaccttgggttcctgcaaccagcagccacacccagaagagcc

SEQ ID NO: 109793 - DNA, 601 bp, Human
agcaggccctaccttgcccgaaggcagctctgcccagagcctgggtggcgttctcgaagcccagggcccggcagacgacgctggcatcagtcaggtcccacaggttgtcacacacagtgccccactggcctctgtagaagatctccacgcggccctggttggtggcgcccccatcggccagccgcatgtcaccatcgttcacgcctgcaggcagagaccagcgagggcgaggctggggcctgcagcacccaccgcccacacctccaggccccatatgctgtcctgggtctcccctgctgarcttgtatttcagggcttcaaggtcccctggcctctccatgaggggcacctccatgagggaggagtggaagatacatacagccccccctaccccgcaaggaggccaaactcgcctttccttgttttaggggtctcagcccttcactccatagacagaacaggggcagagaagccctgagttctccagcactgggagtggaggtggcaagaccctgagggaaggataggaggggaacggaggccccgtgctgacccgccctgcagagggtgtctgcagtttgggggtgctggcctatggggg

SEQ ID NO: 109794 - DNA, 601 bp, Human
tcaccaatcaccactaacaccaaaaccactgcctgcttagatggcctgaaaagttagggtcctgtggcaaccccattttagaactccgggggtcctcgagcagcttcctgtcggggagaaggcctgcagaagtcatgggaggctcccggctcgggggtcagtgtggtgcaccctctccccttctttgagcccctctcaaagcctaactcaaaatgaaatcccataggtttttctttgccacaaatatagtagttttgaagtaactgtgacctttcaaccaggtgggcttgccctgggcctmctaaaacctgagccaccgcaggacccccagctccctcccacctgcacgccttaccacagctctcctgccccaggagctttggccgtgcgcccatggccccgtgtgctccccgccgcctcccctggcccccgacagccccatggcgtctcctgggcttcccccactgtgagtccaggctcagctccagccacttgtccatcccatgtgggcacaggggctccctgggattcgacccgtcctgccttaggggcctccaactcctggcaaagggcagtgggcaggaaatgcccaggttgtcac

SEQ ID NO: 109795 - DNA, 601 bp, Human
gagagatgggactataatgaccacaagttaggtgacttttcatattcacattccttccacgttcttcgacaatcctggtccagttacttactgtggaccctgtgtgctttactttcctctgctatataatgagaataatattaacaccttctttatccggttggtgtgaaaactgcatgaataaatgtaaagcacttggactgtgtctgacacagagtaaaatgctcgaatagcatcagctgttattactactactacttactactattatttgcaaaaacattacaagggataattatayccaggaagcttcccttgtattggtaatgttttattgctttttctaaaatttaaatcagagcaacagtcaatacatgcacacaaaaaaggcaattcttcaaaaatgtgggggaaaagcctcccatacccatgttacctgctggtgagtttcaggtaagggtgtagctgggagcatccggttccaagactgccttgtatttctcttacaggatgcctccccttctgctgcggtttttaatcagcgtttctagggcaggcttgcaggcggggccgcgaaccccctgtagttgtacacggagct

SEQ ID NO: 109796 - DNA, 601 bp, Human
gtagcgatggaacactggttgattctcctggaactgccttcaactatttaagaaaaatcagaggggaaagcagctttgaaggaaatgtgcaaagtaaagctatatgtgggaggcagcagttctagtaaacgcacagaactcacagctgtgatttttcttttaaagacatataaataaaaaggagtcctcactggtgtaaattactcctgccttttttttttctccacttttttcaactgctcacattttggaactgtgtgagcaagtttttacatattgatcaatcttttaaagtttatayatcattttcttaaagaaggaaacaaagatcaagctgaaaagaacattcaggcaaaagagaaaaattacatgatgaatgaatgcagtctttgtgggcgagaattctgggatgggagtgtggggtgtagggacagctttcaaacacttactcaaatgtgcttatcttcatcatttcctgcctctaatttttaccgaataaccaccttgagatcccaggaattcaataggaaactcaatttaacaacaagttccagggtattccacataatctctctttaaggcaaagtcccaaaagagagat

SEQ ID NO: 109797 - DNA, 601 bp, Human
cagactagccccacggaggtttcctagatctcgggtagcgatggaacactggttgattctcctggaactgccttcaactatttaagaaaaatcagaggggaaagcagctttgaaggaaatgtgcaaagtaaagctatatgtgggaggcagcagttctagtaaacgcacagaactcacagctgtgatttttcttttaaagacatataaataaaaaggagtcctcactggtgtaaattactcctgccttttttttttctccacttttttcaactgctcacattttggaactgtgtgagcaagyttttacatattgatcaatcttttaaagtttatacatcattttcttaaagaaggaaacaaagatcaagctgaaaagaacattcaggcaaaagagaaaaattacatgatgaatgaatgcagtctttgtgggcgagaattctgggatgggagtgtggggtgtagggacagctttcaaacacttactcaaatgtgcttatcttcatcatttcctgcctctaatttttaccgaataaccaccttgagatcccaggaattcaataggaaactcaatttaacaacaagttccagggtattccacata

SEQ ID NO: 109798 - DNA, 601 bp, Human
caagtaatcaaacattaaccgagactcctaacagccagttccttctcagactagccccacggaggtttcctagatctcgggtagcgatggaacactggttgattctcctggaactgccttcaactatttaagaaaaatcagaggggaaagcagctttgaaggaaatgtgcaaagtaaagctatatgtgggaggcagcagttctagtaaacgcacagaactcacagctgtgatttttcttttaaagacatataaataaaaaggagtcctcactggtgtaaattactcctgccttttttttttctccacttttttcaactgctcacattttggaactgtgtgagcaagtttttacatattgatcaatcttttaaagtttatacatcattttcttaaagaaggaaacaaagatcaagctgaaaagaacattcaggcaaaagagaaaaattacatgatgaatgaatgcagtctttgtgggcgagaattctgggatgggagtgtggggtgtagggacagctttcaaacacttactcaaatgtgcttatcttcatcatttcctgcctctaatttttaccgaataaccaccttgagatcccaggaatt

SEQ ID NO: 109799 - DNA, 601 bp, Human
gagacagagcgagactccgtctcaaaaaacaaaaaaccaaaaaaacaaaagaaaacaaaacaaaaaaaccctccagatttgcttgaatttgtcattggccaaatcatattcaccagaaattacctaggtaggtttttaggttgggtgatatttttcgaaggaatggtaaagagcatggagatgagataaacgaaaacctacaaactctcccagttatacaactcacataacctgcaatgatgtctggaattctatggggcccaaagtaacaacaacaatgatgatgatgataagattaagmtcttactacataccaggcacccttctgcatacattaaatatattcaacaaccctattaatatccccattttgcaggtgagaaaaacaaggcatagaaaagctaagtaacttgcccaagatcacacatcttgctccgtgaacacagaggaggaaatgtaactggaaatgccaagcccccgtgcggtctgcctgccagtgatggaaacctgacatgggagggcagccaccacaggaacctgggttatgtttccagtgttgccatttgggcaacagtcttcacattctcttactgaaaacatt

SEQ ID NO: 109800 - DNA, 601 bp, Human
tcgcgccactgcactccagcctgggagacagagcgagactccgtctcaaaaaacaaaaaaccaaaaaaacaaaagaaaacaaaacaaaaaaaccctccagatttgcttgaatttgtcattggccaaatcatattcaccagaaattacctaggtaggtttttaggttgggtgatatttttcgaaggaatggtaaagagcatggagatgagataaacgaaaacctacaaactctcccagttatacaactcacataacctgcaatgatgtctggaattctatggggcccaaagtaacaacaactatgatgatgatgataagattaagatcttactacataccaggcacccttctgcatacattaaatatattcaacaaccctattaatatccccattttgcaggtgagaaaaacaaggcatagaaaagctaagtaacttgcccaagatcacacatcttgctccgtgaacacagaggaggaaatgtaactggaaatgccaagcccccgtgcggtctgcctgccagtgatggaaacctgacatgggagggcagccaccacaggaacctgggttatgtttccagtgttgccatttgggcaacagtct

SEQ ID NO: 109801 - DNA, 601 bp, Human
atcgcgccactgcactccagcctgggagacagagcgagactccgtctcaaaaaacaaaaaaccaaaaaaacaaaagaaaacaaaacaaaaaaaccctccagatttgcttgaatttgtcattggccaaatcatattcaccagaaattacctaggtaggtttttaggttgggtgatatttttcgaaggaatggtaaagagcatggagatgagataaacgaaaacctacaaactctcccagttatacaactcacataacctgcaatgatgtctggaattctatggggcccaaagtaacaacaasaatgatgatgatgataagattaagatcttactacataccaggcacccttctgcatacattaaatatattcaacaaccctattaatatccccattttgcaggtgagaaaaacaaggcatagaaaagctaagtaacttgcccaagatcacacatcttgctccgtgaacacagaggaggaaatgtaactggaaatgccaagcccccgtgcggtctgcctgccagtgatggaaacctgacatgggagggcagccaccacaggaacctgggttatgtttccagtgttgccatttgggcaacagtc

SEQ ID NO: 109802 - DNA, 601 bp, Human
ttgcagtgagccgagatcgcgccactgcactccagcctgggagacagagcgagactccgtctcaaaaaacaaaaaaccaaaaaaacaaaagaaaacaaaacaaaaaaaccctccagatttgcttgaatttgtcattggccaaatcatattcaccagaaattacctaggtaggtttttaggttgggtgatatttttcgaaggaatggtaaagagcatggagatgagataaacgaaaacctacaaactctcccagttatacaactcacataacctgcaatgatgtctggaattctatggggcycaaagtaacaacaacaatgatgatgatgataagattaagatcttactacataccaggcacccttctgcatacattaaatatattcaacaaccctattaatatccccattttgcaggtgagaaaaacaaggcatagaaaagctaagtaacttgcccaagatcacacatcttgctccgtgaacacagaggaggaaatgtaactggaaatgccaagcccccgtgcggtctgcctgccagtgatggaaacctgacatgggagggcagccaccacaggaacctgggttatgtttccagtgttgcc

SEQ ID NO: 109803 - DNA, 601 bp, Human
actaaaaatatatttaaaaaattagccgggcgtggtggcgggcgcctgtagtcccagctaatcgggaggctgaggcagaatggcgtgaacccgggaggcggagcttgcagtgagccgagatcgcgccactgcactccagcctgggagacagagcgagactccgtctcaaaaaacaaaaaaccaaaaaaacaaaagaaaacaaaacaaaaaaaccctccagatttgcttgaatttgtcattggccaaatcatattcaccagaaattacctaggtaggtttttaggttgggtgatatttttckaaggaatggtaaagagcatggagatgagataaacgaaaacctacaaactctcccagttatacaactcacataacctgcaatgatgtctggaattctatggggcccaaagtaacaacaacaatgatgatgatgataagattaagatcttactacataccaggcacccttctgcatacattaaatatattcaacaaccctattaatatccccattttgcaggtgagaaaaacaaggcatagaaaagctaagtaacttgcccaagatcacacatcttgctccgtgaacacagaggaggaaatg

SEQ ID NO: 109804 - DNA, 601 bp, Human
attaaataattaaataattaaaattaaaaaagattaaattaaaaagaattaaagaattcatgatgtctaaaagaacctccagggccgggcacggtggctcacgcctgtaatcccagccctttgggaggctgaggtgggtggatcacgcggtcaggagatgcagaccatcctggctaacacggtgaaaccccgtctctactaaaaatatatttaaaaaattagccgggcgtggtggcgggcgcctgtagtcccagctaatcgggaggctgaggcagaatggcgtgaacccgggaggcggagsttgcagtgagccgagatcgcgccactgcactccagcctgggagacagagcgagactccgtctcaaaaaacaaaaaaccaaaaaaacaaaagaaaacaaaacaaaaaaaccctccagatttgcttgaatttgtcattggccaaatcatattcaccagaaattacctaggtaggtttttaggttgggtgatatttttcgaaggaatggtaaagagcatggagatgagataaacgaaaacctacaaactctcccagttatacaactcacataacctgcaatgatgtctggaattctatggggc

SEQ ID NO: 109805 - DNA, 601 bp, Human
ccttatttttttttataaatagcttccatatttaccatctcatttgagtcttacaacagcctgtgaggtgggcacagttttattattcccactttacagatgacaaaactggaacttagtgctaacttccataaacaactgatcgttgaatactaaaggagatacaaaaaatttgcataaaaaattaaataattaaataattaaaattaaaaaagattaaattaaaaagaattaaagaattcatgatgtctaaaagaacctccagggccgggcacggtggctcacgcctgtaatcccagcmctttgggaggctgaggtgggtggatcacgcggtcaggagatgcagaccatcctggctaacacggtgaaaccccgtctctactaaaaatatatttaaaaaattagccgggcgtggtggcgggcgcctgtagtcccagctaatcgggaggctgaggcagaatggcgtgaacccgggaggcggagcttgcagtgagccgagatcgcgccactgcactccagcctgggagacagagcgagactccgtctcaaaaaacaaaaaaccaaaaaaacaaaagaaaacaaaacaaaaaaaccctccaga

SEQ ID NO: 109806 - DNA, 601 bp, Human
taaagaatagatacttacactatctatataatagtataaaaatagaataagtatagatagtatactatctatacttatactactatattatatatatagatagtatactatatatgctatatatgtaatatagtatactatctatacaatatatactatctatatatatactatctatagatatatatagagatatatatatctatatatagagagatatatatatctatagatagatagtatactataaagaatagatccatcaggttctaaaacaaaatgtgaatcagttatctttccrtggtggaattataggtcatgaaaacactctcttacacttgtcttaattttccaagtgttctagagaaaaaatatgatttgcaattgtgaagacattaaattataatctattttttaaaacaataaaatgctatcctgaagactaccagcattagtgatgcaagactttatatgcaaccacccttgattgccataataaagaatttttcaggattaacatgaacaccaccaagtgtttgccaactgagtacctcagagtatcctgcactgggtccccacgaggtcatcaaatacttattgg

SEQ ID NO: 109807 - DNA, 601 bp, Human
atgaaaaacaaacaaaaactattatgaaagattaagttacaaaaacaagtacattaaacagtgtgaacccactggaattcatatatgcttttaaagaatagatacttacactatctatataatagtataaaaatagaataagtatagatagtatactatctatacttatactactatattatatatatagatagtatactatatatgctatatatgtaatatagtatactatctatacaatatatactatctatatatatactatctatagatatatatagagatatatatatctatatakagagagatatatatatctatagatagatagtatactataaagaatagatccatcaggttctaaaacaaaatgtgaatcagttatctttccatggtggaattataggtcatgaaaacactctcttacacttgtcttaattttccaagtgttctagagaaaaaatatgatttgcaattgtgaagacattaaattataatctattttttaaaacaataaaatgctatcctgaagactaccagcattagtgatgcaagactttatatgcaaccacccttgattgccataataaagaatttttca

SEQ ID NO: 109808 - DNA, 601 bp, Human
gccactagaaatgctatagatgaatgtttaatgacccaaaaaatgtttgttggctgggcacggtggctcatgcctgtaatccagcactttgggaggccgaggcgggcagattgcctgaggtcaggagttcaagaccagcctggccaacaagaagaaatcctgtctctactaaaaacacaaaaattagctggaaatcacttaaacctgggaggcagaggttgcagtgagcctagatcgtgccactgcactccagcctgggcaacagagcgagcctccatctcaagaaaaaaaaaaaaaacaygaaaaacaaacaaaaactattatgaaagattaagttacaaaaacaagtacattaaacagtgtgaacccactggaattcatatatgcttttaaagaatagatacttacactatctatataatagtataaaaatagaataagtatagatagtatactatctatacttatactactatattatatatatagatagtatactatatatgctatatatgtaatatagtatactatctatacaatatatactatctatatatatactatctatagatatatatagagatatatatatctatatata

SEQ ID NO: 109809 - DNA, 601 bp, Human
ttgactttaggcactatagatttaatatatgcttcttataaaaaattaaccaattcagagcaagacactggaacctgcccttttaaatttagtgtattgcaaaaacccttcattacttttttttatttttaatgtcaacttttatttttagattcaggggtacatgtgcaggtttgttacatgggtatatcgtgtaattctgtgatttggggtacaattcattgttacccagatagtaagaatggtgcccaatagacagtttttcaacacttgctccctctctccatcccaatgaaaaacmttattattattatttttgttttgagacagggccaggctggagtgcagtggctcaatcatgactcactgcaacctcgacctcccaggctccagtgatccaccagcctcagcctcccaagtagctgggactacaggcatgcactaccacaccccgctaatttttcttttttcttttttttttgaagagattgtggggagtatctcactgggagctgcagacaaagctgttcctatctggccatctttgatccagccatggtgggagtctcactatgttgcccaggctggtcttgaactcctg

SEQ ID NO: 109810 - DNA, 601 bp, Human
gaagaagaagaaagcatattgtgtctcattttaaactgctagtagggcagaactgagatttgaatccagagtctgtgagagtccaagtcttgtgcgcttagttcctatgccacagtatgccccagatcttataattttacaaagaaccggttttagttgttttaaaaaaacagaatttgtcatatgatgaaaatggaatttcaaaccacagggggaagggtagattattccataaatagcattttagactactaactggttaactgtttcaaaaaatgaaaatgagttacatctcacaacrtaccctagaaaaattatagataaaatatttcaacataatatatgagatcactaaagaattacaagaaaaaaagtaagaaaatattggcatatcttggaataagaaaaggttttcctaaatatataagtaaaggtagaacactaatggggaaagatgcatagtttctgctacataaaaataaaaaccttaggtatgtcaaaataccataaacaaaacagtaaaagataaaaaataaatgggggaaaatacttgcaatgtatgacagaaaaaggattactattcttctcatataaagtgtta

SEQ ID NO: 109811 - DNA, 601 bp, Human
atattccataaacagattccaatacttaagaatttagcatatgaaaataaaccaggcacagaaagataaacttcacatgttctcacttattcatggcagctgaaaatgaaaacaattgaactcatggagacagagtcgaatgatggttaccagaggctagaaagggtagtgggtggtgtgggagtggaggtggttaaagcgtacaaaaaatagttagaaagaataagatctagtatttgatagcagaacagaggactatagtcaataataatttaattttatattttaaaatagctaaaagagtataattggattgtttgtatcacaagggataaatgcttgaggtcacagatgctccatttaccttgatgtgtttattacacattgcatgcctatatataaaaatatctcaggtaccctataaatatatatacctactatgtacccacaagaattaaaaattgtaaaaatgttggaaggagaccaaggagatgaaggacacgaaggagacgaaggagatgaagaagacaaagaagacgaagatgaagacgaagaaaaagaagaagaagaagaagaggaagaagaagaaagcatattgtgt

SEQ ID NO: 109812 - DNA, 601 bp, Human
gcctgggtaacaagagtgaaactccacctaaaaaaaataaaaagaaaacttaaaaataaaagaagggttttttccctctaaatatcatcaagaaaaacaaactttaaaatatgtcttatcttgggggccttgatacttactttatttcacatttgttaaagtcatattactaggcctggcatggtggctcatgcccgtaatcccagcactttgggaggctgaggcaggtggatctcttgagtccaggagtttgagaccagcctggccaacatggcaaaaccccatctctactaaagaatayaaaaattagctgggcatggtacacagctgtaatcccagctacttgggaggctgaggcacgagaattgcttgaactcaggaggcagaggttgcagtgagctgagattgcgccacttcaccctagcctgggcgacagagcgagactctgtctcaaaaaaaaaaaaaagaaaaaaaaagactacattaactggggccacagatacaaaaaatgtttctttaattaaaaggagttcatttataaatctatgctaaaattttagaaatttgagttgaatagattgtgaggaaaatatgtaattac

SEQ ID NO: 109813 - DNA, 601 bp, Human
tagccagttaatctcctatgcctcttggaagtacagtaattacaaagagaatgcctcagacctggcaagagatgatgaaaacgagtaaaggtatatctatcctctcagcgcctaggagaattgtttactgacctcattcaaactcagactaaagcccctaaggaacccaagctgaagatacggtctcattgtaagaatctaatattttaacctagaagtgctgattttaaaaacacagcagaaaataaacaaaatcaaccaaccaacaataaattctctcatataagcattggttgtgcayctaatggacacaatggtaaatttggaggtttttaaggtgtatttggaggttttcaagctttttaaagtttaacaaagcatcaagatgctgctcagcagcctcagctacaaattacaatgtcatatactctccaaatcagaagtggcattgctataacaactgtggtatatgcacgtatgcagacaaactaaggttatttacctggtcttatgggaacactgttacttatgaaacttttccttcaattttatttaaaagaagggtatttgcactttgggaggccgaggtgggcagatcatt

SEQ ID NO: 109814 - DNA, 601 bp, Human
acagcacgcagaccggcctgatgatgcgatcctccactgcaaaacttaaaacccagaaaccatcccgaggtgagaagggttccagccaaaagtttccaactgcgctcggtgacaaataagatggacaggttatggccaccataattcatttggcaattcctcagggctgctgccatggcggaagttacagatcttaagctctgtcaacccccccaaaaaatatatatcataaatttgagttttccttgttagttgctaagaactgggagagggaagggaggaaagtctgtaattgcaaacmccttgtttatcagcttcagccacttttgtgtgaccacattacctgaactattagccagttaatctcctatgcctcttggaagtacagtaattacaaagagaatgcctcagacctggcaagagatgatgaaaacgagtaaaggtatatctatcctctcagcgcctaggagaattgtttactgacctcattcaaactcagactaaagcccctaaggaacccaagctgaagatacggtctcattgtaagaatctaatattttaacctagaagtgctgattttaaaaacacagcagaaaataaa

SEQ ID NO: 109815 - DNA, 601 bp, Human
acaactcacataaatttaaaaggcaagatgacaaaatattttcagtgtgtatttttaaaaactgcttacaaatcaataataaaatcactaacctacccaaaacagggcctaaggatacaaacaggtaactcacaagaaaataaatttaaatactcaaccatgaagcagcattcaatcttactgaaaaccaaagaaatacaaattaaaatgagataccattttgccaacagaattagcaaagtctagagaatgaaaatattcacaaccattcacacataaacaatagaagtataaacgtgcrcagcttttctgttgtcaaaatatattaagagacaaaaaaagtgtgaaacttttgacctagtgatcaatttctcatgattcatccatagaaaataattttaaaatgctgataataactcagtggcaagaattttcatttcaggtttgaatatttaaaagtttaaagcaatctatatctccatcaatagcgatggattaataagtgataagagttgtataacagaatatatcctagccattaaaaattaatagtttatagatatatttatatgtttgccacagaaatattttccccatatac

SEQ ID NO: 109816 - DNA, 601 bp, Human
tacaggcacctgccactatgcccagctaatttttatatttttagtagagttggggtttcaacatgttggccaggctggtcttgaactcctgacctcaagtgatctgcccgcctcggcctcccaaagtgctgggattacaggtatgagacaccacagccagacaaccttgatatttcaatcttgcatcctattcattaacacatctaagtttgttttaatatagaaaacaatgttatgacttgccacttaagttcctttttcattctctagttgttcccgtgccaggtgtggtctgtggttycacatatgccatggcatactctacactagtactcccatttgagaaggggacatgaaaatagacagtctcagttcaccagaatgtggaggattgcaggcctgcctcatgacccggcccaattcttataaaacactaagttccagaaacaataggagagaggataagcaggttcaccatgcctttcagtacagtaagacccagtgcccaccagtctctggccaagtgagagaatggccagagaacagagagagaaacgtggtaagtaatccttcccttcaacatcacctaggtaggagggaa

SEQ ID NO: 109817 - DNA, 601 bp, Human
catcaaaacccccgtaaaatggcagagagagggaactcatacctatccctctagtctgggaacacagcctgaagcaatccaatggaagaaaaaaaaaatcacaatttacataaagccttatcttttatcctaaaaattaactttgatatttttgtttgtttgtttgaggtggagtctcactctgtcgcccaggctggagtgaagtggcacaatctcagcacactgcaacctccgcctcctaggttcaagcgattctcctgtctcagcttctcaagtagctgggattacaggcacctgccaytatgcccagctaatttttatatttttagtagagttggggtttcaacatgttggccaggctggtcttgaactcctgacctcaagtgatctgcccgcctcggcctcccaaagtgctgggattacaggtatgagacaccacagccagacaaccttgatatttcaatcttgcatcctattcattaacacatctaagtttgttttaatatagaaaacaatgttatgacttgccacttaagttcctttttcattctctagttgttcccgtgccaggtgtggtctgtggttccacatatgccatggc

SEQ ID NO: 109818 - DNA, 601 bp, Human
aggtatgcctatacttctcaaacttttccatcaaaacccccgtaaaatggcagagagagggaactcatacctatccctctagtctgggaacacagcctgaagcaatccaatggaagaaaaaaaaaatcacaatttacataaagccttatcttttatcctaaaaattaactttgatatttttgtttgtttgtttgaggtggagtctcactctgtcgcccaggctggagtgaagtggcacaatctcagcacactgcaacctccgcctcctaggttcaagcgattctcctgtctcagcttctcragtagctgggattacaggcacctgccactatgcccagctaatttttatatttttagtagagttggggtttcaacatgttggccaggctggtcttgaactcctgacctcaagtgatctgcccgcctcggcctcccaaagtgctgggattacaggtatgagacaccacagccagacaaccttgatatttcaatcttgcatcctattcattaacacatctaagtttgttttaatatagaaaacaatgttatgacttgccacttaagttcctttttcattctctagttgttcccgtgccaggtg

SEQ ID NO: 109819 - DNA, 601 bp, Human
ttaagaaattgctccagttaccctaaccttcagcaaccacaaccctgatcagtcagcagccaacgacatcaaggtgagatccttcaccaacaaagattatgatttgctgaaggcttagataattgttagcattttaaacaatacagtatttttaattaaggtatgtaatttgtttaggcataatgctattgcacacttaatagaacacagtatagtgtaaacataacttttatatgcaccgggaaaccaaaaagttcatgtgactcactttattgtgatatctgctttattgtggtggccmggagctgggcctgctatatctctgaggtatgcctatacttctcaaacttttccatcaaaacccccgtaaaatggcagagagagggaactcatacctatccctctagtctgggaacacagcctgaagcaatccaatggaagaaaaaaaaaatcacaatttacataaagccttatcttttatcctaaaaattaactttgatatttttgtttgtttgtttgaggtggagtctcactctgtcgcccaggctggagtgaagtggcacaatctcagcacactgcaacctccgcctcctaggttcaa

SEQ ID NO: 109820 - DNA, 601 bp, Human
tggaatattttaagcccactgttgagatctactgctcagaaaaaaaaagcatttctttcaaaatgttactattcattgacaatgcacctgggtcgcccaagagctctgatggagctgtgtaaggagcttaaagttgtttccatgactgctaacacagcaaccactatgcggcccatgctcattaaagagcaatttcaaatttcaagtcttaagacctacattttataatgctattgctgccacagatttgtgattctgctgatgggtctgggtaaagtaaattaaaaatcttgtggaaatrattcaccattctagatgacattaagaacatttgtaattcatgggaataggtcaaaatatcaacattaataggagtttggaagaagttgattccaaccctgatgactgactttgaggggtttgagacttcaatggaggaagcaactacagatgtggtgggaatagcaagagaactggaattagaagtaaagcccgaagatgagactgaattgctgcaatttcaataaaatttgaacagatgtagagttatttcttctggatgaacaaagaaagtggtttcctgagatggaatctactcctg

SEQ ID NO: 109821 - DNA, 601 bp, Human
ttttgaagtgaaaggaagagtggcatgtctctcactttaaatcaaaagctagaaatgattgcacttagtgaagtctgcatgttgtaagcagaaataggccaaaagctaggcttcttgctccaaacaattagctaacttgtgaatgcgaagggaaagttcttggagaaaattaaaagtgctactccagtgaatacacaaatgataagagagcaaaatagccttatggttgttatggagaaagtttcagtggtctggaaagaagatcaaaccagctaaaacttgcccttaaaccaaagcctamtccagagtaagcccctagttctttgattctgagagaggtgaagaagctgcagaagaaagttggaagctagcagaggctggttcaagaggtttaaggaaagatgccctctccataacatgacagtgcacagcgaagcagcaagtgctgacgtaggagctgcagcaagttatccagaagatctagctaagaccattgatgaaggtggctactctgcacaataaattttcagtgcagatgaaacagccttcaattagaagatgatgccatctaggatgtttgtagctatggagaagtcaatgc

SEQ ID NO: 109822 - DNA, 601 bp, Human
accacacccgtagaagacagcaaacttagctgatcaatggagcagtcagaacacacatttatcagtcatttctccatctctctccttctcctcaggcctccctattccctgagacacaataatattaaaactaggccaatcaataaacctacaatggcctctcagttttgaagtgaaaggaagagtggcatgtctctcactttaaatcaaaagctagaaatgattgcacttagtgaagtctgcatgttgtaagcagaaataggccaaaagctaggcttcttgctccaaacaattagctaasttgtgaatgcgaagggaaagttcttggagaaaattaaaagtgctactccagtgaatacacaaatgataagagagcaaaatagccttatggttgttatggagaaagtttcagtggtctggaaagaagatcaaaccagctaaaacttgcccttaaaccaaagcctactccagagtaagcccctagttctttgattctgagagaggtgaagaagctgcagaagaaagttggaagctagcagaggctggttcaagaggtttaaggaaagatgccctctccataacatgacagtgcacagcgaag

SEQ ID NO: 109823 - DNA, 601 bp, Human
cataaaatataccttaacacatttaaagaaatagaaatcatacaatgcatgctctcagaccacgatggaaataaactagaaatcaataacagaaagagagctgaaaaatcccccagtactggagaagaaacaacacacttctaaacaacacatgggtcaaaaaggaaactcaagagcagttaaaaatattttgaactaaatgaaaagaaaaatacaacttatcaaaatgtgtgggatgcagcaaaagcagtgcttagaggaagatttatagcacttactgaatatattacaaagaagagayatctaaaatcaatacgctaagcttccactttaggaaactagaaagagaagagccaattaagtgcaaagtaaacagaagaaagatgaagtgattcattttagttactgttttgctctgtgctgagtatctgaaaattagtcatccacatgggatagcacaggcatatttcatttgatagaactttgctttattgtgcctcacagatactgtggttttttgttttgttttcttttttctttttctttttcttttttttttttttacaaatttaaagtttgtggcatctatccaacagcaagc

SEQ ID NO: 109824 - DNA, 601 bp, Human
gaagaaagcacccttgccctgtcataccaagaaggtgcccaaggtgtccactgtgtacctcatgccatattgtaaaaaactgtgtgtctgctcctgccatgatctataaaaaattcaggagctgagggcaagggctaggtcatggttctctttgcattaataacaccagacccagcagagtatctaatatacagttaaatgtttactaaagtgaacaatccacaaaataaatcaccaaaataaatatgtagatacatagcatctcccacttcgtgctgatcttagttttgttattcattcmattgcctctataagcattaagtaaagaaagtagctacctcaggtgaattaagcaccaaatgttacattaggcctagttcacaaaaatcacaattactgtttgatcacttagatatatcctacatgggatgatagcatagatattccacatgcctctgctctcactattaaaagaaaaatgccctgctttttatctgaaatccaaaacatccaatttagttgaaaggactgttttgtttgtttttccctctgttgcaccgtatgggaaagagacacttcacaagaaaataaggtcgtatta

SEQ ID NO: 109825 - DNA, 601 bp, Human
accatatctcataagattgctaggtgggttaaaggagtttgtacaatatgtaaggtactggaagaactatgagccaggcaaccttctaactattggccattatcttttagaagaaagcacccttgccctgtcataccaagaaggtgcccaaggtgtccactgtgtacctcatgccatattgtaaaaaactgtgtgtctgctcctgccatgatctataaaaaattcaggagctgagggcaagggctaggtcatggttctctttgcattaataacaccagacccagcagagtatctaatatayagttaaatgtttactaaagtgaacaatccacaaaataaatcaccaaaataaatatgtagatacatagcatctcccacttcgtgctgatcttagttttgttattcattccattgcctctataagcattaagtaaagaaagtagctacctcaggtgaattaagcaccaaatgttacattaggcctagttcacaaaaatcacaattactgtttgatcacttagatatatcctacatgggatgatagcatagatattccacatgcctctgctctcactattaaaagaaaaatgccctgcttttt

SEQ ID NO: 109826 - DNA, 601 bp, Human
gaatggaagcagcatggctaggatggcaggcaagggtcctgggctcaaatccttattctgctacttgctggcagagggaacttgggcaagtcacctaacaattttgtgcctcagttcagttttttttttaaatctctaaaatggagataccatatctcataagattgctaggtgggttaaaggagtttgtacaatatgtaaggtactggaagaactatgagccaggcaaccttctaactattggccattatcttttagaagaaagcacccttgccctgtcataccaagaaggtgcccaaggtgtccactgtgtacctcatgccatattgtaaaaaactgtgtgtctgctcctgccatgatctataaaaaattcaggagctgagggcaagggctaggtcatggttctctttgcattaataacaccagacccagcagagtatctaatatacagttaaatgtttactaaagtgaacaatccacaaaataaatcaccaaaataaatatgtagatacatagcatctcccacttcgtgctgatcttagttttgttattcattccattgcctctataagcattaagtaaagaaagtagctacctcagg

SEQ ID NO: 109827 - DNA, 601 bp, Human
tgacaaccacctatgtgggaattactctcatcatggtaaatatgtcggagagtggctgtctgaaagtctggctgcatttagcccaagtctgttacacgatggtgctctcacacacaaacaactccaggcacctcagcatccacagccttccacaggctgatatggagagtcagaatggaagcagcatggctaggatggcaggcaagggtcctgggctcaaatccttattctgctacttgctggcagagggaacttgggcaagtcacctaacaattttgtgcctcagttcagttttttttttaaatctctaaaatggagataccatatctcataagattgctaggtgggttaaaggagtttgtacaatatgtaaggtactggaagaactatgagccaggcaaccttctaactattggccattatcttttagaagaaagcacccttgccctgtcataccaagaaggtgcccaaggtgtccactgtgtacctcatgccatattgtaaaaaactgtgtgtctgctcctgccatgatctataaaaaattcaggagctgagggcaagggctaggtcatggttctctttgcattaataacaccagacc

SEQ ID NO: 109828 - DNA, 601 bp, Human
tttaaataagagacagatgtttaaaatccacattttttttttccagaagctcattcattgcaaagaagtctgtctcactggttgttttgtgtgttagcaatacactgtttgccaatgcatacaactctctttatctaaaggaaaaaaaaaaatacacctttaacaaacatttgtagaatgcacacactgtggccctgctctaacacttggggatgcagacccgaaccagatactgaagtgtccactattcggaggtacaaagaccacccaaaaatgctgccagctgaatgaagttcttacrtacaagtaaaagagcaaatgctatttttgttctcatctgctgttccttcaagtcagtggaaatgcctgtgctttttgtaggttcatgtcatcgctaaagttggtggggacaagtctgaaagtaagccagctattagcaactgtgctctcgcaggttctatctttagttggactgtgaagaactaaaagtgttaaagtaaaagtgttaaagactctgcagccttctgccattgtttgggggaaatgttggtggggaggtgtagagggggatgaggaggaggtgaagccagtgccccagggg

SEQ ID NO: 109829 - DNA, 601 bp, Human
caactcttcctccccaacagaccagcaggataggctgctggataggctgctggtcttgttaactgtgttaactatgttaactgttaactgttaacaaattaactgtgttaacacagttaacaagtagtcaacttttgtcgaggagaaggggtgggccctgcagtagatgtaatctgcttcaagtaattcagagatgtgaatgatttggaattacaagcaaattaaggggaaactctcctaaaggaagaccataaggtcctttaaataagagacagatgtttaaaatccacattttttttttccagaagctcattcattgcaaagaagtctgtctcactggttgttttgtgtgttagcaatacactgtttgccaatgcatacaactctctttatctaaaggaaaaaaaaaaatacacctttaacaaacatttgtagaatgcacacactgtggccctgctctaacacttggggatgcagacccgaaccagatactgaagtgtccactattcggaggtacaaagaccacccaaaaatgctgccagctgaatgaagttcttacatacaagtaaaagagcaaatgctatttttgttctcatctgct

SEQ ID NO: 109830 - DNA, 601 bp, Human
cccaacacctgctgaatgttacaacggaagcacatcaatcaggtgaggaagaaaaattttagattgtgggtcacaaagattagctgacccagatgaagatcaaggaagcctctagtgcaatgtggacaaaaactgcagaaaataccacaagggcctctggtctgagcagcagaatttttaaaagaagctaatgtctgtgtgtttaaatctcaggagataggttagtttcttggcttctgaaaacatcaactcttcctccccaacagaccagcaggataggctgctggataggctgctggtcttgttaactgtgttaactatgttaactgttaactgttaacaaattaactgtgttaacacagttaacaagtagtcaacttttgtcgaggagaaggggtgggccctgcagtagatgtaatctgcttcaagtaattcagagatgtgaatgatttggaattacaagcaaattaaggggaaactctcctaaaggaagaccataaggtcctttaaataagagacagatgtttaaaatccacattttttttttccagaagctcattcattgcaaagaagtctgtctcactggttgttttgtgtgtta

SEQ ID NO: 109831 - DNA, 601 bp, Human
cccccaacacctgctgaatgttacaacggaagcacatcaatcaggtgaggaagaaaaattttagattgtgggtcacaaagattagctgacccagatgaagatcaaggaagcctctagtgcaatgtggacaaaaactgcagaaaataccacaagggcctctggtctgagcagcagaatttttaaaagaagctaatgtctgtgtgtttaaatctcaggagataggttagtttcttggcttctgaaaacatcaactcttcctccccaacagaccagcaggataggctgctggataggctgctggtcttgttaactgtgttaactatgttaactgttaactgttaacaaattaactgtgttaacacagttaacaagtagtcaacttttgtcgaggagaaggggtgggccctgcagtagatgtaatctgcttcaagtaattcagagatgtgaatgatttggaattacaagcaaattaaggggaaactctcctaaaggaagaccataaggtcctttaaataagagacagatgtttaaaatccacattttttttttccagaagctcattcattgcaaagaagtctgtctcactggttgttttgtgtgt

SEQ ID NO: 109832 - DNA, 601 bp, Human
cctacccccaccccccaacacctgctgaatgttacaacggaagcacatcaatcaggtgaggaagaaaaattttagattgtgggtcacaaagattagctgacccagatgaagatcaaggaagcctctagtgcaatgtggacaaaaactgcagaaaataccacaagggcctctggtctgagcagcagaatttttaaaagaagctaatgtctgtgtgtttaaatctcaggagataggttagtttcttggcttctgaaaacatcaactcttcctccccaacagaccagcaggataggctgctggataggctgctggtcttgttaactgtgttaactatgttaactgttaactgttaacaaattaactgtgttaacacagttaacaagtagtcaacttttgtcgaggagaaggggtgggccctgcagtagatgtaatctgcttcaagtaattcagagatgtgaatgatttggaattacaagcaaattaaggggaaactctcctaaaggaagaccataaggtcctttaaataagagacagatgtttaaaatccacattttttttttccagaagctcattcattgcaaagaagtctgtctcactggtt

SEQ ID NO: 109833 - DNA, 601 bp, Human
ggtttcaccatattgcctggtcttgaactctgggctcaagtgatccgcccatctcagcctcccaaagtgctgggattacaggcgtgagccgccacgcccagcggtttattttctttactgctggaaaacagcgtcttttccttgttatcactcactggttctgtgcagtttggactccttgtgttctgaggtacaagctgaaaagatgaagaaatttcgacccaaagggactgctctgttataaaatgttaaaccttttccccctacccccaccccccaacacctgctgaatgttacaackgaagcacatcaatcaggtgaggaagaaaaattttagattgtgggtcacaaagattagctgacccagatgaagatcaaggaagcctctagtgcaatgtggacaaaaactgcagaaaataccacaagggcctctggtctgagcagcagaatttttaaaagaagctaatgtctgtgtgtttaaatctcaggagataggttagtttcttggcttctgaaaacatcaactcttcctccccaacagaccagcaggataggctgctggataggctgctggtcttgttaactgtgttaactatgttaa

SEQ ID NO: 109834 - DNA, 601 bp, Human
caagggaagatgcatatcatatcttatttactgggataaaaaacatacactaggctcctacgcctgtggttcatttctcaaggctcgggactcagagaaactgcccatcctctcttagcccatccccatccgtggcctgtgaacagtcactgctagagcagaaccctctccctgctttaggcagttcctcccccagaggagccaaaaacagccagaaagtgctgttccctgattgtaggtggtgaagcacatctctgaataattaagcaagtgtatattctttttctttttttttttttttaacagggcctcactctgttgcctaggctggagtgcagtggcacaatcactgctcactgcagcctcgacctccctgggctcaggtgactctctcacctcagtctcccaagtagctggggtgacagatgcacacaaccacgcccagctaatttttgtatttttttttttcatagagacagggtttcaccatattgcctggtcttgaactctgggctcaagtgatccgcccatctcagcctcccaaagtgctgggattacaggcgtgagccgccacgcccagcggtttattttctttactgct

SEQ ID NO: 109835 - DNA, 601 bp, Human
ttgctctgccccagtggagtcagatgacatcacagcccccagagagcaggcacgcttggctttgcctccagcctctggggccttggctcagggaagaggagcatgcacacaaagatagggattccctttccaacacaatcctcttcctcattcacaagggcggctggtgccggccttgtttaaagtatattcaagggaagatgcatatcatatcttatttactgggataaaaaacatacactaggctcctacgcctgtggttcatttctcaaggctcgggactcagagaaactgcccatcytctcttagcccatccccatccgtggcctgtgaacagtcactgctagagcagaaccctctccctgctttaggcagttcctcccccagaggagccaaaaacagccagaaagtgctgttccctgattgtaggtggtgaagcacatctctgaataattaagcaagtgtatattctttttctttttttttttttttaacagggcctcactctgttgcctaggctggagtgcagtggcacaatcactgctcactgcagcctcgacctccctgggctcaggtgactctctcacctcagtctcccaag

SEQ ID NO: 109836 - DNA, 601 bp, Human
gaatatcaacagctattcataccaatctatctacctccttaaagcaaatggtttttatataaacaaagttccagattttcagaaaatttctgcctgtgaagcctctgaaaatagctcatcaggtgataaacagaccagttgaaagcgacgaaaccatttatgggagaagctaaaatagagaaaacccaaaccagcacatagctagggagtttagaacaatccagattttgttcttgctttctaattatcttattgggaacctaaacatgagttttcccaaagttaatgactttatcttcamggccaagcagggaggccattcatctacttttgctctgccccagtggagtcagatgacatcacagcccccagagagcaggcacgcttggctttgcctccagcctctggggccttggctcagggaagaggagcatgcacacaaagatagggattccctttccaacacaatcctcttcctcattcacaagggcggctggtgccggccttgtttaaagtatattcaagggaagatgcatatcatatcttatttactgggataaaaaacatacactaggctcctacgcctgtggttcatttctca

SEQ ID NO: 109837 - DNA, 601 bp, Human
aatatctgctgctatgtcaaggatgtgggtggaaggaaaaaaagagggaagtgaagagagactcttaagggtaaagtatgtcatcaatgaaaacattgatcaacccttgaatgtcactgcagagaatgaacacaagggcaagaggaaaggtgaaataagaagtccatgaagtaggaaatgaaacctctacttgaaacacacccacactctcacatactcacacaaaattattgccaatggagcaagaggtcatccagagacactcgttggtattgactacaaaatgaaagtggattctttyccccccagtataagggaggcagtacacaagaatatcaacagctattcataccaatctatctacctccttaaagcaaatggtttttatataaacaaagttccagattttcagaaaatttctgcctgtgaagcctctgaaaatagctcatcaggtgataaacagaccagttgaaagcgacgaaaccatttatgggagaagctaaaatagagaaaacccaaaccagcacatagctagggagtttagaacaatccagattttgttcttgctttctaattatcttattgggaacctaaacatgag

SEQ ID NO: 109838 - DNA, 601 bp, Human
ccaccatctcaagcaagaatgcaaatacactgcgcttgtatcaccacctccatacagaacccacagcagacattactaattgatcacagcactacttcctgctgaactcagatgcagcttccaagtccttctaaacagccacttccaaatgatcacagttgtcacagaagatggaatatttcccacttgcttcaaacaatatctgctgctatgtcaaggatgtgggtggaaggaaaaaaagagggaagtgaagagagactcttaagggtaaagtatgtcatcaatgaaaacattgatcaamccttgaatgtcactgcagagaatgaacacaagggcaagaggaaaggtgaaataagaagtccatgaagtaggaaatgaaacctctacttgaaacacacccacactctcacatactcacacaaaattattgccaatggagcaagaggtcatccagagacactcgttggtattgactacaaaatgaaagtggattcttttccccccagtataagggaggcagtacacaagaatatcaacagctattcataccaatctatctacctccttaaagcaaatggtttttatataaacaaagttccag

SEQ ID NO: 109839 - DNA, 601 bp, Human
caagtactgcgtttaaaaaaataaaaagccatgagatataagcaacataagtggggacaccttcaactaattcttagaaacacatattttcctcattcttaaggaaaagagtccaccatctcaagcaagaatgcaaatacactgcgcttgtatcaccacctccatacagaacccacagcagacattactaattgatcacagcactacttcctgctgaactcagatgcagcttccaagtccttctaaacagccacttccaaatgatcacagttgtcacagaagatggaatatttcccacttrcttcaaacaatatctgctgctatgtcaaggatgtgggtggaaggaaaaaaagagggaagtgaagagagactcttaagggtaaagtatgtcatcaatgaaaacattgatcaacccttgaatgtcactgcagagaatgaacacaagggcaagaggaaaggtgaaataagaagtccatgaagtaggaaatgaaacctctacttgaaacacacccacactctcacatactcacacaaaattattgccaatggagcaagaggtcatccagagacactcgttggtattgactacaaaatgaaagtg

SEQ ID NO: 109840 - DNA, 601 bp, Human
tccttctgactaagagccagacagaatactcatgtgataactcaacaagggcccaaagttgacagacctgaacgtccacacagagtatggtcagtcccattagctgtgtttttttgcctcttacttcgaggggaggcagacaccccagtgtgtcctgaagggtttcaaacataccagtccacaccctcatgggctctttgccttgctgggaagccaatcctgtctaacaggactccgtagtgattctccatggctatggtactagatttatggaacaccttttaaagcctcaagtactgcrtttaaaaaaataaaaagccatgagatataagcaacataagtggggacaccttcaactaattcttagaaacacatattttcctcattcttaaggaaaagagtccaccatctcaagcaagaatgcaaatacactgcgcttgtatcaccacctccatacagaacccacagcagacattactaattgatcacagcactacttcctgctgaactcagatgcagcttccaagtccttctaaacagccacttccaaatgatcacagttgtcacagaagatggaatatttcccacttgcttcaaacaa

SEQ ID NO: 109841 - DNA, 601 bp, Human
accaaagcaaacaggctcggtgctggcctggtaccagagcacgtgcaagctgcaaatgcccagcccaagactgtgctctcctctaggtttctatgccctcaatgtaccacctctgcagcaatccctgaggccccaggtctccactttcctttatatctccacactgcacctgtgggagaaagtttaacagagatagccacctccactgaagtgggtgtgatgatgctgagctggctgctcgggcaggagcactgagacataccctatatcctccagggaaaggagtcctcccctctaagaraaggtagaaggcagtgttccttctgactaagagccagacagaatactcatgtgataactcaacaagggcccaaagttgacagacctgaacgtccacacagagtatggtcagtcccattagctgtgtttttttgcctcttacttcgaggggaggcagacaccccagtgtgtcctgaagggtttcaaacataccagtccacaccctcatgggctctttgccttgctgggaagccaatcctgtctaacaggactccgtagtgattctccatggctatggtactagatttatggaacacctttt

SEQ ID NO: 109842 - DNA, 601 bp, Human
tatgcccaaggctttctggaagctcacacagtgtctcatctagctcagcacagacctcagcaataccacctgcaggcaggtctgacagcaacccaagctcagaggtgaagggtccacaaggaccaaagcaaacaggctcggtgctggcctggtaccagagcacgtgcaagctgcaaatgcccagcccaagactgtgctctcctctaggtttctatgccctcaatgtaccacctctgcagcaatccctgaggccccaggtctccactttcctttatatctccacactgcacctgtgggagaragtttaacagagatagccacctccactgaagtgggtgtgatgatgctgagctggctgctcgggcaggagcactgagacataccctatatcctccagggaaaggagtcctcccctctaagaaaaggtagaaggcagtgttccttctgactaagagccagacagaatactcatgtgataactcaacaagggcccaaagttgacagacctgaacgtccacacagagtatggtcagtcccattagctgtgtttttttgcctcttacttcgaggggaggcagacaccccagtgtgtcctgaaggg

SEQ ID NO: 109843 - DNA, 601 bp, Human
aatcttatcttggtctggatagtttaaaacttctctgaagcactttcaagttcccttccagggtctgcccaccatccctgaaatattaatacttcaggatgctgccacctggaatgaaggctttgtccttggtcattcacaggcagatcccagggatctccatctaaggcagtggtgtccaatcttttggcttctctgggccacattggaagaagaagaataagaacacacataaaatacactaacaatagctgataagccaaaaataaaatcacaaaaaatcttgtaatgttttaagaaagtttatgaatttgtgttgggccacattcaaagccctcctgggccacaggcggcccatgggccacaggttggacaacctttgtctaaggtaaccccaggtttacttataagacatgcattaaatacccaggagaaattagcctgcagatgacaacggctatgcccaaggctttctggaagctcacacagtgtctcatctagctcagcacagacctcagcaataccacctgcaggcaggtctgacagcaacccaagctcagaggtgaagggtccacaaggaccaaagcaaacaggctcggtg

SEQ ID NO: 109844 - DNA, 601 bp, Human
tgagcagcagcactttataagcaccttgtggaatctaggtgatttccatctggagtaaggagacactgttccaacctttctgtgatgacagttctccaacaaataacacagacactggagcatttttcatcacggatgcgtgtaaataaatagtcatcatggatgtcttttctgaatagatgacatctgacacaggcctgaataaaacgagggagccagatctggaaatatctggaggaagagcacgtgcaaaggtcctgaggagtgaatccccccgccccagtcctagaaaagagcaggyggctgctgtggctgggggagggcacaccgggaaatgaggctggagagatgctggggcagacgcctccagtggggagcactaggggcctggactttattccaagctgggcagcccctggaagactttgagcagaggagcaataacatctgatgcatgtgacagaagagacactcagggtcctggggacagaagaggccttaaggaggcacaagtgggaactggaagaatggggtgagatcactgcagaagttcaggcaaaggtcacagtggggtggccactgggacatgagagttgtcaga

SEQ ID NO: 109845 - DNA, 601 bp, Human
caacacttggactctcctatttgagcagcagcactttataagcaccttgtggaatctaggtgatttccatctggagtaaggagacactgttccaacctttctgtgatgacagttctccaacaaataacacagacactggagcatttttcatcacggatgcgtgtaaataaatagtcatcatggatgtcttttctgaatagatgacatctgacacaggcctgaataaaacgagggagccagatctggaaatatctggaggaagagcacgtgcaaaggtcctgaggagtgaatccccccgccmcagtcctagaaaagagcaggtggctgctgtggctgggggagggcacaccgggaaatgaggctggagagatgctggggcagacgcctccagtggggagcactaggggcctggactttattccaagctgggcagcccctggaagactttgagcagaggagcaataacatctgatgcatgtgacagaagagacactcagggtcctggggacagaagaggccttaaggaggcacaagtgggaactggaagaatggggtgagatcactgcagaagttcaggcaaaggtcacagtggggtggccac

SEQ ID NO: 109846 - DNA, 601 bp, Human
agacaacacttggactctcctatttgagcagcagcactttataagcaccttgtggaatctaggtgatttccatctggagtaaggagacactgttccaacctttctgtgatgacagttctccaacaaataacacagacactggagcatttttcatcacggatgcgtgtaaataaatagtcatcatggatgtcttttctgaatagatgacatctgacacaggcctgaataaaacgagggagccagatctggaaatatctggaggaagagcacgtgcaaaggtcctgaggagtgaatccccccsccccagtcctagaaaagagcaggtggctgctgtggctgggggagggcacaccgggaaatgaggctggagagatgctggggcagacgcctccagtggggagcactaggggcctggactttattccaagctgggcagcccctggaagactttgagcagaggagcaataacatctgatgcatgtgacagaagagacactcagggtcctggggacagaagaggccttaaggaggcacaagtgggaactggaagaatggggtgagatcactgcagaagttcaggcaaaggtcacagtggggtggc

SEQ ID NO: 109847 - DNA, 601 bp, Human
tggtggggttccaatgagactcggaagccccaagagggaagaaacacacggggatgatgcatttgactttcttttggtccactgccagattttaaggcccctaatgtatctccctcaggtcaatacatgttcttaccagccacgtgtagcaaagctgttcagttaatgccccaaatgcacttagttgtatgggcagaatctcatttattgactcgagacaaaccagtaaggaacaaggcatgccaaccccagagctgtggggcagagagcatcatgtatcttttagcagtgtcaatttaaracattttaaaggaaaacaaaaatcccggagaaaatgcaatagctctgctatgggaaaatgggagtgggatctcccctaccaaccctgctctagtccattttcccctttaacttttgctggggaaagggtggtgatgagaagcaaaaaggagggagagggaaaagaggaagttttctgctaggatggtttagttctagcaagaacagagaccagcaggaagactacagaaagaagaatgaaggtggcagcatttcacctttaagtcccatgtaagagtgcagtgagaaaagggtttcaggt

SEQ ID NO: 109848 - DNA, 601 bp, Human
ggccccatctcaacttccctggcctgtgatgtctcagaattaccatcctctgggcccaggtgagcagtggttctgctggtgtgcacctcgggccagcaaagttagactcttggtggctgaaatcaaaccaagcccatcccctcagctcagtcaaagccatgtgtgggcatcattcacacaagtggcttgaaagtagggtatgagcagggaggaggtaaaaacaagcaatccttgaactctgtcccatttcctccatgtgaatagcttggtgatgacaaactcatccctgcaccctggtgcrcaacaccctggacaccccggaaccaccctgcagaaggcattgtgaggctttgggtttgggccaatacaaataccagtgtgacttggcagaatctcagatcaatgcagcatcagcctggaagtaggggatgggggaaggggacaatgctgccccattgctaatccccactgtccaccttgggggctggccacaggacaccccttaggcatgctcacttgagttgataagggtggctgattaagaagcaagttcaatcaagaaggaaacaaatccccagaactacaggttttcaagagttaa

SEQ ID NO: 109849 - DNA, 601 bp, Human
ccggatttaagtctgctgaagtggcctgtcaagtggatcctgcattgtttggtcacccgatgagatgacccctgaaatattttattttcctacccttaactcattttgttggcttttcctgaaacttttataagaacacaaagacttccatccagtgaccccaaagaggcctggccatatcccaaggaggctaagacagaggagtgaacgctcattgtgaacgttcgttgtgaatgttgtgtcccagggctcttcaagcaaaggcaagacttgccacaaggagtttacaatccagatgatygaagcaaacacactcactggtgttcctgtatctctgatgctccctattacagccctttcttccacccaaatgtttctacctagtccgggtctcttacaaacactaactccttctcttctgcgtagaaaagcctccttactgcctgacgtcatttctaccagccttccaggtcgagctcaatccccaagtcctccacgatgccccctgaccactctggcaggcagagctccctgcctgcacctcctaatacccaccagcactgggctgggtataagatcaggtcactcacatggactagta

SEQ ID NO: 109850 - DNA, 601 bp, Human
aaatatataaagaaatgggccacacagaacccagggccagatagtataggttcatggcatcttcccttatgaattatatcccaacattcaaattttatttgcaagcatggcaggattttaactgcgtagcaaaaatcactaaattgtatgatttcatcaatatttttaaatccaagaggttgacagccaggtgaggatgctggcttcagggtaagaactgattaagaaggaaaaagggaaggccctgcagaggaggactatgagcaaggctggtaggatgagcgtaccatggactatccayaaactcattgggatattaaggtcaaaagtagccatgtggcatctccattggacagcagcaagttccaactagaaaaatctcgggaaatacttcatgattatgacatcacaggaaatgatccagcattacctgaaagctcataggaattttccatatccatctaaacatatctgacaatagcaaaaaacaaagtattcagaatgaatcttcaggatcagggaggcaagagagatgggcagatgggtgcctgcaccacaaccccctaccactttctagcctgtcacagcacagcagaaaggg

SEQ ID NO: 109851 - DNA, 601 bp, Human
gcctggtgaccacctcttctgtggacactcagctatagtgcctggagctgggaggagcatcctctggcccctgaccacctcagcagagtggaccatgtcctgctctggcctctgctggggctggggtttgctttcaggcccctatgtactccactgcatggatcagttgctccctctagaatatcaagagctctacctttcacctgtttgggatcctctaagccagacttcctgcatgaagggatgaagggtaagtttttgttttcagggggatgtgggaggatgaagaggctgcagcagktccttttggatgaaggatgttctggattcagacgaggtggtgaggaaaggcctttggatgaagaacacgctcagggcgggaggataggaattgtgctagagggcagggcagaagggagtgtgggtattcagagggcagcaggtttcccccttcctcccctaccattcttagacctggcaggtcctaaggaacaggaagtagttagtggtacgtagacggtgggaatcctgctgctcagggagaggtctgcaaaggctcccatgtaggcataaatatataaagaaatgggccacacagaac

SEQ ID NO: 109852 - DNA, 601 bp, Human
aaaccacgatgttccacagatgaaagacactggctttttattcataatttgagcaacacaagaagaataggtcctttctataccctcacggaaaacaacttcttggtgccctgggcttcactctgcaatcttgatccatgcctagcatcagctgaggccctgtgatgagcggcaaggcctctgctttgtcttcatcatgtggtgaacctaagaggaccctggagcaggaggacagggctcaggtctctcactttgcaggtggatgtgtaccactttttgggcatgacctagtcccaggccyagtgctaatgttctgcatgtgttctcttacttagtccttataacaactcatgacataggtgcctcccaaccttctggtccagctggtagaaatgcccagtcatagagatgaagaaactgaggcttagagaggttaagaaatttgcccaagctcctgcagccacattcaaactcaagtgtctccaactcccatgcacaagacagtgtctaattaccagaccacaccacagtccttctcaccatggccagttgtgacacaggtgtgtattcagcagtcacaaaccccaagttagtccaaaca

SEQ ID NO: 109853 - DNA, 601 bp, Human
aaggcatccccatccaagccgggaaaagtcagcagttgcccccttgaagctggggaacagtcatgttctgacttcgctggcactgccacaaaccatccttggctaaagtcagccagtgactcataatagtgttcaaggatgacaccggggatgctttgcatactctgaggggaagcgtgacttgcctgtcacaaactgccccgaactaaagaattatcttcatgccctgttcctgctccctatcctgtcagtcagggtgaacccagtcagcatggttcctgggctccatgttggcctctgyttaagcaaaacccagacaagaaagcaaacactgtacagctgaatccaggacaagacactgatgagcaccactgctccaggaagatgagggtgtgcaatgggggcctgctccccagccttggggcaaattacttcaccttctgttcctcacctgtgagctcgcagctgctaaactcacagaggtgttttgggaatgaattaaagtttgcaaaaccacgatgttccacagatgaaagacactggctttttattcataatttgagcaacacaagaagaataggtcctttctataccctcacgg

SEQ ID NO: 109854 - DNA, 601 bp, Human
tgtcttccctgtgcaattctttcttgctgtccaattgatgctaattttggaagcaaggctcccagggcccctctgtcacccacacaccagtgttaaaacaaggcatccccatccaagccgggaaaagtcagcagttgcccccttgaagctggggaacagtcatgttctgacttcgctggcactgccacaaaccatccttggctaaagtcagccagtgactcataatagtgttcaaggatgacaccggggatgctttgcatactctgaggggaagcgtgacttgcctgtcacaaactgccctgaactaaagaattatcttcatgccctgttcctgctccctatcctgtcagtcagggtgaacccagtcagcatggttcctgggctccatgttggcctctgtttaagcaaaacccagacaagaaagcaaacactgtacagctgaatccaggacaagacactgatgagcaccactgctccaggaagatgagggtgtgcaatgggggcctgctccccagccttggggcaaattacttcaccttctgttcctcacctgtgagctcgcagctgctaaactcacagaggtgttttgggaatgaattaa

SEQ ID NO: 109855 - DNA, 601 bp, Human
cacctacaagacgcaaatttaaagataaaactacaagatttttaagactgcaactgcagagtgttaaacctcaagctcagggcccttgtgagcatggggtcctgtgtgacctatacaggttgcatgcccataaaaccagccctgccaacagatgacctttatgtgccttcagattacagtactcgaggtttctggaaatggtagcaaccttccaatgaagaaggaacctcttctgagttatgcaatcagcatgagccacattagaatgacttcccaaaactgaaacgcaaaaagatgccasagttgctgtgccgaggggctgggcctctgacaggttagctcagaaagcaaatgaatcaagttagcacaggaaacaagcaaagttctgtctgttacaggatcgatgcagccccctactctgcaggctgtgagggttccttgccccttttcacttagggtgtagacacagaagtcctgactctcaaagaacaaaacacacttggaatagataaagcaatcatgctcccgatgttccttccaacctctgaaatgagaaacataagaacttcagactgcttttactggaggtctggcatggacc

SEQ ID NO: 109856 - DNA, 601 bp, Human
gggggagtcaagcagctcacccctctctagttgcccactgaagatgccatggagctgccagtccagaatggggacagctgccaccatgccgtaccctgagatgccatgtacttaaccccaggccctgccagggatagatcatggcaggagcaagaaaacctaggggaggcagggagatattaataagcaggaccacgggaacaaagcctctaagcccccagtgcatactgtattgtcccactggacttcacctacaagacgcaaatttaaagataaaactacaagatttttaagactgcarctgcagagtgttaaacctcaagctcagggcccttgtgagcatggggtcctgtgtgacctatacaggttgcatgcccataaaaccagccctgccaacagatgacctttatgtgccttcagattacagtactcgaggtttctggaaatggtagcaaccttccaatgaagaaggaacctcttctgagttatgcaatcagcatgagccacattagaatgacttcccaaaactgaaacgcaaaaagatgccacagttgctgtgccgaggggctgggcctctgacaggttagctcagaaagcaaat

SEQ ID NO: 109857 - DNA, 601 bp, Human
cattattgcacttatgtaacttaattacatattatgtaaattaatgaaatacctgtgcataagaaaagagctgttgtttctataagtagagagttttggaaaaatgaagacgaactgctgctaagttagggtggataagacaactataaaagactaggagggctgggcatggtggctcatgcctgtaaacccagcactttgggacgctgaggcgggtggatcatttgaggtcaggagtttgagaccagcctggcctacacggcgaaaccctgtctccactaaaaatacaaaaattagctgrgcgtggtagccggtgcctgtaatcccagctactggggaggctgaggcaggagaatcgcttgaatctgggaggcagaggttgcagtgagccaagattgcaccattgcacgctagcctgggtgacaagagcaaaactccatctcaaaacaaacaaacaaaaaactagggaggtgaagggggggaatgttataggtctagaaagatttatggcacttactctgcaagtgtctaagctcttatttatgaataaatcaaatctggaaattatagaagaagtgatatgggtgtaattcatgcaagt

SEQ ID NO: 109858 - DNA, 601 bp, Human
ctcttgttgacattggctacttttcactctactggataataacctaacatctgattgttctgtaaaacagatccctaagtacgatagttgggtcacagggcatatacaatttttaagttttcacttactaatactaaggaattcggttcgctattaatgttaagctatttctcaggaggttatgtccatattcacatccattagttttgtcatttgccttgcctcttttgaagatggtagatgcgctattaactgagctccacttaaaccaaggccctgatttacctaaccccatactctycatttctttgctaaagcatctagaccaatgccctcagcatgcaaaacctcagttggctactctagtttatcaacctatttctgttctcaacagttaggctatatatttaccaagaggccatttgcatttgttgccaaacctgtttatgtcagctgtactcattattgcacttatgtaacttaattacatattatgtaaattaatgaaatacctgtgcataagaaaagagctgttgtttctataagtagagagttttggaaaaatgaagacgaactgctgctaagttagggtggataagac

SEQ ID NO: 109859 - DNA, 601 bp, Human
tttcaccagaaagccaccgtgttcatcatttcatcacagtaaggccaatgagagagaagacgtttgaggtttgaggtggcccaagttctgaggtttttgacttttctttaccaaagtcctgggtgaatactagaaagtcagtcctgggtcacacacatttcacagactcccagtgaccagcactgtccggccgaggtaaagcaagaacttgggggatggagaagtgctgtcaccttctggtgagagtatctcagcctacaagggcagtacattcagcctcatcttcccatccaactgtaayaaaatgtggttgatgactaaaaatgcagatttctggatcgcatgctgtaagggcctaggaatctgcatttcaacagagtcagcaggatgactgttacgcacactgaaatgtaagaccactaccataggacttaactccaggtggcaaaaagtaaccataaagatacagctttgcttcacactgtatgcatcaccagtaatgataaaaagggtagtaacagcagcagcagcagctaacacttagagtagctgccgtgtatacaaacagttgcaagtgctttatagtcaactcttaattgtc

SEQ ID NO: 109860 - DNA, 601 bp, Human
gcaaagtgtttgtaaatctcccctcaaataacacctgtggtctgagtgagatgtatgtgtatctgtgtgtgtgtatgtttttgaagcatagtggtgaagtgcttagaattctgcagccagttacctgggtttaaatcccagctctgccactttctaactaggtgaccttgggcaagttacttaacttctctgtgcctcaattttgccaactgtaaaatggagctaatagtagtaccttcttcttagagttgttgtagaaataaataaagctaaatggagcagcacccagcatatagggagyactctataagtgttagttcatattattatgtaaattctattgtgattgataaaatacaaattcattttaaagtgtcactgagttctcatagcagcttttgaccattatgtttattaactcatttaatataatttacgttaataataaaggcacaactactctctgtggggtctcacacaattttgatgttaaaaatggatctttattctgaaaaaggttgggaagcactggtcaagggctgaatccctgggaaattgcccacaatggcaactgcaatctggttatcatttggtcaggggt

SEQ ID NO: 109861 - DNA, 601 bp, Human
gatgaagctggaaaccatcgttctcagcaaactatcacaaggacaaaaaaccaaacaccgcatgttctcactcataggtgggaattgaacaatgagaacacatggacacaggaaggggaacatcacacaccggggcctgttgtgaggtggggggaggggggagggatagcattaggagatatacctaatgtaaatgacgagttaatgggtgcagcacaccaacatggcacatgaatacatatgtaacaaacctgcacgttgcgcacatgtaccctaaaacctaaagtataataataataawaaaaaaaaaaaaagaaacttgcctaaggtcatagtccccagggggcacagttaagctttaaatctaggtcatctggctcctgactttaaccaccgtgctatcaaatacttacagtttttatttgtaggcaacttttcatcaagccaaatttaaataataaaaaggcatgatttcctcacatgttaatgagaagcggaaatcaagcgatccatttgctctgacctagaggccccgtccttggacatacacccaaggtggctagcagatggtgagctctgtgcacagaatcaagctaaggag

SEQ ID NO: 109862 - DNA, 601 bp, Human
aaaaaaaaaaaaaaattgcagagactgatgttatggagctctttctctgttttcttctagtagtttcacagtttcagatcttacttttaagtcttcatccattttgagtcgatttttgtatttgttatgcgatgagggtcttaagtacatgaactcctgcatatgttaattagcttgatttagccattccctaatgtatacttatattggaacatgtacaccacatatattttttggtcaaaaaaattttaaagaaaaaatttttaaagtgctctttgcttgcaattttttttttttttttctcctccagggaaacttcttcagtgccctcaagagaggacagcctgcatccttcctaacaccattttgttcacaagtctggcagacagtcatttaattcaggcaatggtttgcagttctatttgtcaccttcaccactgagaagaacccaagggcaatgactgtccttggttcatctctgatgcccagtacagccctctgcagtaagccctcctgctcactcacaaaaatgcttaaacaagaaagagagaaagtcaacttaaattgggccaaagagcccttcagtataataataccctgt

SEQ ID NO: 109863 - DNA, 601 bp, Human
ttctctattttgtttttgttgcctgtgcttttagggccatctccaaaaaaaaaaaaaaaattgcagagactgatgttatggagctctttctctgttttcttctagtagtttcacagtttcagatcttacttttaagtcttcatccattttgagtcgatttttgtatttgttatgcgatgagggtcttaagtacatgaactcctgcatatgttaattagcttgatttagccattccctaatgtatacttatattggaacatgtacaccacatatattttttggtcaaaaaaattttaaagamaaaatttttaaagtgctctttgcttgcaattttttttttttttttctcctccagggaaacttcttcagtgccctcaagagaggacagcctgcatccttcctaacaccattttgttcacaagtctggcagacagtcatttaattcaggcaatggtttgcagttctatttgtcaccttcaccactgagaagaacccaagggcaatgactgtccttggttcatctctgatgcccagtacagccctctgcagtaagccctcctgctcactcacaaaaatgcttaaacaagaaagagagaaagtc

SEQ ID NO: 109864 - DNA, 601 bp, Human
gttgatcattttgacttgaaacgtgaccagtagggaggaagaactgctcaactcagctccttctcccagtgcagtaaaacagactgtctggtgctacctccactgtatcctaaatcaaaggggctctctctcctagaagagctggccctgggcacccttgctctgagccatttgagttctttatacaggaactccttgtgtaggcttccatataagcccccttatcagatggatggcttgcaaatattttctcccattccataggttgtctcttcacactgttgattgtttccttggctgygcagaagcattttaattgggtgtaatccttttctctattttgtttttgttgcctgtgcttttagggccatctccaaaaaaaaaaaaaaaattgcagagactgatgttatggagctctttctctgttttcttctagtagtttcacagtttcagatcttacttttaagtcttcatccattttgagtcgatttttgtatttgttatgcgatgagggtcttaagtacatgaactcctgcatatgttaattagcttgatttagccattccctaatgtatacttatattggaacatgtacaccaca

SEQ ID NO: 109865 - DNA, 601 bp, Human
tattggacgatgcagttctagacagagctgccagaggcttctcgggatatcctcttcaaggaggtaccacatgcaagtggcctgggcatcaggaactcttttacttaaaaacaaaaatattaactgagaatcctctctggtccagatttttaatagtatcagcctttgaacaccaataaaaatacactgatattttaaaatattggtatcatcaaagctctctccccaaacaacatcctggttcaggggctacattcactcacaaagtgatactacttaagcagagtttaaaaaaaaaaaagttaacttgtagtcttaatggcaaaatgtacttttggagaattcttgtggctaaatgagttagtactactttttttccaagagcaactatttgaatagccctgtagtaccaacactctaccaaggttgatcattttgacttgaaacgtgaccagtagggaggaagaactgctcaactcagctccttctcccagtgcagtaaaacagactgtctggtgctacctccactgtatcctaaatcaaaggggctctctctcctagaagagctggccctgggcacccttgctctgagccatttgag

SEQ ID NO: 109866 - DNA, 601 bp, Human
agtgaccgagagttaaacctgctgttaagccagtgaaattttgtcactgcagcataacctaacatctcctgactgaaccttttagtctggagtaaatcttaatttttacaagcgttctgggtgattcttatgccaacagcctatggtccacacttttagaagtaacctcgatgccatattaactttctgtacttcgtttctttataaagaaataggtgagctacagagagctagtattcacttatttactcaacttttattttgtatctattgtgtcagacattgcactaggggttcatcygtatgcagagcattttcacaagtacagggacatgagaaagcactcaacagctggctgcagcacaatattggggtgagactgaggaaggatgaccctggggctggcgtttagggagaaacccaggattgaaggaaaggatgtgagtgaaaacaaatgtgtcgcaaggttctaaaactgtgaaataaacataagccgcataagtaattctatatattctagtagccacctttaggataaaaaggtgaaattgatttgaataatgtatttaatttaaccaaataaggtcaaaatagtgttact

SEQ ID NO: 109867 - DNA, 601 bp, Human
tgaaaattgttagatacaagaggaaaaataactaaaaacagcttattccagcattaactcttagctctgccaatggaagaaagccaatgtggtatttttataaccaaagaaaactgactgttggtacaatttccagtttacataacagtagcattccaagagcttgtttgtaaatcatttggtgagatctcagaatccacaggaaacagaatattacaaaaagtgggtgaaagagctggagcagctcataaaagctggtcttacctattgcatacctcacctcttaaacagagtgctgctraatctgccattcttaacaataccaccagggacaatgttgggcacaaattttctgagaatatggattccttatgctgttcaaaccatcagccagcaggcttggggctcccccagggccctgcctttcctggcatgggactagggtggcaggtgggaaataggctgcaggaagaggaggagatgaggttgcagaggaccagaggtttgaggcaccagtttcagattaacagagagtaagggcaacggggcttgggctaagggttttggaacaggctggagagaaaaaaatcaagacaaggaa

SEQ ID NO: 109868 - DNA, 601 bp, Human
tactaattctgaccttgggcaagtcactgaaactctctggggctcagtttccccatgaatcaatagggaatgttataaaggcaaaatgggtgatataaagcacttggtatggtgcatagtgttccttccttctttacttccttcattcatttactcactcaacaaaatatcaagtgtcttgtatgcgtcatgcactgtgctgggtactggggatccattaattaactagacagacaaggtccctgccctcaaggaacttaagtctaatgggggaggcaggcaaataagtaaataaacaaasgaaatcattatagacagcactgggtgctactaaggaaatgcacagagatgtgatgaagagctactgccagaatcaccatgcagggaaaacttctctgaaatggtgaagcacatctgagacccgaaggacatgaatgagtcagccactggaaaaactggggaaagagcattccaggcagaaggaggagcaagtgcaaagcctagaagttagagaaggacatgatacatctgggaaaaagaaaggagaccagggaaccggagcatagaaagtaaggaagaaagacgtatgagctacagatgg

SEQ ID NO: 109869 - DNA, 601 bp, Human
gaaggaggtggtgttaccagagcagtatcactgttatctgaagcttggacactgctttccagttgctgccataaattatttttattgttttttaaaaatgagactttaagacacatattgcttctcaaataagagtcattcgtaatcttcacactcaaggcagatctccacagctccctccaaaatatgcttctaccagaaccctttcttgttaccaccaagttcttttgcagaaaatagcagaaaaggacctatttcaaaggccatggacaaaaaattttgagccacagggaaaaaaaaacagaatacttcatgctattatacctatgaagatacagaaagaggcaaaaacttaatattgaaccataacctcagacctgactctggcacaaacctttataggcagacaaacctgagagcaaatattggctctttgtgacttactaattctgaccttgggcaagtcactgaaactctctggggctcagtttccccatgaatcaatagggaatgttataaaggcaaaatgggtgatataaagcacttggtatggtgcatagtgttccttccttctttacttccttcattcatttactcactc

SEQ ID NO: 109870 - DNA, 601 bp, Human
gaacctgaaggccccgagactgggggaaggaggtggtgttaccagagcagtatcactgttatctgaagcttggacactgctttccagttgctgccataaattatttttattgttttttaaaaatgagactttaagacacatattgcttctcaaataagagtcattcgtaatcttcacactcaaggcagatctccacagctccctccaaaatatgcttctaccagaaccctttcttgttaccaccaagttcttttgcagaaaatagcagaaaaggacctatttcaaaggccatggacaaaamattttgagccacagggaaaaaaaaacagaatacttcatgctattatacctatgaagatacagaaagaggcaaaaacttaatattgaaccataacctcagacctgactctggcacaaacctttataggcagacaaacctgagagcaaatattggctctttgtgacttactaattctgaccttgggcaagtcactgaaactctctggggctcagtttccccatgaatcaatagggaatgttataaaggcaaaatgggtgatataaagcacttggtatggtgcatagtgttccttccttcttt

SEQ ID NO: 109871 - DNA, 601 bp, Human
ttttactttcccaggggcacaggtctctctattagtcaaataaattaccttaaaaggaaattttatggtattcttcaaacagattctgacacatcttttaaagattatttctacttggtctatagtctatattttacaactattttgaaggtgattctctccagtatattttttattgttactatgattattgttatttgagggagattcttttaagtgtataatatcattaactataagcacaatgttgtacagcagatcaataaagtttttcatcttgcataactggaacattctaccrtttgaatagtataataattccccattttcccctcctgctcagtatatttttaattggttattgatggtttataggaaaactactgactgttttcttacttgcaccctactggctacttttaagatttctaataggcatttgtggcagtttgtgcgtgcttccttgatatatactcatataatttgtagaaatagtgatttatctcttttccaaccagaggctcctgagcactgaggagcctggctgccgtggagatctcagctgaatactgcaaagctgctgccatacccacatgtgtga

SEQ ID NO: 109872 - DNA, 601 bp, Human
tgtttattaatatttggaggtacaaatccctccacattttacatgagcattttcttgtgccttaaaggtgaactttagaatcatttagttaagttcccccttattcatcctaatcttgtggaaagagtaactagaactgccttgggtttctaaagtaataatgggaagaacagttctataaccttttactttcccaggggcacaggtctctctattagtcaaataaattaccttaaaaggaaattttatggtattcttcaaacagattctgacacatcttttaaagattatttctacttgrtctatagtctatattttacaactattttgaaggtgattctctccagtatattttttattgttactatgattattgttatttgagggagattcttttaagtgtataatatcattaactataagcacaatgttgtacagcagatcaataaagtttttcatcttgcataactggaacattctaccgtttgaatagtataataattccccattttcccctcctgctcagtatatttttaattggttattgatggtttataggaaaactactgactgttttcttacttgcaccctactggctact

SEQ ID NO: 109873 - DNA, 601 bp, Human
ataagtctccgaccttatctgctttgtacgcagctcttatttttatcttcactaatttgaccaatgaaaatgatatttcattaatttgcatctctttgatgactagtaaggctggacatcttttctatgtttattggccgtatgtagtttttcttttgtgacttgcctattccaataatttgcttattctcttattgatgtgttaaaatttttgttattggtgtgtgagtttattttacatattaaggatataaatcctctttaggattcaaacactagcaaatacggattttatttataktggttttcaggagatgttcagaaaattataatttttatgtctctattttcctttatggtttctgttttcaatgctctgattagacctccttttgtgtaagctatataaatatccacttatttccttggagaaattttatgcttccatttaaaaagtatttcaatcacctagaacttattttagaatgtcattacgtttttagatctagattctttttaaatgtttaacctaccatctcagaataatttgtgacatggtccgctccttccctatggatgtgaaatgccactactatcacat

SEQ ID NO: 109874 - DNA, 601 bp, Human
gcttatttttcagccttatgataagtattaccaaatggctctcataaatgttgtacaatttatatacccaataagtctccgaccttatctgctttgtacgcagctcttatttttatcttcactaatttgaccaatgaaaatgatatttcattaatttgcatctctttgatgactagtaaggctggacatcttttctatgtttattggccgtatgtagtttttcttttgtgacttgcctattccaataatttgcttattctcttattgatgtgttaaaatttttgttattggtgtgtgagtktattttacatattaaggatataaatcctctttaggattcaaacactagcaaatacggattttatttatagtggttttcaggagatgttcagaaaattataatttttatgtctctattttcctttatggtttctgttttcaatgctctgattagacctccttttgtgtaagctatataaatatccacttatttccttggagaaattttatgcttccatttaaaaagtatttcaatcacctagaacttattttagaatgtcattacgtttttagatctagattctttttaaatgtttaacct

SEQ ID NO: 109875 - DNA, 601 bp, Human
agaacacactattcacccaagcacccaccccaaaaaggaaaatgctaacaacagtgtagccagcttttaaaacaaataaactaaaatctactcggcagcctcacccatacttaccagtgccataacaatgacatacctaatgatggttaacaaatgcttaaggaggaacagaactttagagcaagaagggaaccttagtgatgaagaaaaggagctctaaagaggtgacttcctaaggttgggactagaatctaggcctctgaacttcccactcaggaccaactcgtgtatacgctctacrttagtacaaatttgatttttcctccttttccaaatgcattagtttcccattgctgctataacagattaccacaaatttagtggcttaaaatcacccacattatctcacatttctggatgtcagaagtctgaaatgagtcttatggggataaactcaaagtgtcatcaccaggagggatggttccctctggagattgtaggggagaatctgtttcatcttttccaccttctagaatctgcttgaatcctctggcttgaggctgcatcactccaagctctgcttccctcaacacatcttctc

SEQ ID NO: 109876 - DNA, 601 bp, Human
taccctgtagtatcaagcagtaactctcaccattcacatttcagtttccttcagcagcactgactgcggctttctatgggccagagagcatgtgaggagactcaggaggcccaccttcccttctggacaagtgaccgggggaacctgggctgttccactgcatggccttgacgtgacactatagcttcaaacttcttattctgtatgtacaaaattttgcagtgattttagcataggagtctgggtaggagggatctttcaggacatctttgcagaaagacctaggaccaccatgggagaytctgtgaggcctccacccccgatttgttttggttctgatggcttctaacctctgtgtttgcctccacagtaccctctgaaatgttccagaatcccccatatgagaacacactattcacccaagcacccaccccaaaaaggaaaatgctaacaacagtgtagccagcttttaaaacaaataaactaaaatctactcggcagcctcacccatacttaccagtgccataacaatgacatacctaatgatggttaacaaatgcttaaggaggaacagaactttagagcaagaagggaaccttag

SEQ ID NO: 109877 - DNA, 601 bp, Human
tggaatggggtctcccaggacaaacccatgttggggcatggcaacaataaggtgtggggaggttggccaggaccagtggctttcagttcagtaaagtgtggggggcccaaaaccctcccaacccaaaccaaagttttcagcttggtatgattcagaagtcatccataccacaccaggcaaggaaagcccactccactcaagatggctccaccaaagcccacctgtgcttccatgagtctctggattgtgaactggcctatatgaaacttggtttttaaaaaagttcattccctttatcttyttgaaaattcaaaaagtatgaaagtgtacaatgtcaagtctccctcttaccctgttcccagccagccatgccccttccccggagacagtggcataacagggtcccatgcacatgactgttggcactgcctttattctttgaagggctcttcctttatgagcaaaagacactttttgctgtcctctggccccctaaggaaaggctcacatatggcttccctgccctgtgcaagattccatggctctgtcagtttcctaccctcatcccttgggaagtcccagggcagcactccacacatca

SEQ ID NO: 109878 - DNA, 601 bp, Human
taaccaccaatctgatgtctttaccatatagtgtcaataaatgatgcacttgagaaaataacaacgaattgcactattcagagaaggtaaaagataagatattctctctcccatcttctttccaccttgtgactaattaaaacaaaacctcctcatatagtaattttcaaatgatggcaaatgggaacatttttgtgcttcagccttagcacaattttcctttagcactggaaatttcagtcggataatgcgctttgcactgcagttacgtaagtacagtggaagttcttgtgttcacttrtagaatacagagtttccttttactcacacactcctttaatgcagttggacatcaatctttcccgcttagaaaggaggttttgtttcactgccaggggatagaacttccaaaaaacacaaatgtctttcagcatcatgttgagtaaataatcaagggggtatgaattggtctctctctaacttcctgccttattttgctttcaactcataggtgagttatgaaaagacatctgccctaacgttctagccacctaggcaggatgtcagctccaaagacaagtctcagcttatggtgcttccc

SEQ ID NO: 109879 - DNA, 601 bp, Human
tatagcaaagtttgagaacaactggtctagtatacacacaaatagattaaaagaaaaaatgagaaatcccttcctggactataaatagaatcatagaaagtttataaacaactgtagcaaaatttattgaaaataaattgaacatataaccaccaatctgatgtctttaccatatagtgtcaataaatgatgcacttgagaaaataacaacgaattgcactattcagagaaggtaaaagataagatattctctctcccatcttctttccaccttgtgactaattaaaacaaaacctcctcrtatagtaattttcaaatgatggcaaatgggaacatttttgtgcttcagccttagcacaattttcctttagcactggaaatttcagtcggataatgcgctttgcactgcagttacgtaagtacagtggaagttcttgtgttcacttatagaatacagagtttccttttactcacacactcctttaatgcagttggacatcaatctttcccgcttagaaaggaggttttgtttcactgccaggggatagaacttccaaaaaacacaaatgtctttcagcatcatgttgagtaaataatcaag

SEQ ID NO: 109880 - DNA, 601 bp, Human
tggcattttatactcactgtgtctaccatgtagggtctagctataggttctcttttatagtctaggaacttgctgttcaaaatgtggtccacagacaagtgccactggtgctacctgggagcttgttagaaatgcagagtgtcaggcctcacccctgagccactgaatctgaatctgcattttaaccaggcccccaggagagtcctccacacattgtaggctgagatatgtagctctggtttaccgcctttcaatcttccacacgcattgcagtcaccttggaaaagtacccatgccaggrcccacccccacacccagagataatgatttaattgttatggggtgcagccaggacaatgggatttttaaaaactcttcaggtgattgtaacatatagcaaagtttgagaacaactggtctagtatacacacaaatagattaaaagaaaaaatgagaaatcccttcctggactataaatagaatcatagaaagtttataaacaactgtagcaaaatttattgaaaataaattgaacatataaccaccaatctgatgtctttaccatatagtgtcaataaatgatgcacttgagaaaataaca

SEQ ID NO: 109881 - DNA, 601 bp, Human
gcagtcaagggacaagtgagaacctgtgtggcattttatactcactgtgtctaccatgtagggtctagctataggttctcttttatagtctaggaacttgctgttcaaaatgtggtccacagacaagtgccactggtgctacctgggagcttgttagaaatgcagagtgtcaggcctcacccctgagccactgaatctgaatctgcattttaaccaggcccccaggagagtcctccacacattgtaggctgagatatgtagctctggtttaccgcctttcaatcttccacacgcattgcartcaccttggaaaagtacccatgccagggcccacccccacacccagagataatgatttaattgttatggggtgcagccaggacaatgggatttttaaaaactcttcaggtgattgtaacatatagcaaagtttgagaacaactggtctagtatacacacaaatagattaaaagaaaaaatgagaaatcccttcctggactataaatagaatcatagaaagtttataaacaactgtagcaaaatttattgaaaataaattgaacatataaccaccaatctgatgtctttaccatatagtgtc

SEQ ID NO: 109882 - DNA, 601 bp, Human
gtttacaaagcagtcaagggacaagtgagaacctgtgtggcattttatactcactgtgtctaccatgtagggtctagctataggttctcttttatagtctaggaacttgctgttcaaaatgtggtccacagacaagtgccactggtgctacctgggagcttgttagaaatgcagagtgtcaggcctcacccctgagccactgaatctgaatctgcattttaaccaggcccccaggagagtcctccacacattgtaggctgagatatgtagctctggtttaccgcctttcaatcttccacaygcattgcagtcaccttggaaaagtacccatgccagggcccacccccacacccagagataatgatttaattgttatggggtgcagccaggacaatgggatttttaaaaactcttcaggtgattgtaacatatagcaaagtttgagaacaactggtctagtatacacacaaatagattaaaagaaaaaatgagaaatcccttcctggactataaatagaatcatagaaagtttataaacaactgtagcaaaatttattgaaaataaattgaacatataaccaccaatctgatgtctttacca

SEQ ID NO: 109883 - DNA, 601 bp, Human
gggagagggtgcctggctctgtgccacaggcagaggctccctgggcaggtgagcgccttctcccaccagctgttagaaaaaggtgggcgttggaatgctgctcagaggcaccctggcttcgctcaacctggagtttcacacacccattccttaacctcattctctccctatttcattcctcttcccacgcagtgtttactaaaatctctcaacaccagacgaagcacaagaccaggatgttctgggctgcctggggaatgttcccacaacggtgagccgctgggcagagaatcacacggtygccacccattcaaggcgggggcgccccagtctccaactcaggggtcactgatgtgctcaaggacaagaaaaccatcagacaatgtctgagagaggggcttttccttcggtgcttacaaataaaatacaaaaatcctcacaggaaaaggaggataaaggctgtggtggctttgctgtttgtttacaaagcagtcaagggacaagtgagaacctgtgtggcattttatactcactgtgtctaccatgtagggtctagctataggttctcttttatagtctaggaacttgctgttcaaaatgt

SEQ ID NO: 109884 - DNA, 601 bp, Human
cttgcccctacccctcatttttttgaaaacactttgaatactctcccgtttgtttttccaggtgaccgttagaatcatttataagttctcttccccatatccaaaccgttagaggactgacattataattatacatcaagttagagataactggcccatttacaacaaggagttttcctagtcacaaatgtgctatgcttctccatttattcgcatttctgtgatgcaccctgcagtaaagttccatggaagtcctgcatacaaccaccactgctggatttattatttctctgtaacaccrtcagcttacttttaaccatccctgacagaaaaaggaaaggcctccagccaccaagccctgctataataccatacattggaggctggaagggtgttccagggctggaaagatggcacaaaagattccgagtcagcagcacgggccccagtagcagctctgtcacactcactctagatgactttggccaagtccttcccatccctgggtctcagtttactcctctgtaaactgtgctgcctgtctgttcctggggagagggtgcctggctctgtgccacaggcagaggctccctgggcaggt

SEQ ID NO: 109885 - DNA, 601 bp, Human
aaccatctatatttagtgcataagacgtatttcattattttctaaacagccaaccaattatcctaactccatttgttgaacagtttatcatctccttattgatttgaaatgttacctttatcataggctaataactcactttcagtctttctacttagttctactgagattctgtttctgtaccagcaccaaagcatttactgtaaccttgcaatatgtttaatatctggcagtacaaatttacaaatttgtcatcttcccttgcccctacccctcatttttttgaaaacactttgaataytctcccgtttgtttttccaggtgaccgttagaatcatttataagttctcttccccatatccaaaccgttagaggactgacattataattatacatcaagttagagataactggcccatttacaacaaggagttttcctagtcacaaatgtgctatgcttctccatttattcgcatttctgtgatgcaccctgcagtaaagttccatggaagtcctgcatacaaccaccactgctggatttattatttctctgtaacaccgtcagcttacttttaaccatccctgacagaaaaaggaaagg

SEQ ID NO: 109886 - DNA, 601 bp, Human
tgggattacaggtgcccgccaccgtgcctggctaatttttgtatttttagtagagatggggtttcaccatgttggccaggctggtctcgaactcctgacctcatgatccacctgcctcggcctcccaaagtgctggcacagtcccttttagtgttttatgaaattagaaaataaatccaggatcacctctgaagactgagaatcaatccaaaggaaccgagcactgcttagttttcaaaccatccctgctacccttcccatagcatctggcttgaccattttgagacttttttccctcccygcaatttcagcttagggacatactgatcagctcagtggctcttttgccaaacatgtacttacttacttccctgtctttgtatgctacaaagacattatagctgaaattatattcatatattgcatttatacaggcaaccaccccactctggtggctggctgtgttggcccttctccatcaagtctcagatgaacagtcaagaaagaccagatacttactaattggctacatcaggggcaacgctgtatccttcagcaggaagtcacaattcacaatcatatttcctcctcctggaaccga

SEQ ID NO: 109887 - DNA, 601 bp, Human
ttctgtgtgctcccaacagccttccaacaaagttgcttttgttcaagttagttggaattgattgttgcaaccaaagaaccctagttgatgtattcggaacaagatctgttcttcaactgacttcttataatgctattccttgtcaccaattctccagtgcccacaggatcatggaatcacccattcaactcactgcaaccattgattcgcttcagttttccaaaaacatttcctcaacaagcccacaggcagaaactgaattaaaatgccaagtttcatctattcactgcccccaaagtgrgctataaatctgtagttacccaaggtggtaagtcttgtttatagcaatactgtgttctgtagccttaccgctcttccttcttctctcaagctcacccttcctaaattgatacgcctaccttcacagtcatcccccccctttctttttgagacagactcttgccctgtcacccaggctagagtgcagtggcacgatctggctcactgcaacccccgcctcctgggttcaagtgattcttctgcctcagcctcccgagtagctgggattacaggtgcccgccaccgtgcctggctaattttt

SEQ ID NO: 109888 - DNA, 601 bp, Human
ttggcttatcaccatgttcagatgtgctacccacccttccatcctctttacctcaaatatgaatcttgataagaaagacaaaaagataatgctgatggaattcatgcattataactgtggcatgttgagcagagtttctgttctgagatagaatctgccattcctgattcctggcttcctggagtcatctgggttactgttctgttctaagggtgattctccagctttcccacagattctgtgtgctcccaacagccttccaacaaagttgcttttgttcaagttagttggaattgattgytgcaaccaaagaaccctagttgatgtattcggaacaagatctgttcttcaactgacttcttataatgctattccttgtcaccaattctccagtgcccacaggatcatggaatcacccattcaactcactgcaaccattgattcgcttcagttttccaaaaacatttcctcaacaagcccacaggcagaaactgaattaaaatgccaagtttcatctattcactgcccccaaagtgagctataaatctgtagttacccaaggtggtaagtcttgtttatagcaatactgtgttctgtagcc

SEQ ID NO: 109889 - DNA, 601 bp, Human
aaaatatacccatctgaagtttgttgccaaaccacattctatccttatgactactttgtcatcaagatccagacaatattaatttcttagatcaaccatctatctacagaattgatctatgatgatttaacttttgatatcccgattattttttcttgaagcaactgtccatgtcattattgagcctatttgtttatttggggctgcctggcaaacatttctttacttcataacagcactcaggttttcttttagggaattacctcttcccctacaggtttacattggcttatcaccatgwtcagatgtgctacccacccttccatcctctttacctcaaatatgaatcttgataagaaagacaaaaagataatgctgatggaattcatgcattataactgtggcatgttgagcagagtttctgttctgagatagaatctgccattcctgattcctggcttcctggagtcatctgggttactgttctgttctaagggtgattctccagctttcccacagattctgtgtgctcccaacagccttccaacaaagttgcttttgttcaagttagttggaattgattgttgcaaccaaagaaccc

SEQ ID NO: 109890 - DNA, 601 bp, Human
gagtatgtttggggatctcttcatttaaagaggtcactggcattgttccttctcaccaactagccaactgtgaactcttgtaactcatatttctccattttgtccaactgaatattttgattttgtcatgtgccttgttgaactcaacgtgtatcctcttatacagccttatgctggtggcatttccctcatcagtcttacaacactaaaaaagaagtaaagttaatctgctgtgacttttcattctttatttgctgtaataaattggtctaatgttttcctgggagtgtcaagttttatmatctacattctaaacaatcttcaggcatttttacatcattaaagtcagaaatgtatttgtctttttccattctctgagcaatttttacatttgctgctatttcttaaaaatcaccaacagggatgggtgatttttgctacaggtttctcagtacattgaagtaaaattcatctgtacctgtgatgagtaaactcatctgtggtattaggggtcttttactaggatactcactcaaccttttatttcatatttactatgtttgttttattctttttgacagaaaatataaaagcaaaatta

SEQ ID NO: 109891 - DNA, 601 bp, Human
tagcttgtaagtgagccattcttcagccccactcaagccttcagatgacagtgcagccccagttgccatcttgacagcaacctcaatgagagaccctgacccagaacctcccagcaaagccacttctgaattcctctcagaccctgtgtgggaaaataaatgtttattgctttaagctactaaattttaatttgtcatatagcaataaataacatacactttgagtttctataagtattctttaagcaagaaagtctgcaaacctctcacctcagggaaaattctgattttttttttttttagtgcctttcttaaaatagtctactatagagtaatggggacaacaacaacaacaaaacacatttaccaaatacgttggatgttggcctttgtgctaacagttttatacgtactacctaagttaattcttataaaagccctgtgatataggttctattattctatccattttacagatgaggaatacaggtttagagaggttaaaagccttgcctaaagatgtagggctaggaagaggcagaagggaaatccaaaaacaggcagtgtgacctcagagtcctagctctaaagctctaggtta

SEQ ID NO: 109892 - DNA, 601 bp, Human
ctggtttaaatcccctgggctaagtgtaaatcaagcaacttggagctctgctcttacaaggagaaatgttgggggattccagaaacaccagggtcattttacctcttaatagtttctccaagccatactggttcagaagcaaagacctcatagttccatgaaaaatttgtttttcctcaaaactaaaagaaatgaagccctaagggtctcatttcacaaaattctcccctagtccagaagtgaaatatcaaagagttggaggtactcacagctaactttctacccagtcagggttctgcayatggtgtccctgggagaggacacccagcctgtgctctactcttccagtactcaggggctcagtctctaaggtagtactaagtactactgccccaaatagaatgagctgccttagtactggcattctatttgggcagattattgctaggaggttcttccttaaacacattaacatctgcctcccagaaacctctgtgtattgttttgaattccatccttggaagccacacagaataagtctccctcttctatacagcagtcctttcccatttctatagtcagccaccaaacctctgggtct

SEQ ID NO: 109893 - DNA, 601 bp, Human
aaatcctttcttgtggccagcgatttcttgcatcatcatctttacagagaaagatctgctttcgtgtagcatcatggggagttaatttgggcttcaacagagacaatggccctattcaatattttggggctagataaagacagaaaaggggaagtttaactgtagcgccttcaaatacctaagaaatctatttggtagaagcaggagacaacaggtacacaccaaagagttttctcttttcccctgtgttttccagacattcatgccatgccagtagtgagagctgactgagtttgtcacytattgtggccttgactgtgtcctttcttaaggcattggcaggatccagatggcctgccctcaccctcataccttggccttccaaggttgggctgtttgggtgattctgctcctgacaatcctgtcttccagaggagtgattgttggactagggtaggagggctgccacctgcacgctcactggcagaaattcttcagagcttctagtactgatatacatttagaaatggtttcatatttcacagatcatttcagtgagtgtccaagggtagattggactaagggaggagtaaacgtggta

SEQ ID NO: 109894 - DNA, 601 bp, Human
cttcattgtataatttttggaaatacaaatatcctaagcaaatgacttgctgtcttatcactgagaagaaataacctgtgtttagaaaacattttacaaatgcttattatttttagtaggttgccttttttgtcttttgtataaaagatcatgtttctttgacttctttccccttttgtggtgatttagaatataaatactctttttaatttgtttacattttaaaaaaatttagtttattttctcaattatcaatgttaaaaatgaaatttgatgtgtcatttgataaaaaattagcatrcttacttcctccttctttttcttcccagttaccagtttttatttgtcatctgatttcatatcctcattattttatatataaaacttatatttcagtaattaattttgacatctgtactagtataactaaactgacaacagttgcttggacacattatcgctggttttgaaaaaattatatcctccccatttgggggtttttatcttgatatagctgttatctagttgaagaggctctttggacattttttccaggaagggcatgtgaaaagtatatccatataacgaaatattatatgtc

SEQ ID NO: 109895 - DNA, 601 bp, Human
atgtgttacacatcaaacaactttttataacagcccccacaagggattttataatttgttatttaaaagttatgcatcttcattgtataatttttggaaatacaaatatcctaagcaaatgacttgctgtcttatcactgagaagaaataacctgtgtttagaaaacattttacaaatgcttattatttttagtaggttgccttttttgtcttttgtataaaagatcatgtttctttgacttctttccccttttgtggtgatttagaatataaatactctttttaatttgtttacattttwaaaaaatttagtttattttctcaattatcaatgttaaaaatgaaatttgatgtgtcatttgataaaaaattagcatgcttacttcctccttctttttcttcccagttaccagtttttatttgtcatctgatttcatatcctcattattttatatataaaacttatatttcagtaattaattttgacatctgtactagtataactaaactgacaacagttgcttggacacattatcgctggttttgaaaaaattatatcctccccatttgggggtttttatcttgatatagctgttatcta

SEQ ID NO: 109896 - DNA, 601 bp, Human
ccaggatatatggccagtggatctcagcagaggtaacatgctccacttgcaggcttggtccataagaacctcccggtgtgacctccctttgtcttttcccagctgctgtctgattagagaggctcctgcaggacatggaggagggaggagccacaggatggaagaagcctgggtccttgaataagcacatggaaagaagtctgcagggccaggaaaacctgcagagcctttgacatgagcaggaaataaacaatattcagggtttatctgttacagcagggagtgttactctaatgccaarcctgaagtctggcattaggggttggttagagaatttctgatgtgggatgaatcctcacaataaatcatatccttttctctctttctctgtctcttctgggagcctcatccaaacatcaacatgccctgtgcttacaatctgaagtcaatctggccctgattgggaggctccactttgaaaccctggtccccagcttaaggtctgttctgtccgttctccatcctggagggatcaggtcgaccttcacaaacctctccaggagtagtaacagtcttttggggtgaggagtgagatcagctt

SEQ ID NO: 109897 - DNA, 601 bp, Human
acagttaaagcttaaccaatttttattgttagtgttttattcacagacagaattgtagtgttatagaagactggccttgaggaatctagatttaatctgcacaagaaaaatcatgttactgcctcatgttttatcaataaaaaggaagaaggaggaaggagacaaaataatcatttagagaagacagaagatgcttagaagaaagatgtttggtaagagatgacctcgggcttggtctctatggacagaaacctcacacactcctaccataaacaacaaaatcccaaaagagtacagcctrtttgatccatttccaaccactatacttatgtcactttttttcttttaattgaaagagttcagctgggaaactgctctctgaaggaggcagggaatatgcaaaagataaagtgtgggccagagactcccaggagttcccctaaatccaaagtcctttttctcctgagaatagagactacatttcccagcctcccttgcagttaggtgtgaccatgtgaccaggatatatggccagtggatctcagcagaggtaacatgctccacttgcaggcttggtccataagaacctcccggtgtgacc

SEQ ID NO: 109898 - DNA, 601 bp, Human
tgttctggctttgttggaggaacagccccgttagagcccagggctacctgcctttgcagtctctgtgtgcctctattctccttataaatatcaaaattgttaggtaaagtggttggcaggaaactctcaatccacccttaggaaaaaatgcttcctcttgttgagtctttgaaccataatccccttaaaccctctacactgagcacatataagcgctattgggatgattgtttttctagaacattttatgtcctcagaacttttgacaggtgccttttttcatcggcagtttgcagatgcmgtgtgggtggaagaaggatactcctcattttaagtgaggaaactgaagaatacagaggtaaatttaaggcaaagctcaacagtcttaaaaacatagaagtgaatttgtagttgggactatgtcccatgacaaagatgtgactctctttcctattccctctgagttttgtacagatgattttgcttgtccttagataaaagcccttcaatcaagattatattcaagaggaaagaagctgagatgtaagagagtggtcgaattatacgcaattatttttttttataaattttcgaatttcat

SEQ ID NO: 109899 - DNA, 601 bp, Human
tccctactaccttggtcttagtaattttaagcaaaaaaaaaaaaaaaaaaaaaaaaaaattaagaaaattacaggtcacgattttgctttgaggactggaagctaagcctcccccttttcttttaatatgtgataatttgatttcaaagagacaaatcatttccttctttcatctcttcaaaccagaaagccccttattgtaattacatcctcttggtgtcaaccagcatttggaaaatactttacttccaagttccattcacaaggtaaacaaggaggtttatgtttggctttcatcagstggctttgaacgagaatgtgaatggctctgggaactggagcccagtcctgctggatggggaattctgttctggctttgttggaggaacagccccgttagagcccagggctacctgcctttgcagtctctgtgtgcctctattctccttataaatatcaaaattgttaggtaaagtggttggcaggaaactctcaatccacccttaggaaaaaatgcttcctcttgttgagtctttgaaccataatccccttaaaccctctacactgagcacatataagcgctattgggatgattgttttt

SEQ ID NO: 109900 - DNA, 601 bp, Human
ctgttacctgtaccccgactccccctgggaagaccactacctcccccaaaaggcacaaggaggagagaggcaggtatgagactccacaagcagcctgccaatcaccattctacattcattatggattaaaatgcaatggaaatagacaggaaatatactggacgaagatcacactctctgccactaagctcctcttcctcctcatgaccccatttctccagctcccaggttgcttcttctatccctactaccttggtcttagtaattttaagcaaaaaaaaaaaaaaaaaaaaaaaaaaawtaagaaaattacaggtcacgattttgctttgaggactggaagctaagcctcccccttttcttttaatatgtgataatttgatttcaaagagacaaatcatttccttctttcatctcttcaaaccagaaagccccttattgtaattacatcctcttggtgtcaaccagcatttggaaaatactttacttccaagttccattcacaaggtaaacaaggaggtttatgtttggctttcatcagctggctttgaacgagaatgtgaatggctctgggaactggagcccagtcctgctggatggg

SEQ ID NO: 109901 - DNA, 601 bp, Human
tgtgtgtactgggaaaaaagatagagtcagagaagccccagtggggttcatcatgcttactttgaaggcaaaagcagagtttgcatcattttggtaccttttcattttccaacagggagaagaaaatcagataacatgaacacagaagtattttgccagctttcaattttatctaaagtacctggtcttagagtttttaacccaatgtagaattttctgaggttggactatgatgatgatgacattattattaggagcagctactattggattgtccacctactgcaagtgctatgcccarcattttatagagcgaattctatttaatccccacaaaaatcttgcaaggaaatcctcactatctcatcttacagatgaagaaagtggagctgaggggggttaaagttgttcaatgatgcgaagtcagcaaatggcagagcggaaaccagaactcatggttggtttcctctaaagctctcgccctttctaatacagcacactgtcacttcagagggcatggtgcgtgtgtggatgtgtgtgagagagagttgagagttaagaagtccttatgggcatcttccacacactcaagatgactctc

SEQ ID NO: 109902 - DNA, 601 bp, Human
gggaacatctgagccattttaattccctctgaccatttctccctttgggaaaaacccaaggggcatcagatgtgatggaaccaaattcaaacaaagatattggtaaagaaacacacaatttagtttctactttcctacaaagatactggttattgataacacagcagccgtgtgtgtgtgtgtgtgtgtgtgtgtgtgtgtgtgtactgggaaaaaagatagagtcagagaagccccagtggggttcatcatgcttactttgaaggcaaaagcagagtttgcatcattttggtaccttttyattttccaacagggagaagaaaatcagataacatgaacacagaagtattttgccagctttcaattttatctaaagtacctggtcttagagtttttaacccaatgtagaattttctgaggttggactatgatgatgatgacattattattaggagcagctactattggattgtccacctactgcaagtgctatgcccagcattttatagagcgaattctatttaatccccacaaaaatcttgcaaggaaatcctcactatctcatcttacagatgaagaaagtggagctgaggggggttaa

SEQ ID NO: 109903 - DNA, 601 bp, Human
accaactaatgaggggaattcaattttgctgtcttagaggggggtgtgtgggatggtggagatgagataaatataattatgcaactcattcattattaaacccaagatcactatcttttaaacgatggatataaaaccatttgaaaacagagtttagcctgcagtaccatcatttaagagggaaggggccttcgttgtagttaagcagtgaaagagagaaaggtaactatagtgctacagttctcttgctgttccacttgttcagctgggtggggtggggcagggccatttttgtctctaycattccccaaccccagattcacaatttactgagagaactcctatgcttaaaagagaacatatttttcctataacataatccctgaaaaatctcctaattcttcagtgatcttttccaatattgaccaaatctgaccctatttgctttttaactttccctgatcatacactgactttagatcctacccacccctccatccccactgaagggcagagactccatattatctcaccaaacatcaaaagcaccctgtggggttagcattattagtctctatttttaagataagaaaacaaaact

SEQ ID NO: 109904 - DNA, 601 bp, Human
tcatggctaactttctaacaatttaatcatgacgtctggctttttagtaggaactttcagccaaagtttctgacctgggactaaatattttgtcttcagatactacaatggcaaagccaactaatactttttggatgtctaggagaaaaggcagtagattaatttagtaaagatgggagtcagcagtagctactggggaagctggcggggggtataaatctgatactcccaggtatcaaggcctccattccaccctgaggccaggctggagtcacccaaagctctggactcagctctgggmtgggaggctggcttcagggcagcagcaggcccagtttacaagggtggaactccaagcttgggaggtgatgcgtgaacctgcaaaagcagctatggagtgaaggagaggctggtgcggaggcttacactcgggtggcagaactgctaagccagagcttagagaagtaaatggtctagaacccagtggctgcccagagagacttggtgagcagggatcctgctcccctgggcaggtggggggaggtgagaataattcttactttttgtgaatgatcccgaagaggaagggcactgtcagcat

SEQ ID NO: 109905 - DNA, 601 bp, Human
gcagagcttacatcatttacagccatttcataacttcctcagatatcatggctaactttctaacaatttaatcatgacgtctggctttttagtaggaactttcagccaaagtttctgacctgggactaaatattttgtcttcagatactacaatggcaaagccaactaatactttttggatgtctaggagaaaaggcagtagattaatttagtaaagatgggagtcagcagtagctactggggaagctggcggggggtataaatctgatactcccaggtatcaaggcctccattccacccygaggccaggctggagtcacccaaagctctggactcagctctgggatgggaggctggcttcagggcagcagcaggcccagtttacaagggtggaactccaagcttgggaggtgatgcgtgaacctgcaaaagcagctatggagtgaaggagaggctggtgcggaggcttacactcgggtggcagaactgctaagccagagcttagagaagtaaatggtctagaacccagtggctgcccagagagacttggtgagcagggatcctgctcccctgggcaggtggggggaggtgagaataattc

SEQ ID NO: 109906 - DNA, 601 bp, Human
caagtcgaggcagggtaggcggcctgctttaacctaagtagtctccattttttagataagaaaactaaactgaagcttagacaaccttgtcaatgggcaagggtttgctcagtaacttagagtaccatctcctccttggggggcaaaactgcctccagttattttataaaaatgagcattacaaggaaccccccaaattcctggtatctttcctaagaatgattctctcagcctctctctcagagtctgcctctttcttttcttcctgcttttctctctctccccctatttttttctctayctcccttcactctccctttcccactctattgttttttctggaaattcaagaaaatagcgagtgagggaaggaaaggcctagagacttaaaatttaaaaaaagaatcacttagaaaaggaaggtggcaaaggccagcagggaatatccaaagaaagtctccccaagatgtgccagctgagggcagagaaggactggcactggcccccaggactctggcccatctcctccagacaccaagtctgagtagcacttggggctgacgataggaaaagcaaatgttccaggttttggaacagacct

SEQ ID NO: 109907 - DNA, 601 bp, Human
cagcactggggcttgtgcgcccctagggtgctgtacgagcctcgtgagctgatgtgctttactaaagccatctccaacaagtgagggcggagtaactgttctcatttgagggcctttaaaggtgtttgtcttagatcctcccagactcagcaaagaacaccccaaataccagggcagggtcagcccaggcagacaaggctattcctatgagaggcactttggtgaaggtaggggagggcagggacagggatgtcacttattgagtgcttgctaagtgctgggggctttccttacatcatcygccaagtcgaggcagggtaggcggcctgctttaacctaagtagtctccattttttagataagaaaactaaactgaagcttagacaaccttgtcaatgggcaagggtttgctcagtaacttagagtaccatctcctccttggggggcaaaactgcctccagttattttataaaaatgagcattacaaggaaccccccaaattcctggtatctttcctaagaatgattctctcagcctctctctcagagtctgcctctttcttttcttcctgcttttctctctctccccctatttttttctc

SEQ ID NO: 109908 - DNA, 601 bp, Human
tgggtcaaaccacagtcccaagggcaagccacactgtgaccactctgctcttcctgtgcacccttaggatgagccagctccaggaggggcagcactggggcttgtgcgcccctagggtgctgtacgagcctcgtgagctgatgtgctttactaaagccatctccaacaagtgagggcggagtaactgttctcatttgagggcctttaaaggtgtttgtcttagatcctcccagactcagcaaagaacaccccaaataccagggcagggtcagcccaggcagacaaggctattcctatgagmggcactttggtgaaggtaggggagggcagggacagggatgtcacttattgagtgcttgctaagtgctgggggctttccttacatcatccgccaagtcgaggcagggtaggcggcctgctttaacctaagtagtctccattttttagataagaaaactaaactgaagcttagacaaccttgtcaatgggcaagggtttgctcagtaacttagagtaccatctcctccttggggggcaaaactgcctccagttattttataaaaatgagcattacaaggaaccccccaaattcctggtatct

SEQ ID NO: 109909 - DNA, 601 bp, Human
gtgggtcaaaccacagtcccaagggcaagccacactgtgaccactctgctcttcctgtgcacccttaggatgagccagctccaggaggggcagcactggggcttgtgcgcccctagggtgctgtacgagcctcgtgagctgatgtgctttactaaagccatctccaacaagtgagggcggagtaactgttctcatttgagggcctttaaaggtgtttgtcttagatcctcccagactcagcaaagaacaccccaaataccagggcagggtcagcccaggcagacaaggctattcctatgaraggcactttggtgaaggtaggggagggcagggacagggatgtcacttattgagtgcttgctaagtgctgggggctttccttacatcatccgccaagtcgaggcagggtaggcggcctgctttaacctaagtagtctccattttttagataagaaaactaaactgaagcttagacaaccttgtcaatgggcaagggtttgctcagtaacttagagtaccatctcctccttggggggcaaaactgcctccagttattttataaaaatgagcattacaaggaaccccccaaattcctggtatc

SEQ ID NO: 109910 - DNA, 601 bp, Human
gggaggagtgggtcaaaccacagtcccaagggcaagccacactgtgaccactctgctcttcctgtgcacccttaggatgagccagctccaggaggggcagcactggggcttgtgcgcccctagggtgctgtacgagcctcgtgagctgatgtgctttactaaagccatctccaacaagtgagggcggagtaactgttctcatttgagggcctttaaaggtgtttgtcttagatcctcccagactcagcaaagaacaccccaaataccagggcagggtcagcccaggcagacaaggctattmctatgagaggcactttggtgaaggtaggggagggcagggacagggatgtcacttattgagtgcttgctaagtgctgggggctttccttacatcatccgccaagtcgaggcagggtaggcggcctgctttaacctaagtagtctccattttttagataagaaaactaaactgaagcttagacaaccttgtcaatgggcaagggtttgctcagtaacttagagtaccatctcctccttggggggcaaaactgcctccagttattttataaaaatgagcattacaaggaaccccccaaattcc

SEQ ID NO: 109911 - DNA, 601 bp, Human
agttcgaggttctttgcgcagggtgctgtcctgcccccaccacccaggaagttcaatgtgcaccatgtgcagaacgggttcctcttccactggcatatttggcagctttgtagcttgtcacaggttttctgataggggatgtgattcacacttgagacctaagtggacagggaggagtgggtcaaaccacagtcccaagggcaagccacactgtgaccactctgctcttcctgtgcacccttaggatgagccagctccaggaggggcagcactggggcttgtgcgcccctagggtgctgtrcgagcctcgtgagctgatgtgctttactaaagccatctccaacaagtgagggcggagtaactgttctcatttgagggcctttaaaggtgtttgtcttagatcctcccagactcagcaaagaacaccccaaataccagggcagggtcagcccaggcagacaaggctattcctatgagaggcactttggtgaaggtaggggagggcagggacagggatgtcacttattgagtgcttgctaagtgctgggggctttccttacatcatccgccaagtcgaggcagggtaggcggcctgctttaa

SEQ ID NO: 109912 - DNA, 601 bp, Human
caagcatttaattcaagttcgaggttctttgcgcagggtgctgtcctgcccccaccacccaggaagttcaatgtgcaccatgtgcagaacgggttcctcttccactggcatatttggcagctttgtagcttgtcacaggttttctgataggggatgtgattcacacttgagacctaagtggacagggaggagtgggtcaaaccacagtcccaagggcaagccacactgtgaccactctgctcttcctgtgcacccttaggatgagccagctccaggaggggcagcactggggcttgtgcgyccctagggtgctgtacgagcctcgtgagctgatgtgctttactaaagccatctccaacaagtgagggcggagtaactgttctcatttgagggcctttaaaggtgtttgtcttagatcctcccagactcagcaaagaacaccccaaataccagggcagggtcagcccaggcagacaaggctattcctatgagaggcactttggtgaaggtaggggagggcagggacagggatgtcacttattgagtgcttgctaagtgctgggggctttccttacatcatccgccaagtcgaggcagggta

SEQ ID NO: 109913 - DNA, 601 bp, Human
tcctccccgcaccccccccaccatataaccaaacttcttaaaaacaagcatttaattcaagttcgaggttctttgcgcagggtgctgtcctgcccccaccacccaggaagttcaatgtgcaccatgtgcagaacgggttcctcttccactggcatatttggcagctttgtagcttgtcacaggttttctgataggggatgtgattcacacttgagacctaagtggacagggaggagtgggtcaaaccacagtcccaagggcaagccacactgtgaccactctgctcttcctgtgcaccctkaggatgagccagctccaggaggggcagcactggggcttgtgcgcccctagggtgctgtacgagcctcgtgagctgatgtgctttactaaagccatctccaacaagtgagggcggagtaactgttctcatttgagggcctttaaaggtgtttgtcttagatcctcccagactcagcaaagaacaccccaaataccagggcagggtcagcccaggcagacaaggctattcctatgagaggcactttggtgaaggtaggggagggcagggacagggatgtcacttattgagtgcttgctaagt

SEQ ID NO: 109914 - DNA, 601 bp, Human
ccaggttaatacacaaagatggatatcagaaaatcacacgcacatgccaaagctgagggacaaatctaactctatgcctcctggcagtcttagcaaggatgtataaggttcattagataggaatatatatacttgttctgcacaagctggacaggctcagctttccctaagtctgtggttggagagcaacggtcagagagcaacttctcttcttctgcgggtgtttttgaaggggacttcatgtgctgtggtggatgacatcctgaacaatttcccaaagaagcatctgcccgtgtaaacmatcagttctttcacttcacacagctcactaagaagccagaagagtccaagctgtgaagaagctccatgcaacagtaacagtgatggcagatgacatgtggtggtctcgctctgtgtattcagagaccagagtggaaacaagcctgaggcttagagtgcaagttcctggtcctccataattccacctgtctgcctcagcccaaagggcagagaggatgaagggagcttgatgctagtggattatcattagaaggttgtttattaaaaaaaacccttttcctgactacaaccatgatacatt

SEQ ID NO: 109915 - DNA, 601 bp, Human
agattgggacaaaggaaagtaagggtaaggagcagcaatgagcaaaacaggcaccaggttaatacacaaagatggatatcagaaaatcacacgcacatgccaaagctgagggacaaatctaactctatgcctcctggcagtcttagcaaggatgtataaggttcattagataggaatatatatacttgttctgcacaagctggacaggctcagctttccctaagtctgtggttggagagcaacggtcagagagcaacttctcttcttctgcgggtgtttttgaaggggacttcatgtgctrtggtggatgacatcctgaacaatttcccaaagaagcatctgcccgtgtaaaccatcagttctttcacttcacacagctcactaagaagccagaagagtccaagctgtgaagaagctccatgcaacagtaacagtgatggcagatgacatgtggtggtctcgctctgtgtattcagagaccagagtggaaacaagcctgaggcttagagtgcaagttcctggtcctccataattccacctgtctgcctcagcccaaagggcagagaggatgaagggagcttgatgctagtggattatcatt

SEQ ID NO: 109916 - DNA, 601 bp, Human
tgaatgaatatccacgtgataaaaccactacagtaagtaatccccccatacattcagtgaggtataactaaaagtccaagtgtcccctttagcccttaatgacagttactgtctttcacacatgaggacaagcagagaagcccaaagccaggtggagatatcgacctggggctgctggaccctcctctgagcaggagtctgcaggactgctgggtccagttgcctgggctggttacagtcacctgcatgtgcttggcttgagtggttgaggaacaggcccagtcactggctaacagtagaygctggatgctgaattgagacaggaagggtctgctgtagtttgcataactggcttctctgtgctcactgaacttgtcaaggaacaaacacagagagatgaaggggctagactctagaggccaatgcaggccggcaaggcagcaaaacttcatctgtacttacagccacttcccattgctcacgttagctccgcctcctgtcagtttagcagtggcattagattctcataggagcgggaaacctattgtgaactgtgcatgtgagggatctaggctgtgtacttcttatgagaatctaatac

SEQ ID NO: 109917 - DNA, 601 bp, Human
gagtgtggggggagtgttctccccccatacccttttgggggagggtgttgggggagaacattagggaaaagaactaatgcatgctgggcttaatacctaggtgatggattgttatgtgcagcaaaccaccatggcacatgtttacctatgtaacgaacctgcacatcctgcacatgtaccctggaacttaaaaaaattaaataattttaaaaaaaagattacttaaagcaagaaacccatatgagagcagcacagtcagtgttgggaaattcttttctctttcccataatggggagagagraaaaagagcagagtaggggctgagatgggtcctactcagagccctagtaccatgactctcacgagcttggggtggtcaccaaacctctcagggttttccatccctggctttcagacaggaataaaaatagccagccaattcaggagcaccgtcatgcacaacagacctgctgaccaggcagcactttgggcttatttttttccactcccattttgtccaaagtaaatttgaggcatggtatgtagctatttcaagacagctccatcgatatagtctccactgcttctttcaacaggtcct

SEQ ID NO: 109918 - DNA, 601 bp, Human
gacgggcgactgtagtcccagctacttgggaggctgaggcaggagaatggcgagaaccccggggggcggagcctgcagtgagccgagattgtgccactgcactctgcactccagcctgggcgacagcaagactctgtctcaaaaaaaaccaaaaaaacaaacaaacaaaaaaaccaaaaaaacccaacacaaatagaaattagacatgaaggagtctgggaaggacatacactaagatggtagcagggcttctcttggtaggattaggagtgataaggctataaagattacttagagtcccattactgggtatatacccaaaggaatataaatcattctatgataaagatacacacatgcgtctgttcgtggcaggcctattcacaatggtaaagacatggaaccaacccaaatgcccatcaatgacagactgggtaaagaaaatgtaatacatatacaccatggaatactatgcagccataaaaaggaatgagatcatgtcctttgcagggacatggatgaagctggaagccattatcctcagcaaactaacgcaggaagagaaaaaccaaacactgcatgttctcacttataagtggga

SEQ ID NO: 109919 - DNA, 601 bp, Human
atcttctggtgcctagtattattaattattatttctaaataactttcagcattttaaaggtttaatgttaaaatggtttaagcatggcttgcaaaacttatttgagatttatgtataaggaattcaaagtttttaatatataatatcatgccaatcctgcttatgttttatttttttcaactagaaaaacatttttttatttggtttgtaaggatcttactaatctaatgggactcatgattttcattcttttgctataacacaataattagaatctgttttatttccctatacatgaaayacttactattcccaaatatagtataaattactacctttggaatttaagatacttaaaagtgaaatatcttggtctggcctatgttagttgctcatattctagaaaataatggaggaaactaaaaaagaaattttttttcaaaatgttttctaacactatagctaattttagaatttgtttaaggtaaaagaaatgttagtatatggtagtgaaatagtagacatagactctctcccaacttttattttctgagagaagtaaattatttcgtcaaagttgggggaggaagaggaatagaag

SEQ ID NO: 109920 - DNA, 601 bp, Human
ttagtgataccactaaatgtgactatttaattagacatttttattttgctgtgatatcctcacactgcttaccaggtgattacctttgaaattgcctagccatgccaattcaattaaactggataggataataggagtgaaaatgttttgcaaatgacaaaatctttgcaatcatttgctaatattactaattctcatattccatgaatttagagttgaatacttctatcctaacacatgtacttctaaatgtgtttgaagtttgagtcttactaacttatgtagaattcacatatttttyggccgggcacggtgactcacgcctgtaatcccagcactttgggaggccgaggcagacagatcacaaggtcaggagtttgagaccagcctgaccaacatggtgaaacccccgtctctactaaaaataaaaaattagccgggcatggtggcacgtgcctgtaatcccagctactcaggaggctgaagaaggagaatcgcttgaacccgggagacggaggttgcagtgagccgagatatttttcacacaaaaaccttaaatattacagtgcagtggttagcaactctgaaagtttgtttgttt

SEQ ID NO: 109921 - DNA, 601 bp, Human
atgacaaaatctttgcaatcatttgctaatattactaattctcatattccatgaatttagagttgaatacttctatcctaacacatgtacttctaaatgtgtttgaagtttgagtcttactaacttatgtagaattcacatatttttcggccgggcacggtgactcacgcctgtaatcccagcactttgggaggccgaggcagacagatcacaaggtcaggagtttgagaccagcctgaccaacatggtgaaacccccgtctctactaaaaataaaaaattagccgggcatggtggcacgygcctgtaatcccagctactcaggaggctgaagaaggagaatcgcttgaacccgggagacggaggttgcagtgagccgagatatttttcacacaaaaaccttaaatattacagtgcagtggttagcaactctgaaagtttgtttgtttctaacaaccaccacctgttaaaggcatgatttaatctctttaagactcagagtagataattacagtaccaagctcatgcctgtccaggatcttatcatgccttatcatctctacctatatcattcacatccactgtctctcatgtttactact

SEQ ID NO: 109922 - DNA, 601 bp, Human
ttctacagtctattgttcacatggaagtcagaattatcttttaaaaacatcttaatcaattgatatgactctcctatgcagaatccaccaatgactgcctgtaatagtcaaaaataaagcccacactcctacaatggccaacaagatgctacatatactggcatcttctacctacatcatctcgacatgatctcctctcatggagggcagagactatgatgttcagagctgtattaccagcccctagaactaccacctatcctggtggatggaccctcacttgctgaagggatgactaggkatgcaagggttaccatggaacaatgtaggtagatgctctgcacacagagtacctttaatgcagaacagtgatagtcgttgcccttttaaggattcctttggtttgtttcaacagaggccatcacatctgcaatgctaaagcactttcatgtttttgactcatgattttatagcattatgagaaactttacttagctgatttataattgcaagccataatgtataataccaaaagaaagaaaaatgcacatagacaaatcaggaactaattagctggatgagaaagccagttgaagagcag

SEQ ID NO: 109923 - DNA, 601 bp, Human
tctcaagtgtgctttctcatgaatgccagcttcaagcagtatattaatttttaatgacctgagctgcttagctaataagctgtgatcaatggaatagaccaggtggtgcatatatagttgccaggatcctatacctatgggtgggaagagggaagaataatcagtgaaatggagtctcaaaagctattaaaaatctcatggtacagtttatttataccctaagtcttcccttccacaaaattcccctttattgaattttattgttgtataaagagccaaagagtaggatgttaagagattrgaagagcagggagtatagccagcctccaagggaaagacaaatggataaaggacttcttgactgtggtttttgtgtaattgatactttagggagtgttcactacatactattttttccttcttcttcacatacttaggtatattttatggttgtcaactcatgaaaaccctattactgatcaagggtcttccatattggttggtgctcagaaactgaggatgtttataagcccttaaaagtcttattcaagctctccttgtcccttgagctagaaagtagcatttttcaagattgaaggga

SEQ ID NO: 109924 - DNA, 601 bp, Human
cctaccttgttcaagtctctgttctataaagcatgagaaatccaagtaagggattgtgtagaagcatgaaactgcaacatgtgttaaaagaaacagcaagtccattttaattggattatgtaaggtagtagactgagttgagtcaaaaggggtaaattgaaataggactgtggagatgctataaaacctaacctaggggcatgcactttattcattagatagtggggattccgtgggcaacacggtttctggcagagcaatgatgtgatcaaacttgagttaggaagtttgattacactgrcaaagatatgtagaatgaattagacagtagattctgaagcaaaagaaaattggaggtttgcatcactaatatgtatttacaccttcaatatgtggcagtggacaagaaagtgagtggaaaagaaacctgtagctgaggataacagtcaggactggaattatggactaggtactcatctacatatccagtatctgaactatttggagtgaagggccatggagaagagaataatgccagaaaagagcaaagaacattagggaacattcacattggtggggagaagtggagaaacagagaaaa

SEQ ID NO: 109925 - DNA, 601 bp, Human
ggcaccagattctgaagtatctcagaaatctgagccatcctcttcctcactcttactctctcagcccagggcgtctaccagaacctttcagtggcctttgattagtttccctcttcctgaaattctttataaactgactctcctccatgctgtcactgtgtaattttcagtgtatatcagatcatttctttttcctacttcaaattttcctacagtctaaagctccaaacatattaaatgccatttagaacacgtcaaagcagctgtttctggacaatctccagtctttcctttctactcrattgccttttcttcattctaacctcagcaggtgacttgtacttcctcaatttaattatttatttttgtatgccacgtttctctcatgttacaatcacctttgttatttccgttactcctgtctaaatacccgtgttccccttgtctgccttccaaaagcctatgtctgttcaattcaaatgccattccttctatgaagctttttctccagtcctaaaaaagtggtattaattgtgcctttaggcaataaggggcatctggtagccttttaaatgtatctgcactatagaaaaatcatctt

SEQ ID NO: 109926 - DNA, 601 bp, Human
agcctatgtctgttcaattcaaatgccattccttctatgaagctttttctccagtcctaaaaaagtggtattaattgtgcctttaggcaataaggggcatctggtagccttttaaatgtatctgcactatagaaaaatcatcttggcgtgtcattattcccatccagttggtgaagtctcaaaggcaaaagtttcaccgcttccaaaaccatgttattcgattttaaacaaaacaatacttaataaattgttgttaatagttgttactaagttatgagtaaaataatgagtacgtgataartaaatggattaaagaggtgaaaagaaataaactgtagccttgagatagatttacaaaatagattttatggtgatggttactgtttgtcatcctttcgtgtggtagggaagggggtttgttttgggtaggaaaaaagactaggtttgtagtcagaaagcaagaaaaggaggaagaatgagctggaattgtgagaccatgaagggatatatgacaaaattttggaggaggcaggaaaagatacgttaaagagcaaataaattaacaaaataagggccacccattcctctaaagaaaggtgac

SEQ ID NO: 109927 - DNA, 601 bp, Human
ccatgttattcgattttaaacaaaacaatacttaataaattgttgttaatagttgttactaagttatgagtaaaataatgagtacgtgataagtaaatggattaaagaggtgaaaagaaataaactgtagccttgagatagatttacaaaatagattttatggtgatggttactgtttgtcatcctttcgtgtggtagggaagggggtttgttttgggtaggaaaaaagactaggtttgtagtcagaaagcaagaaaaggaggaagaatgagctggaattgtgagaccatgaagggatatwtgacaaaattttggaggaggcaggaaaagatacgttaaagagcaaataaattaacaaaataagggccacccattcctctaaagaaaggtgacgacaatgagggcaaatgaagagggcctagagagacaagacatagaccctttgcagggcttctgttttttaccatctcaggaaaaggagggctttcactctgcttttggcaaacatcaagctgtcctaagattccctgaatgtgtttgcacattctgtctgcacattggccagaaagcagatgttacaaaaggaccaacccagaagctg

SEQ ID NO: 109928 - DNA, 601 bp, Human
gagtcatttacaaccattgtgaacagagctctaggaaagatccagtagtaatcaatcctgaataaaaagcaaagggccaacacaatcaaaaaagacctttctctaacacagacagactgctgtggcactagaaagttcttcctactggcctactgggaagcagtgtgtaagcctttttgttttgagcctgtgtgttcctttttggcatgtgtttacaattggagtgagtcctgtttttggagtgtgagaattcaagagagaactttattttaaaagcaagggggattgaaaattatagtayaatataatgttatatacgtatatattatatatatatatatacacacacacacacttataagcaacagaattgaaaatataacagcgtaatacattgcatatgcacactgatatataatatccatatacatacatctatggattatttaaatatacactgtaagatttgactgaaacatgaggacagggaaattcttcattgaaatactatagggaagtaacataccaatgtatatttttaatgtaattttctcatggcagagctgagtaactgtattacatagttcaaaatatttgtaca

SEQ ID NO: 109929 - DNA, 601 bp, Human
gtgaacagagctctaggaaagatccagtagtaatcaatcctgaataaaaagcaaagggccaacacaatcaaaaaagacctttctctaacacagacagactgctgtggcactagaaagttcttcctactggcctactgggaagcagtgtgtaagcctttttgttttgagcctgtgtgttcctttttggcatgtgtttacaattggagtgagtcctgtttttggagtgtgagaattcaagagagaactttattttaaaagcaagggggattgaaaattatagtacaatataatgttatatacrtatatattatatatatatatatacacacacacacacttataagcaacagaattgaaaatataacagcgtaatacattgcatatgcacactgatatataatatccatatacatacatctatggattatttaaatatacactgtaagatttgactgaaacatgaggacagggaaattcttcattgaaatactatagggaagtaacataccaatgtatatttttaatgtaattttctcatggcagagctgagtaactgtattacatagttcaaaatatttgtacatggaaatcacacagaaaa

SEQ ID NO: 109930 - DNA, 601 bp, Human
gagctctaggaaagatccagtagtaatcaatcctgaataaaaagcaaagggccaacacaatcaaaaaagacctttctctaacacagacagactgctgtggcactagaaagttcttcctactggcctactgggaagcagtgtgtaagcctttttgttttgagcctgtgtgttcctttttggcatgtgtttacaattggagtgagtcctgtttttggagtgtgagaattcaagagagaactttattttaaaagcaagggggattgaaaattatagtacaatataatgttatatacgtatatattatatatatatatatacacacacacacacttataagcaacagaattgaaaatataacagcgtaatacattgcatatgcacactgatatataatatccatatacatacatctatggattatttaaatatacactgtaagatttgactgaaacatgaggacagggaaattcttcattgaaatactatagggaagtaacataccaatgtatatttttaatgtaattttctcatggcagagctgagtaactgtattacatagttcaaaatatttgtacatggaaatcacacagaaaaacattct

SEQ ID NO: 109931 - DNA, 601 bp, Human
gctctaggaaagatccagtagtaatcaatcctgaataaaaagcaaagggccaacacaatcaaaaaagacctttctctaacacagacagactgctgtggcactagaaagttcttcctactggcctactgggaagcagtgtgtaagcctttttgttttgagcctgtgtgttcctttttggcatgtgtttacaattggagtgagtcctgtttttggagtgtgagaattcaagagagaactttattttaaaagcaagggggattgaaaattatagtacaatataatgttatatacgtatatattatatatatatatatacacacacacacacttataagcaacagaattgaaaatataacagcgtaatacattgcatatgcacactgatatataatatccatatacatacatctatggattatttaaatatacactgtaagatttgactgaaacatgaggacagggaaattcttcattgaaatactatagggaagtaacataccaatgtatatttttaatgtaattttctcatggcagagctgagtaactgtattacatagttcaaaatatttgtacatggaaatcacacagaaaaacattctaa

SEQ ID NO: 109932 - DNA, 601 bp, Human
actccagcctgggcaatagactgagactgtgtcttgatgagataagacaagataaggtgagaggagataaggtaaaataaaataaggtaagatgagataagataggatgagatgagataagataagatgaggtgacataagataagataggaaaagaaaagaaaaatgggagcgatcagtccacagtggcccttttaaggatgctgttaccagtaatacttctaacctaaccatcagcctcactggtccctttttctcctcacttactacagtgattaaaatataaaattgctatcctttrttattgtgatggttatgatgaaatgttaaacatatgttaggtttaatagaagattaatttttgaataccagtgcattaaaaaattaatgtctccttaaactttttgtgatttttctaaaatttgttttattttaatattaacttaatcttttttgtgttcttaataatttttttaaattcactcttggctaggtcctatttacctaacttgcatatgatgggtctatttttatatctaagtattttgcctacaggcccaccacataatattgccacatctattaagacttttccaaataa

SEQ ID NO: 109933 - DNA, 601 bp, Human
gataggatgagatgagataagataagatgaggtgacataagataagataggaaaagaaaagaaaaatgggagcgatcagtccacagtggcccttttaaggatgctgttaccagtaatacttctaacctaaccatcagcctcactggtccctttttctcctcacttactacagtgattaaaatataaaattgctatcctttgttattgtgatggttatgatgaaatgttaaacatatgttaggtttaatagaagattaatttttgaataccagtgcattaaaaaattaatgtctccttaaastttttgtgatttttctaaaatttgttttattttaatattaacttaatcttttttgtgttcttaataatttttttaaattcactcttggctaggtcctatttacctaacttgcatatgatgggtctatttttatatctaagtattttgcctacaggcccaccacataatattgccacatctattaagacttttccaaataagattggaatatttgtctttgcagaaaaattaattattgtggcaatttaagtacttgaatattttttctagctcaattttttaacgtctcataaatgtaaa

SEQ ID NO: 109934 - DNA, 601 bp, Human
ccaactcaactgatatcatgaataaggctactttcaacttagaattcctctgaatcacaattacagctgcagtgggcacagcacaacacaagcagcctgccccaaatccacccctagaaaaaaagaaagaagagaaatgactctgctttatatgactcatacgttacttatatatgactaatatttacctttccctggagaaaaactagtatttaacataattaactagatcgttgatgctccacagatgtagtaggttagtatactttaaaatgcatgtaatacaaatgttttgcatccrtccatttttctttttaaatatgtatgactcagaaggtttttactcatgtagtacctattttatcctctattattgcatttactgtgttataatgtatgttttttcaaacacatctgcctttctgaatacagtgtaagcagtttatggtcagagtctatatcttaatcatcatcattttcctaatgcctaacagcattcctgatataaacctggtattcaatcaatgatcattgaataagatactagaaaccaacataaattaatcgatggattgataatgatcttaaaattaaatgaagg

SEQ ID NO: 109935 - DNA, 601 bp, Human
tagataaatactgtaattcatgaaacagtctgttaagtttattagactgtattaatttgaggattaggttttgttttaattaattaatttttttgaacatagaatctagccccttgtttcagtcccactcacactgccatagctcaggcccagttcctttcaaacaactgtctctgagaaatgtttctatccttagccatgtcttcttccaatttactttccataccactgctggatcaatcatcctaaaaaccaagctcgagtgtaccattttcttttctccatctttcatgggcatccmtggccttcaggacagagtgcaggcatggctcaccacatccctttacaattctgccattgcctggccatcgacctcatttccacacttcccacttcacttctgttccatagtgaacaattttgtgccttacatgaggtttttttttttggttgttaatgttgttcatttatttagcaagcatttgttgtggagcctactctgtgccacacactgtacttggtgctggaggtcagagatgaattaaacacagcccttcctccaggagctcacagccttgtgagggagacatagagtagagag

SEQ ID NO: 109936 - DNA, 601 bp, Human
agaaatgtttctatccttagccatgtcttcttccaatttactttccataccactgctggatcaatcatcctaaaaaccaagctcgagtgtaccattttcttttctccatctttcatgggcatccctggccttcaggacagagtgcaggcatggctcaccacatccctttacaattctgccattgcctggccatcgacctcatttccacacttcccacttcacttctgttccatagtgaacaattttgtgccttacatgaggtttttttttttggttgttaatgttgttcatttatttagcragcatttgttgtggagcctactctgtgccacacactgtacttggtgctggaggtcagagatgaattaaacacagcccttcctccaggagctcacagccttgtgagggagacatagagtagagaggaacctctgacccagagtgagggctggagttatggagatgccagaagatgctcattttggtatctttctagaaagtgttgcctagcccaagtctcaaaaacaaacaaaacaaaaacaaaaatgtaggatttggtcatctaggctctttcttcctagaaagcttcttgtcctttctt

SEQ ID NO: 109937 - DNA, 601 bp, Human
gagtgagggctggagttatggagatgccagaagatgctcattttggtatctttctagaaagtgttgcctagcccaagtctcaaaaacaaacaaaacaaaaacaaaaatgtaggatttggtcatctaggctctttcttcctagaaagcttcttgtcctttctttgactacctcctacttgtcctttaaaccctcttccaggcagtgttgattggcttcctagtgtggcaagagatgttgacgtacctccacaacttcccgtccttatcaccatcacagcatgtaccacactgtattattgtyattggtttgtctgtcacctccttcaacatgagggctatatatttttttctagtattcccagtgtgttcctactacttgatacacagaagcctgtccattaattttttaaatacagttacaaaataattaattgcttaatgcattaaaatttgtaatcttagagttggacaacatcttagtagtcatacattccagcctcccatcagtcaaaaccagaattgattctgtaatgttcataacaggatggtcattcaggttttgcttgcttgaacacgttcactgataaggaatgcaatcagg

SEQ ID NO: 109938 - DNA, 601 bp, Human
tcatctaggctctttcttcctagaaagcttcttgtcctttctttgactacctcctacttgtcctttaaaccctcttccaggcagtgttgattggcttcctagtgtggcaagagatgttgacgtacctccacaacttcccgtccttatcaccatcacagcatgtaccacactgtattattgttattggtttgtctgtcacctccttcaacatgagggctatatatttttttctagtattcccagtgtgttcctactacttgatacacagaagcctgtccattaattttttaaatacagttamaaaataattaattgcttaatgcattaaaatttgtaatcttagagttggacaacatcttagtagtcatacattccagcctcccatcagtcaaaaccagaattgattctgtaatgttcataacaggatggtcattcaggttttgcttgcttgaacacgttcactgataaggaatgcaatcaggttcaaagaaatgcaaaaaaaaaaaaaaatactatgactatgctgtaaatctgtttacacttatatttggaatgtgattttaatttgaacacgttagagacagagctttagtcagatggc

SEQ ID NO: 109939 - DNA, 601 bp, Human
aagagatgttgacgtacctccacaacttcccgtccttatcaccatcacagcatgtaccacactgtattattgttattggtttgtctgtcacctccttcaacatgagggctatatatttttttctagtattcccagtgtgttcctactacttgatacacagaagcctgtccattaattttttaaatacagttacaaaataattaattgcttaatgcattaaaatttgtaatcttagagttggacaacatcttagtagtcatacattccagcctcccatcagtcaaaaccagaattgattctrtaatgttcataacaggatggtcattcaggttttgcttgcttgaacacgttcactgataaggaatgcaatcaggttcaaagaaatgcaaaaaaaaaaaaaaatactatgactatgctgtaaatctgtttacacttatatttggaatgtgattttaatttgaacacgttagagacagagctttagtcagatggcttgcatttgtggagaaacaattgttcatcagaagataaagggactgagcagatcccataaagagaagggcacacaacaaatggtatcctgcttataattctccaggac

SEQ ID NO: 109940 - DNA, 601 bp, Human
catcatgtccaagtttacgtatctagtaagcggtagacccaggattcacccctatttttctgattgaaaatctgttacttattccacaatatctccagtacctaaatgcaagtccttaattccttaattaaatatcactggtaggggtggggggacttaaaaaaaagaaaaaaaaattactggtagagactaaagctctaaagcattttaaatattgtttatatctaatatacaggagctatttattagtcctctgatataataaaaaataggctcagaaatagtatacagctgtgaagcrtaagttgtatatcatggtcacataaagacaattgcccagtttcatatggtaggttgttaccaatcgagcaggtttacaaagttagtgttgttatctggagtggattctctttttagctctaaccctattccaccagtctcactgctttgtgaaacagcaagcaatggaacggatgttgggatttgacttctccttccagatctctctggaagtgtctaatttggttaaataattgtatctattcttggtttttcagtgtgggtcaaaccatgtactgaatcctattgctgaaaattttca

SEQ ID NO: 109941 - DNA, 601 bp, Human
tgcctgtaatcccagtgttttggaaggctgaggcagaggaattgcttgaggccaggattccaggcaacataacaagacccatctcttggtggtggatgggggggattagctggctatagtgatgtgcacttataatcttagctactcaggaggctgaggcttgcttgagcccaggtgtttgagactgcagcgagctatgattgtgtctccgcattccagcctgagtgacagtgtgagaccctgtctttgaaaaaaaaaaaaaagaaagaaaaagaagaaaacacaaaataataacaagtartaggtaacatttcttaagcccttccaacttgtctgaacttatactttatttgtactatctatttctagcaataacctaatgttatctgtgcctatgatcatttgaaattacgtgttatgcacccaccagctctcttctttctaattgtttattagtcatggtatgtgatgaagaatgatgagtcatccttataggtattttacaatcagcctgaaataaagcagggaagatatgaaacaaatatctggattttcagcatatctttttcatgttatcaagaaccttttcctctgtttttct

SEQ ID NO: 109942 - DNA, 601 bp, Human
gtattttacaatcagcctgaaataaagcagggaagatatgaaacaaatatctggattttcagcatatctttttcatgttatcaagaaccttttcctctgtttttcttagaagacaaagagggagaatatagagttgcaggcagcttattaacaaatgtttaagcttagaacttctcagcatttataagcaaaaatatggattctgcataaacttctaataccattaaggaccaaaacaaaagtttctattttgtgatactgatatgcatagtaacagtataaagcataattgagcctacayggaaaagagaaacaatatttatgtgcttaattgtattacacaactggtcattttagccttttgttcatctgtggatatgtagcagcacaaaattataaaaccaatgtttttgattgaactggcacattacatgatgatagggcagaacacatagaaaacattctagaactgtctgtgccgaacacattattaaaatggagacatgcctatctggcacatagtgtatttttcctttagattttccaagactttattgtttctccttttgccaatttttgagagtagttagtgctgcctggt

SEQ ID NO: 109943 - DNA, 601 bp, Human
aactggcacattacatgatgatagggcagaacacatagaaaacattctagaactgtctgtgccgaacacattattaaaatggagacatgcctatctggcacatagtgtatttttcctttagattttccaagactttattgtttctccttttgccaatttttgagagtagttagtgctgcctggtaataactatcatcagtaagtattcctgtgctttgtgatctttctaatattgtaatccaaagaaaaccagtgaggtttgtgattatgtgggaatcccaggagggaaagttctattctwcttaatgatattttcagcacacatgtctcagtgatctagatactaaataattcaattacttctttgagagctttacaaattcagcgttatctaccacacatttgcaccctgcttattaccccacatccacctccaaaatgatctaatggtaaagaaaattgtaactcaatttgagatattttaatcaagtgtacttctatcacaaaccattaatgaatgctaaggggtgtttaaagtaaatgttcgaaagacgatttgaaaatgccagggactgcccattgttttcataatgtgaagtag

SEQ ID NO: 109944 - DNA, 601 bp, Human
catgcctatctggcacatagtgtatttttcctttagattttccaagactttattgtttctccttttgccaatttttgagagtagttagtgctgcctggtaataactatcatcagtaagtattcctgtgctttgtgatctttctaatattgtaatccaaagaaaaccagtgaggtttgtgattatgtgggaatcccaggagggaaagttctattctacttaatgatattttcagcacacatgtctcagtgatctagatactaaataattcaattacttctttgagagctttacaaattcagmgttatctaccacacatttgcaccctgcttattaccccacatccacctccaaaatgatctaatggtaaagaaaattgtaactcaatttgagatattttaatcaagtgtacttctatcacaaaccattaatgaatgctaaggggtgtttaaagtaaatgttcgaaagacgatttgaaaatgccagggactgcccattgttttcataatgtgaagtagatttttttttaaccatggacaattggtaattttaaacattcttggaagatactacaagtaggattaggcacaacagagcactgcc

SEQ ID NO: 109945 - DNA, 601 bp, Human
aacatagttgccttaacccttcacttcagttagtctatagggatgttccatgtgtgtatttttatcactcctcattcttttctgaggtcctatgcagcaagcttggctgaaagcactagtcttcaaatgtcaatgtatcagagtcaccctattgagcttgttaaaatatcaatttgcaagtcccacattgagaaattctaatttgttaaacctgtgttggagctaattgactgaaaacactgtaagacacactggaatggatgatcaccaaagatcacttcagttttatgattttaaaacrttttctccaatggattgaagtagtttatcttaaaagtatttctaaacctttatatcatgtggtttctattatgattactagacctctatcaccccatttatacagatttagaaatgtttttactagaccctattcgtgtccagtagtttgttttacttggtgttatttttcatatgcaccggagcatatgaaatggagttagaacttgaattccatacttctaccatgacagccctgaaaattagattcaaaactattcccctcttaacccaatttgctatatagtgttggccaaacatc

SEQ ID NO: 109946 - DNA, 601 bp, Human
ggtaggtaattgattaattaatattcattcaacattgaatacatatttgaaagctgggaggtggaggttgcagtgagccaagatggaaccactgcactctagcctgggcaacgacgtgggaccctgtctcaaaaaaaaaaaaaaaaaaaaagacaatgaaaatgaaagccaaagtatgaccaaaggctgttttgatagttttttatattgctatcatggtttggttatgcacaccatactttcaaataaccccttttagacttcgaagaaaaggtatggaaaacttcaaaattttaaatgrgtagaaatgagaaaattgtttcttttttagtaaaatgtatttctgatttgcatccttagtcctggagttatccagagaaaataaattcaaaattcatcaatagctcagactgatggcagagttgtcagggacatttttttctgtgtgtttctgcttacttcttatttctttcctttaaatagtctgggaaatatgacagctgtactttattttcttgtgtctgcaagccctcagggcatatgtgctcaggaactactttttgttacacttaaataagtatgtctatttgccacttgctct

SEQ ID NO: 109947 - DNA, 601 bp, Human
agctgggaggtggaggttgcagtgagccaagatggaaccactgcactctagcctgggcaacgacgtgggaccctgtctcaaaaaaaaaaaaaaaaaaaaagacaatgaaaatgaaagccaaagtatgaccaaaggctgttttgatagttttttatattgctatcatggtttggttatgcacaccatactttcaaataaccccttttagacttcgaagaaaaggtatggaaaacttcaaaattttaaatgagtagaaatgagaaaattgtttcttttttagtaaaatgtatttctgatttgcatccttagtcctggagttatccagagaaaataaattcaaaattcatcaatagctcagactgatggcagagttgtcagggacatttttttctgtgtgtttctgcttacttcttatttctttcctttaaatagtctgggaaatatgacagctgtactttattttcttgtgtctgcaagccctcagggcatatgtgctcaggaactactttttgttacacttaaataagtatgtctatttgccacttgctctaaaaaacaaaatgcaggaaacatcagagtgtatcaaattatttttttccat

SEQ ID NO: 109948 - DNA, 601 bp, Human
gctgggaggtggaggttgcagtgagccaagatggaaccactgcactctagcctgggcaacgacgtgggaccctgtctcaaaaaaaaaaaaaaaaaaaaagacaatgaaaatgaaagccaaagtatgaccaaaggctgttttgatagttttttatattgctatcatggtttggttatgcacaccatactttcaaataaccccttttagacttcgaagaaaaggtatggaaaacttcaaaattttaaatgagtagaaatgagaaaattgtttcttttttagtaaaatgtatttctgatttgcmtccttagtcctggagttatccagagaaaataaattcaaaattcatcaatagctcagactgatggcagagttgtcagggacatttttttctgtgtgtttctgcttacttcttatttctttcctttaaatagtctgggaaatatgacagctgtactttattttcttgtgtctgcaagccctcagggcatatgtgctcaggaactactttttgttacacttaaataagtatgtctatttgccacttgctctaaaaaacaaaatgcaggaaacatcagagtgtatcaaattatttttttccatg

SEQ ID NO: 109949 - DNA, 601 bp, Human
ggctgttttgatagttttttatattgctatcatggtttggttatgcacaccatactttcaaataaccccttttagacttcgaagaaaaggtatggaaaacttcaaaattttaaatgagtagaaatgagaaaattgtttcttttttagtaaaatgtatttctgatttgcatccttagtcctggagttatccagagaaaataaattcaaaattcatcaatagctcagactgatggcagagttgtcagggacatttttttctgtgtgtttctgcttacttcttatttctttcctttaaatagtatgggaaatatgacagctgtactttattttcttgtgtctgcaagccctcagggcatatgtgctcaggaactactttttgttacacttaaataagtatgtctatttgccacttgctctaaaaaacaaaatgcaggaaacatcagagtgtatcaaattatttttttccatgtgcaatattcaggcaatgcaataatagatggaggtccaggtgaaaatgcttctctttttaagccagctgttaaatgcattaagttttaatttgtacatacagttttataacacttagataaccaaccaaaat

SEQ ID NO: 109950 - DNA, 601 bp, Human
caattataaataaggaacagaacatagtactcaggacttagaataaagtaaatactgcattaagcattaaaattcttgggaataaaagaaaataagggaacagatgtatttcctgatagtctaattatcagaaatatgcaaaataagctgggcatggtggcttatgcctgtaatcccagcactttgagaggtcaaggtggatggaatgcttgagcttaggagttcaagacaagcctggacaatatggcaaaaccttgactctctaaaaaatacaaaaattagctgggcatgtggcacatasctgtagtcccagctacttaagaggctgcttgagaggctgagcggggagaatcacttgagcccgggaggttgaggctgcagtgagtgtgattgcatcattgcactgaagcctgggcaacagagtaagaccctgtctcaaaaaataaaatgaaataaagaaaataaaagaaataagcaaaatataggttatcttatttctaaattacaatgtaaattaatttattatgcattttttttgcacgaggcaatcacatcacaaaagacaatgtttcaacagtagtgttacagatttgcaggcaga

SEQ ID NO: 109951 - DNA, 601 bp, Human
cagagtaagaccctgtctcaaaaaataaaatgaaataaagaaaataaaagaaataagcaaaatataggttatcttatttctaaattacaatgtaaattaatttattatgcattttttttgcacgaggcaatcacatcacaaaagacaatgtttcaacagtagtgttacagatttgcaggcagactttggctgcctatgggcaagtccaaattttttcttaacacagaaaaagaggaactcatttaagtatctagacacatactcaagtaagattttagaatttttaaacatagaacattayaatcttaggcctggaaaatgctaaaagcagatacatttaaatataagaaaatcctaatgcagtagaaattgaattgttgatgttccagtcaatactgtagaaatctgataaataacagcagtgatggctaaaagacctacccatcagctacaaaaagagtttccgagagtctacattaattatcatattagatagtttctattaagtgattgaaaattggaatatgtctgtcccaaaattgttttgccatagtacccatgttttatagtgagctggatatttccttttgttctttcttca

SEQ ID NO: 109952 - DNA, 601 bp, Human
attgttgatgttccagtcaatactgtagaaatctgataaataacagcagtgatggctaaaagacctacccatcagctacaaaaagagtttccgagagtctacattaattatcatattagatagtttctattaagtgattgaaaattggaatatgtctgtcccaaaattgttttgccatagtacccatgttttatagtgagctggatatttccttttgttctttcttcattcttttgttgttgttgttgttgttgtttcttcctgttttttacttgcttctcaatctcttctatcacttctrtttctttagaattaataaattctaaattaataaaacatttggttacttattattccattctcacattgctataaagaaatatctgagactgtgtaatttataaagaaaagaggttcagttgcctcatggttcacaggttgtacaggaagcatgatgctggcatctgctcagcttcggggaggcctcagaaaccttacagtcatggtagaaggcaaagggggagcaagcacctcacatgaccagagcaggagtaagacagagtgaggagccacacacttttaaacaatcagatatcatgag

SEQ ID NO: 109953 - DNA, 601 bp, Human
tgataaataacagcagtgatggctaaaagacctacccatcagctacaaaaagagtttccgagagtctacattaattatcatattagatagtttctattaagtgattgaaaattggaatatgtctgtcccaaaattgttttgccatagtacccatgttttatagtgagctggatatttccttttgttctttcttcattcttttgttgttgttgttgttgttgtttcttcctgttttttacttgcttctcaatctcttctatcacttctgtttctttagaattaataaattctaaattaataraacatttggttacttattattccattctcacattgctataaagaaatatctgagactgtgtaatttataaagaaaagaggttcagttgcctcatggttcacaggttgtacaggaagcatgatgctggcatctgctcagcttcggggaggcctcagaaaccttacagtcatggtagaaggcaaagggggagcaagcacctcacatgaccagagcaggagtaagacagagtgaggagccacacacttttaaacaatcagatatcatgagagctcactatcatgaggacagtaccaaggggga

SEQ ID NO: 109954 - DNA, 601 bp, Human
cagttaggagcagttaagatctgtgatcttttgcaatttggagagtttcccattgtacagtaggaatggaatgttaaaaattcctagtatctcacaacaaattttttagtagacttggagagaatttgtctttgtcttcacttttttatttgtatctttatttgcttagagacagagtctttctctgtcacccaggttgagtgctgtggcataatcatggctcactgtagcctcaatgtcctcagttgaagtgatcctcccacctcagcctcctaaatagctgcacccagctaattaaaamaaaatttttttgtagagatgggggtctcactatgttgatcaggctggtcttgaactcctggactcaagcaatcctcccacctcgacctcccaaagtgctgggattacaggcaagagcaactatgcccagtctttatcttctttaattgcacattcacatggttttcaaagagatttgggtaaaaataatattacatcaggaagaagaaattaaagaaggctatggtacttttaactatgttgaaaataccattttgaagaacagagataatctatgaccccaaaattttgattagaagta

SEQ ID NO: 109955 - DNA, 601 bp, Human
tcccacctcgacctcccaaagtgctgggattacaggcaagagcaactatgcccagtctttatcttctttaattgcacattcacatggttttcaaagagatttgggtaaaaataatattacatcaggaagaagaaattaaagaaggctatggtacttttaactatgttgaaaataccattttgaagaacagagataatctatgaccccaaaattttgattagaagtataagtgaaatttatcatttatgggtggtattttaataatattatgttgtgattataaatgagtgtggccaaatartgtctccttttgttcaataaacttttccctaaaacagaggcaatcttttcaagttatattttctgtaaaagtagttttgtcagagccatgctattttagtttgaaatctcctaaaatgatcattacttactaaatggttagactatcttctttcaaaaagctcaataaattaaaaagcaatacctgagtaatctgcatacattttaaggaatattatctgaatagtcttaccaggaagttgggtgatactttttaggtaatcgttttgatttgtttgtgattctagtattaagcgaaatc

SEQ ID NO: 109956 - DNA, 601 bp, Human
gtgctttgaagtcagtttagtctgaaagtgaattaatatacagcactgatcctctttcactagtgctaggactgaaattccagtcagtcagaggaaataaaagaagagaaaaatcatggcaactaacttgacatttccccacattatctgtattctcaatcccattcccctatttaatttttatcacgtgaatttttgcaggctgagtatatgtatgttttgctagaaactgtcagcattttaactcattgaaagaaaactttacaaatagtttttttttaattctcttaaatgaccttgracctaaatccaatggattgattagaagcatattttttagagcagaaaaaagcaaaatacgtaaatacatactgtaatttttttaatccatcattcaacaaattacagtttagcttttctacatgcaaggtgttgtgttagcttctgtgccagtgcatgtgcaagaaatggtcccagaacttcatgaatcagatgatcttggagcagacatgagacttgtgcatatgtttatttggatacaaagcataacatgtaagtgccacatgagcagtatagaaaggcaaagtttaaagcagattat

SEQ ID NO: 109957 - DNA, 601 bp, Human
caactaacttgacatttccccacattatctgtattctcaatcccattcccctatttaatttttatcacgtgaatttttgcaggctgagtatatgtatgttttgctagaaactgtcagcattttaactcattgaaagaaaactttacaaatagtttttttttaattctcttaaatgaccttggacctaaatccaatggattgattagaagcatattttttagagcagaaaaaagcaaaatacgtaaatacatactgtaatttttttaatccatcattcaacaaattacagtttagcttttcwacatgcaaggtgttgtgttagcttctgtgccagtgcatgtgcaagaaatggtcccagaacttcatgaatcagatgatcttggagcagacatgagacttgtgcatatgtttatttggatacaaagcataacatgtaagtgccacatgagcagtatagaaaggcaaagtttaaagcagattatttctgctttgggccaaagtccccaaattgtgcacaaaatcatcttatcatcttggggtgctgcagcaaattcacaagaatacaacaaggtattttaaatatttaaggggaacagtgata

SEQ ID NO: 109958 - DNA, 601 bp, Human
ttgtggttgagaataaaataaaaatattatttgcacatttcatggttacaatgaggattaattaagatagtaaagtgtacaaagtgaatggctcaagaaataataactgttaattaattttattattattggtggtagtggtggtatcaatatggatgacatagcactcttgatcaagtaatatttttctatagctgagtatacacaactttaacagggtggaacttgggtgtcaggagcactaagaggattttcaagggattgcagcatgaggagatgagagcatgttatagcatattgrttgtgaggaagaaaagagttagtatgatatgtcaaggtttttttcatcatcgtatcttgcagcattagaccttcaatattccataaatgtgtgttgagtgagcgagtgaatgaaggaataaatgaataaattcaaaaagaagaaagtcctcttcacattaatgatgaaaacaattgaaaagtcttactttgtcccttgggctctcgccagttgactctcagtgcctgttatgaaagcttgtaatacacaaaaaaaaatcactgcagtgtgcttggtcatgcagtaaaaaccaacaccatt

SEQ ID NO: 109959 - DNA, 601 bp, Human
aatgaaggaataaatgaataaattcaaaaagaagaaagtcctcttcacattaatgatgaaaacaattgaaaagtcttactttgtcccttgggctctcgccagttgactctcagtgcctgttatgaaagcttgtaatacacaaaaaaaaatcactgcagtgtgcttggtcatgcagtaaaaaccaacaccattcactatttcatctgttcagtggtcttaagtatttgagagcatcagaaaaatctatttgtcaagtcagtgtattatcaccagcttctctgagaaaatgatatacatttaraagaggctaatagacgtttcttttaaatgatgggtttaggaacatccagagttcattttaaattcagctcaatgtgtatcaaacacatttggtattagcttttggagattgattacaaaggttttgtctgtatgttctgagtgacaaaaattgtaaacagtcagccatgggctaccagagtgatagtcaatccaaactaaactatggtgtgatttttaaattaactttcctctagaaataagcagccaagtattgaatccatgagatatgcatgtgtagaaatctttagaaaaaggaaaa

SEQ ID NO: 109960 - DNA, 601 bp, Human
tccttgtgtattcattgtttaactcacacttgtaagtgagaacgtatggtatttgattttctctttctgagttatttcacttaagataatggtctcccgttccatccatgttgctgcaaaagatatgattttattcttttttatggctgtgtagtattccatcgtatatctacactacattttctttatccagtcatccactgatggatgcttaggttgattccatacctttgctattgtgaatggtgctgcaataaatatatgagtgcaggtgtctttgatataatgatttattttccaytgggtagatacccagtagtgagattgctggatcgaatggtagttttattttcagttctttgagaaatctccataccgttttccataaagactgtagtaatttaacattcccgtcaacattgtttaagagttcctttttctctatagcattgttaacatctgttgtcttttgactttttaataatggccattctaactggtataagatgatatctcattgtggttttaatttgcatttccgtgatgattagtgatgttgagcattttttttcatatacctatttggccatttgtgcatctt

SEQ ID NO: 109961 - DNA, 601 bp, Human
attattttagaaaatggaaagtgacctttcaaattttaagggcacagaaaagcaattgatttctgtaatcattgtgcatgtgacttaacagtgtaattggttttgacttcatctagtattcccttaacagtattatatcaaatcctatctttactgtgcctgtttatagaatcattttgaatatggtactttctagcagcaaaaacagggatgtgcaaacaaagtggtggttctatgtttctgaccttgctctaaaaaagtaataattttgctgttgctcacttttcatctaaagagaggraaaaaaaattattattattactattttttttttgagatgaagtctcgctcttgtctcccaggctggagtgcaatggcacgatcttggctcattgcaatgtctgcctcccgggttcaagcgattctcttgcctcagcctccagagtagctgagattacaggcgcctgccaccaggcctggctaatttttgtatttttagtagagacggggtttcaccatgttggccaggctggtcttgaactcctgacctcaggtgatccacccacctcgacctcccaaagtgctgggattacaggcgtga

SEQ ID NO: 109962 - DNA, 601 bp, Human
tgacctttcaaattttaagggcacagaaaagcaattgatttctgtaatcattgtgcatgtgacttaacagtgtaattggttttgacttcatctagtattcccttaacagtattatatcaaatcctatctttactgtgcctgtttatagaatcattttgaatatggtactttctagcagcaaaaacagggatgtgcaaacaaagtggtggttctatgtttctgaccttgctctaaaaaagtaataattttgctgttgctcacttttcatctaaagagaggaaaaaaaaattattattattaytattttttttttgagatgaagtctcgctcttgtctcccaggctggagtgcaatggcacgatcttggctcattgcaatgtctgcctcccgggttcaagcgattctcttgcctcagcctccagagtagctgagattacaggcgcctgccaccaggcctggctaatttttgtatttttagtagagacggggtttcaccatgttggccaggctggtcttgaactcctgacctcaggtgatccacccacctcgacctcccaaagtgctgggattacaggcgtgagccactgcgcccggccgagag

SEQ ID NO: 109963 - DNA, 601 bp, Human
acctttcaaattttaagggcacagaaaagcaattgatttctgtaatcattgtgcatgtgacttaacagtgtaattggttttgacttcatctagtattcccttaacagtattatatcaaatcctatctttactgtgcctgtttatagaatcattttgaatatggtactttctagcagcaaaaacagggatgtgcaaacaaagtggtggttctatgtttctgaccttgctctaaaaaagtaataattttgctgttgctcacttttcatctaaagagaggaaaaaaaaattattattattactwttttttttttgagatgaagtctcgctcttgtctcccaggctggagtgcaatggcacgatcttggctcattgcaatgtctgcctcccgggttcaagcgattctcttgcctcagcctccagagtagctgagattacaggcgcctgccaccaggcctggctaatttttgtatttttagtagagacggggtttcaccatgttggccaggctggtcttgaactcctgacctcaggtgatccacccacctcgacctcccaaagtgctgggattacaggcgtgagccactgcgcccggccgagagga

SEQ ID NO: 109964 - DNA, 601 bp, Human
tgcgatttactaataggagtcagcatcccatttaaaatatggcctattctatgtaatatattaatttatgcggagcaaaatagcactgagccatttctcctgcaaaatgactaaagccatccacaccaaccccccaagcaaataaacaagctcgcctaacaatgcgagaggttgcagattttcctttcctagttgccatgccaaccactcattgctctggctgccatttccctgagctccgcagagagaggagtgtgcagagcagagttatttagcattcaagggtggatctgcagaaaaycacacagcctcactgcgaagcatctgggcctggtggcaccgatggatgaggacagaaaatggggatcttttcagtgttttccttctaaaggttaggcatccggggctagaaagagtgagaaagacaaggattgatagaaaaggcagttccacgaggtttgtattgtcacgtttgctttgtcctatgtggtctctctactaggtgaagctggttgtggggattagcttcaatcataatatttggcttggcttgttgatgaataggatttgaacctaatttagggctagcttatatggatat

SEQ ID NO: 109965 - DNA, 601 bp, Human
tgtcatcatatttttcttttaatgtttttcaatttttttgagatttaaaaaacctccatttagataaaaatttaaaacaattcttaaattctttttttatttttagcaaacagatgaaagtaataagtaatgggagtgagtcttctagactcatttttggactgtctaagcctttgttttggttaggattatgcatggcctttatctgtcctttgttatatttcggagtattttctcctcacaaaagagaaaaagaaaaaaaagataagataaaaaatctaatacttttgaacaaataaaytgctcaaatatcttgagactatatttcttatcaagcaataatgtgtttttaagtgtgagatatatatatatatacacacatatatatattctttgattatattacttgtgtaggtctgagaaaaatgtttgccactgtatgccaaatgctgccttgcggtttagaattgggtttgattttattgcggttgggaggttattaagtagactggagagtacccagcagttatcactcctcttttttcccctctaagctattgagataaactgactctttctacttcagtgtgtcaagcctttt

SEQ ID NO: 109966 - DNA, 601 bp, Human
tagataaaaatttaaaacaattcttaaattctttttttatttttagcaaacagatgaaagtaataagtaatgggagtgagtcttctagactcatttttggactgtctaagcctttgttttggttaggattatgcatggcctttatctgtcctttgttatatttcggagtattttctcctcacaaaagagaaaaagaaaaaaaagataagataaaaaatctaatacttttgaacaaataaattgctcaaatatcttgagactatatttcttatcaagcaataatgtgtttttaagtgtgagttatatatatatatacacacatatatatattctttgattatattacttgtgtaggtctgagaaaaatgtttgccactgtatgccaaatgctgccttgcggtttagaattgggtttgattttattgcggttgggaggttattaagtagactggagagtacccagcagttatcactcctcttttttcccctctaagctattgagataaactgactctttctacttcagtgtgtcaagcctttttctcttcctctcattccctcacacttcactgctccccagtacattacataaagcacgtgc

SEQ ID NO: 109967 - DNA, 601 bp, Human
ggcattaggcaaaaatagataagaaaggaggaatcaagattcagagaaaaatcatcctaaatacatatgattcagtttaagcatcctgaaaatccatatttttaatttgtaaacacaggtcaaagtgatgctggcatatgagcacctctggttcttgcaaagcatctccagcatgaatgatcagtcctccgattggtctaaaatgttctcttttgtgacacgttgcatttgccgaatgtaaatgggcaagtttacattgtggtgttttcattcccatgcagtattgtgcaagaagtcatargaaaaacattttggaagggtaccaccctacagcaaaggttctcggaaatctaccattaaagataaagagctgttgttgattttattctctcaaatgagtcttcctcttctgaacacccccaagtaccatgtttatatcttgctaatacaattgatcatagcaatcattttactgaggttacttgttatttgtttttattacagtcagtaggttggaaatgctttggggtagaacctgtgcttcattcatctttcttttcctttttgtatataacacagtgcttattttctataatatgta

SEQ ID NO: 109968 - DNA, 601 bp, Human
agcatctccagcatgaatgatcagtcctccgattggtctaaaatgttctcttttgtgacacgttgcatttgccgaatgtaaatgggcaagtttacattgtggtgttttcattcccatgcagtattgtgcaagaagtcataagaaaaacattttggaagggtaccaccctacagcaaaggttctcggaaatctaccattaaagataaagagctgttgttgattttattctctcaaatgagtcttcctcttctgaacacccccaagtaccatgtttatatcttgctaatacaattgatcatarcaatcattttactgaggttacttgttatttgtttttattacagtcagtaggttggaaatgctttggggtagaacctgtgcttcattcatctttcttttcctttttgtatataacacagtgcttattttctataatatgtatgtgctaatacatattttttgaattaatataaagaagagagggctgggcatggtggcttgcgcctgtaatcccagcactttgggaggccaagatgggcagatcacttgaggtcaggagttcaagaccagcctggccaacatagtgaaaccctgtctctac

SEQ ID NO: 109969 - DNA, 601 bp, Human
gattggtctaaaatgttctcttttgtgacacgttgcatttgccgaatgtaaatgggcaagtttacattgtggtgttttcattcccatgcagtattgtgcaagaagtcataagaaaaacattttggaagggtaccaccctacagcaaaggttctcggaaatctaccattaaagataaagagctgttgttgattttattctctcaaatgagtcttcctcttctgaacacccccaagtaccatgtttatatcttgctaatacaattgatcatagcaatcattttactgaggttacttgttattygtttttattacagtcagtaggttggaaatgctttggggtagaacctgtgcttcattcatctttcttttcctttttgtatataacacagtgcttattttctataatatgtatgtgctaatacatattttttgaattaatataaagaagagagggctgggcatggtggcttgcgcctgtaatcccagcactttgggaggccaagatgggcagatcacttgaggtcaggagttcaagaccagcctggccaacatagtgaaaccctgtctctactaaaaatacaaaaattagctgggcatggtg

SEQ ID NO: 109970 - DNA, 601 bp, Human
tcttcctcttctgaacacccccaagtaccatgtttatatcttgctaatacaattgatcatagcaatcattttactgaggttacttgttatttgtttttattacagtcagtaggttggaaatgctttggggtagaacctgtgcttcattcatctttcttttcctttttgtatataacacagtgcttattttctataatatgtatgtgctaatacatattttttgaattaatataaagaagagagggctgggcatggtggcttgcgcctgtaatcccagcactttgggaggccaagatgggcrgatcacttgaggtcaggagttcaagaccagcctggccaacatagtgaaaccctgtctctactaaaaatacaaaaattagctgggcatggtggcacatgcctgtaataccagctacctgggaggctgaagcccaagaattgcttaaatccaggaggtggaggttacagtgagtcagatcacgccactgcactccagcctgggcaacagagtgagaccctgtctcaaacaaaaaaacaaaaagaagagagagtatccatatatagttctgagaatggaaatcacataaacaaaatggtctac

SEQ ID NO: 109971 - DNA, 601 bp, Human
tccttcatcatcagttgattacaggaaatagtttcagaggaaccatttactctccaaattgagcaaggagtagaagcaaataacttttcttctttccctatttttatgaattcatctagggtctttgtttagcagagtgcttcaaactacacagtgctttccttgttgattagtttccatcagcagcagcaattagcatcggtttcctaggaaaccattctgtaccctactgagaaaaaccttttcttgacaggagcattctgtctaaaattgttttgttttccttcttccacaagcgtayggtaagcttatttgtcgttttctttgaacacaacattattataccaaagattcttaaaacatttacaggcttttatattccatatggttgaatttacaggcactgtctcttacttttctctaacaacctgaaagaaatcaacaaaaatatgttctcaagcatatgccaaggtgcttggattttttttattcacagtctaattggtgaacctttgcacgttcaagtaatcatagctggtcctgctgaaaaaccacagggtacgaattcaaaatcaaacttatgggtccaccaacaatgtta

SEQ ID NO: 109972 - DNA, 601 bp, Human
ttttatattccatatggttgaatttacaggcactgtctcttacttttctctaacaacctgaaagaaatcaacaaaaatatgttctcaagcatatgccaaggtgcttggattttttttattcacagtctaattggtgaacctttgcacgttcaagtaatcatagctggtcctgctgaaaaaccacagggtacgaattcaaaatcaaacttatgggtccaccaacaatgttacatatcactcagaatcactcagaaacaagttgaaacttccaggatcattgaaaaagtttcatctccattgsttatttttaatcaaccaagcaatattgatagataaatgtaacacaataactttaaaatgcgctaaaagcaaagcctgaggttgtcttaaaatttttgttgtgacaagtagtgtgatcagaagagcatggcaatggtgcagcatgaatcagcattagggaaaaaaccagagggtcatgatggctataaatgctgagtagtatgatatgacagtagggcaaaatttaccttatgttccttttagtttaaataataagtggcaggagcctgatgtattgtctgttagggtcccagcagtgacc

SEQ ID NO: 109973 - DNA, 601 bp, Human
tttatattccatatggttgaatttacaggcactgtctcttacttttctctaacaacctgaaagaaatcaacaaaaatatgttctcaagcatatgccaaggtgcttggattttttttattcacagtctaattggtgaacctttgcacgttcaagtaatcatagctggtcctgctgaaaaaccacagggtacgaattcaaaatcaaacttatgggtccaccaacaatgttacatatcactcagaatcactcagaaacaagttgaaacttccaggatcattgaaaaagtttcatctccattggctatttttaatcaaccaagcaatattgatagataaatgtaacacaataactttaaaatgcgctaaaagcaaagcctgaggttgtcttaaaatttttgttgtgacaagtagtgtgatcagaagagcatggcaatggtgcagcatgaatcagcattagggaaaaaaccagagggtcatgatggctataaatgctgagtagtatgatatgacagtagggcaaaatttaccttatgttccttttagtttaaataataagtggcaggagcctgatgtattgtctgttagggtcccagcagtgaccc

SEQ ID NO: 109974 - DNA, 601 bp, Human
ttcaaaagaaagataattgagcctttcaaaatatcagattacaataagcagttttatgtttgtttaatattttcagctatgaagatcagtgttacctttcaattacatataatgaataataattccccaatttatgtgtaatctagattcatctttaatcttctaacaactaagtcctggttgttataactttacacctatgtttggaagaaaaagcaagaaaaagagaatagaaagtataaaaaggaatagaaggtaggaaaagtaagcaatgaaaaattaaaatgtagtctaatctctkacttcaaaaagaatttttcatgtcaccaattgtcttcagaattagacaggattatcataccttttagagccctgtctagaatagacagtcctgaattgggacttgctggatggaatcttgagcagatggtagcccaggacctatgcatccaggaaactgggtgtgaagccagaaaataaataacaaagacaatatttacttctctcatatctttgccttggaaaaaaaaatacttcccttgtccattaacatagccatcaacatcagtgatattggattaactatattttcagatggtta

SEQ ID NO: 109975 - DNA, 601 bp, Human
taactgtaaatgaattacatcttttagaacctttttctctggttccttttcatgtgtattgattgctaagaccagaagtttactcagcatatggtttttgtctgaaagttcactcaggctatgaaagcttatttttccatttctgagaatacatacagaagatgggttttgaaattagactcagtgaacaaaaggttgtttaaaaaatatattccctaaaataactattagtgatcaagataacacatgtttccagattgagcagttgaacaatagagagttctaatagttttttcagtcrgtagctgaatccagactaaaaacacctgcctgcctgtgtgtgttttcatatggtaaattagggccaaaatgaaatattttattaattgaacaggtagacacattaatgagattaatgatggaattttagcaggcatctctaatctgtttttctagagatgataaaatcatttttttttgaaaatatcaaatgcttgtcttattttttaggttttcaaaaatgcatgaatcaggtaatgggcctataaataaaccaaatgcggcttactattgaatctttttctgaattttatagagaggt

SEQ ID NO: 109976 - DNA, 601 bp, Human
tttgaccttatgtttatccattcactgggcacatatttattgagccctacagtcttccaggtactcttcaaattctgagtatatactagtgaacaaaacagacatgatccctgcttttaaagagtacactatagccggtaatcccagcactttgggaggccgaggcgggcagatcacttgaggtcaggagttcaagatcagcctggccaacatggtgaaaacccgtctctactaaaaatacaaaaattagccaggcatggtggcgtacgcctataatcccagctactcgggaggctgaggmaggagaatcacttgaacccagaaggcggaggttgcagcgagccaagatggcaccattacactgtagcctggtgacatagcgagactccatctcaaaataaataaataaatagtacactatctagtggagaacagaaatccaataaataagcttaccaataatttcaaattggattagcattgaagaggaaaagaatagggagctttaaaatattacaagagaaacctgattttattgggtggtgaggggatggctaagtagctgagaccagaagcatgaggaggaagtgttggccaaata

SEQ ID NO: 109977 - DNA, 601 bp, Human
gagtagagttaaccttcatgaaataatttcctccaaagaatgcatttgttttgtaatgctttgtttctattccaacgttccttggttattctgacttgtttgagaggaatgtacagatgatttttattttgccgcagggctgtcaatgcttttggttcacttagatcaatggcaaacttgcttaagggataggtggaattcagcagttactgaggcatgaaacattcactgtctcccatcctccatcagcttgatcttgctaatttcccttcatcctgctgtgctgcttctgtggcccttyctgcccttgtgtaggtgtttgtttcgtccgtctgatcttgtgtctgtgttgtccagttctccctgcagtttcttcctgtgtgtctgtttgtagatgaaggggctgaggatcaagtgggtcctctacacaggttccccagccatgaacctgccaccagcggggagaggcgtggactcctagccccctccatctcagtgtctgtgcctgatgatgacccttacaattccgatgaggagtactatgagcatcctttgttcagctcagaacggaccacctctagtgtgctccccagtgtcacag

SEQ ID NO: 109978 - DNA, 601 bp, Human
ttcttctaaactaaatttctaaaatatgtgagtttttaaattaggaacaattgtagtggaaataaatatgatttatactaaatgagaaaatgaaaagctaaaaagctacatggatttgaaaacatgtaaattaacttgattagactttatccaaaaaggtaacattataatgcagttatattaaaattcttttaactgtaatcaaaatctatggcattataaaaattttcttaaaataacaagttagaatttaaatttttaaaatgctacttaaaatgccataattaaattacaaaactaraaatgagtgctaaatgtgaagagattgataatgtagatttttttttctctctctgtttctctctgaggatattaatatttctaaaaaacaaaataaaagaaaattccttttctttttatctgtagtctttccctcagggccgtttaaacaatgcacaattatttcataagaattttgtaagaatcttccatttacaaaactataaaacagctcatatatttctctctaattccttaagtgaccaaatggaatttacttatttttactgacatttcaagtgtaaatgagaaacaaattagt

SEQ ID NO: 109979 - DNA, 601 bp, Human
tttttaaattaggaacaattgtagtggaaataaatatgatttatactaaatgagaaaatgaaaagctaaaaagctacatggatttgaaaacatgtaaattaacttgattagactttatccaaaaaggtaacattataatgcagttatattaaaattcttttaactgtaatcaaaatctatggcattataaaaattttcttaaaataacaagttagaatttaaatttttaaaatgctacttaaaatgccataattaaattacaaaactaaaaatgagtgctaaatgtgaagagattgataaygtagatttttttttctctctctgtttctctctgaggatattaatatttctaaaaaacaaaataaaagaaaattccttttctttttatctgtagtctttccctcagggccgtttaaacaatgcacaattatttcataagaattttgtaagaatcttccatttacaaaactataaaacagctcatatatttctctctaattccttaagtgaccaaatggaatttacttatttttactgacatttcaagtgtaaatgagaaacaaattagtgcaataactcatgaacttgaaaagtttatctt

SEQ ID NO: 109980 - DNA, 601 bp, Human
atgcctaaagaattggccctgacatttgttaatcaagttaactgcaactattaacattatatcattgtgcattacttggccctctgcccatagcctaccaattcatttttaaatgataaaaccaatgaaaatgttcagtataaatcaattctttatctatatttagtccttactatatattcttttgtaccctaacattagctgcttactcaatattcattagcttataacttttatgtatagaaggcacatgaatttgtttcttctgtaatacacatcacataatgtttaggagagaccaaaaaaaaaaaaaacaaagaaaaaaagagaaaagaatatccagaaatatactgttcttacaattcctttgcacattaatttacaaccagagttcattttagtaatagtacacatatatctcagtcctgaccttttcatattgacttttacatgggtagcatgcttgcatgttccataatttttgtttttattctaccattcatttatcacttcaaaatataattttaagcttatttcctgaacgcacttgcctattatttgtttaaaaatcaacccgattacttcagatttacttacagcc

SEQ ID NO: 109981 - DNA, 601 bp, Human
gaaaaaaagagaaaagaatatccagaaatatactgttcttacaattcctttgcacattaatttacaaccagagttcattttagtaatagtacacatatatctcagtcctgaccttttcatattgacttttacatgggtagcatgcttgcatgttccataatttttgtttttattctaccattcatttatcacttcaaaatataattttaagcttatttcctgaacgcacttgcctattatttgtttaaaaatcaacccgattacttcagatttacttacagcctcgaagatggagttccaygatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaa

SEQ ID NO: 109982 - DNA, 601 bp, Human
tttgtttttattctaccattcatttatcacttcaaaatataattttaagcttatttcctgaacgcacttgcctattatttgtttaaaaatcaacccgattacttcagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacrgaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccc

SEQ ID NO: 109983 - DNA, 601 bp, Human
ctactgaactacatctcttagctgacattttgtcatggagatttcttaaatatgttggatccaaactgctcgacttttctatataatttagtttcacaaatttgaagctaaaactcttccttttaggaggaacttcagttagaaataaacttcggtttatttttactttgctgtctactttttttttgtttcccaagacggaatctcgctctgtcgcccaggctggagtgcagtggcacgacctcggctcactgaaacctccacctcctgggttcaagcagttcttctgcctcagcctccrgagtagctgggattacaggcgtgcacccagctaatttttttttttttgtatttttagtagagacggggtttcaccatcttggccaggctggttttgaactcctgacctcgtgatccacctgcctcagcctcccaaagtgctgggattacaggcatgagccactgcacccggcctgctatctacttattactcttcttcaaatacatattttttcctaagtttataaaactggtaaaacaaaggaatgaaacttgttggaaaccatcataaaaacccctacaaatatctgtaatgccaact

SEQ ID NO: 109984 - DNA, 601 bp, Human
tggagatttcttaaatatgttggatccaaactgctcgacttttctatataatttagtttcacaaatttgaagctaaaactcttccttttaggaggaacttcagttagaaataaacttcggtttatttttactttgctgtctactttttttttgtttcccaagacggaatctcgctctgtcgcccaggctggagtgcagtggcacgacctcggctcactgaaacctccacctcctgggttcaagcagttcttctgcctcagcctccggagtagctgggattacaggcgtgcacccagctaatttttttttttttgtatttttagtagagacggggtttcaccatcttggccaggctggttttgaactcctgacctcgtgatccacctgcctcagcctcccaaagtgctgggattacaggcatgagccactgcacccggcctgctatctacttattactcttcttcaaatacatattttttcctaagtttataaaactggtaaaacaaaggaatgaaacttgttggaaaccatcataaaaacccctacaaatatctgtaatgccaacttttttctaaatttcagggcaaagtatttattttat

SEQ ID NO: 109985 - DNA, 601 bp, Human
tttaggaggaacttcagttagaaataaacttcggtttatttttactttgctgtctactttttttttgtttcccaagacggaatctcgctctgtcgcccaggctggagtgcagtggcacgacctcggctcactgaaacctccacctcctgggttcaagcagttcttctgcctcagcctccggagtagctgggattacaggcgtgcacccagctaatttttttttttttgtatttttagtagagacggggtttcaccatcttggccaggctggttttgaactcctgacctcgtgatccacctkcctcagcctcccaaagtgctgggattacaggcatgagccactgcacccggcctgctatctacttattactcttcttcaaatacatattttttcctaagtttataaaactggtaaaacaaaggaatgaaacttgttggaaaccatcataaaaacccctacaaatatctgtaatgccaacttttttctaaatttcagggcaaagtatttattttatatgtttaattatactaggataatcttaccttacactatattttattttagcatttattaagtggcatgcttgtagtctacaaaatg

SEQ ID NO: 109986 - DNA, 601 bp, Human
tttattaagtggcatgcttgtagtctacaaaatgacagattgctaaatcagaaaagaatgtttttctttccattgtacatcatcaatgcctctatataaatcttcggatggttttaaaggttaagaggaacattagcctttgtgagaaagagaaaatcaaggtaactgatggttttattttagccattgaaaattccaagtattttgtatttgtgttcttcatctagaaatcatatcatgtgctttccttcaaaaacaagaatctaaggcaggatttgaaaatagaaggcttgtatatacrcacaccttgataaagcttcaggatgaagaatatatctgaagctaggagttaggaattaacgtgacatacctcaattcattttctcaggtttttagcttcattaaacttagaacttcattaaacttaatagcaaattaatagcttcattaaacttagtagcaaaattgcttgggcaagcagaatctcttgatttagcataaaaactctataacctacctaaaaggatgaaagatgtcatcaggattgtggaattttagagaaaacgtaaaatggtttagtaaagtgtttacatgtcattgg

SEQ ID NO: 109987 - DNA, 601 bp, Human
gtgagaaagagaaaatcaaggtaactgatggttttattttagccattgaaaattccaagtattttgtatttgtgttcttcatctagaaatcatatcatgtgctttccttcaaaaacaagaatctaaggcaggatttgaaaatagaaggcttgtatatacgcacaccttgataaagcttcaggatgaagaatatatctgaagctaggagttaggaattaacgtgacatacctcaattcattttctcaggtttttagcttcattaaacttagaacttcattaaacttaatagcaaattaatarcttcattaaacttagtagcaaaattgcttgggcaagcagaatctcttgatttagcataaaaactctataacctacctaaaaggatgaaagatgtcatcaggattgtggaattttagagaaaacgtaaaatggtttagtaaagtgtttacatgtcattggtattcaatttgccacatttaaagtaaattgtgtttttattcattctttgaaagaaatttaaaatctttgaactaatgaagattttcctttattctggtctaatgttaagatactttaggagaaagcatgtatcagatgtag

SEQ ID NO: 109988 - DNA, 601 bp, Human
gaaatttaaaatctttgaactaatgaagattttcctttattctggtctaatgttaagatactttaggagaaagcatgtatcagatgtaggtgtcattggtttgaagcaagctatacatgtcacaagaatttgagttatattacagagatagtagtaaggcatcgttttcactgcttccttaaaaacaatgagtcctagaatctgaaaaatctcactagctagtcctacatggcataaagcatattgtagacagttattatgtttgtgtcagaactgtacctgtcataaaaatacctttttrgaacttattcagagggcttataaggatacattttttttctgagggtttctattttatgaatgaaaattaaggaggaataaacacacaagcttgattattttatcttctaagcccaattttcaaacatagatggttttccaaaccacaaaggattgttttaaatcatgagagctaagctacctcaggtaagtcatcaaccaaaatgtgctagagataatggagtttaaaattgaatccagaagcataaaacagcagcaagagaaacaacagtaacagatgtggtaataatttcatacagga

SEQ ID NO: 109989 - DNA, 601 bp, Human
aaatgagaacactgtgtatcactttttaaattcaacagtaaatgtacttccatgtcgttgaacattttgtaagttttaatgactacgtaatactgcattttatttctttgcaatgatatacttaatcaatttcctattatttgacttttagaattttttgttggtattttaacaatattactgtagagaactttttggctaagttcagtttgtatgctatttccttcattttctactagtgaaattattgtttcaagaaaaatgttaatatttaaagtttttgctgcatattgtcaaattrccctctggaaaggttctacccacttatacattctgtataaggagagtgttcatatttgttattattactacatattttatattgttgttgtatatttgccaaattatagagatggcatatattattattttaaaattttattttggttgtattaatggtgtttaacttcttcatatgtttgtaaatcttttctattttttctgtgaattttatttttatattattaactgtattttaatgaccaaagccaacatgaagtattttcactcctttatgattgaaagaaaaaaattaaaaggc

SEQ ID NO: 109990 - DNA, 601 bp, Human
gcaagtaataagtaataaacatggatacctgttctagacctggttaatagaaaataaaatggtttagcattatttttgtgttttatttgtataacagattttttattttatttttaatcagggtgtccatgtgcaggcttgttacaagggtatattacgtgatgctgaggtttgagcttatattgattccatcatccaaatagtgaacatagttcccaataggaacttcccaataggaagtttttcaatccttcccccacttttggagtcaccagtgtctattgttgccatctttatgtcygtgtgtacccattgtttagctcccacttataaatgagaacatgtgatatttggttttcttagacatttttctatgactattattaagttagttttggctaaaaagaactgtgaaaatctcttctcatctaagtacacatctctatcattgattataaccatttatcatgtgttcttattaaaaagactttgagtttcttatatgtttatacttcttttttatcttccttttactttatagtttggtttattttgtgcttttgtttgttttctttcatggctagaattctaccttgtcaaa

SEQ ID NO: 109991 - DNA, 601 bp, Human
ttctttcatggctagaattctaccttgtcaaagattcctgctttacagggtagcacaaagtccccaagatacagctcagcctgccctagcacgactaaaagggctacattttctgacagtttattaatacagcccacctcagcaggctccacagaccgtttgccatactcaaaatcagggaacaaggtaaggcggcaggtcaataaaaggtgcagaaagaaatagaatttgggagaaggttatgttatagaacctaattcaggaaatgtatgaaagcaaatactttactctgaagtgtttracacataaacagtaggcccttttaaaaacaaatacaaatttaaaattttgataaacagtatacctattttttaaatgtagaaaatatgtctttttctagatatgctacccattattaatttatggtttgattatctggtaaaatatcaaatgcaaactaacaaaacaaaatatattctattatatataatatataagaaataatattgtacagtacaataataacaaattacattgtatagaatataatagataatttaaactaaacgtcatatacatcagggtttaatactatctctga

SEQ ID NO: 109992 - DNA, 601 bp, Human
aatcagggaacaaggtaaggcggcaggtcaataaaaggtgcagaaagaaatagaatttgggagaaggttatgttatagaacctaattcaggaaatgtatgaaagcaaatactttactctgaagtgtttgacacataaacagtaggcccttttaaaaacaaatacaaatttaaaattttgataaacagtatacctattttttaaatgtagaaaatatgtctttttctagatatgctacccattattaatttatggtttgattatctggtaaaatatcaaatgcaaactaacaaaacaaaatrtattctattatatataatatataagaaataatattgtacagtacaataataacaaattacattgtatagaatataatagataatttaaactaaacgtcatatacatcagggtttaatactatctctgacacctaccaactcaattgtcttgaaacaattatataaactcattaaacttgtttcttcagctttaaaatgtgtatcatgttttgtggtgagaatcaaatcataaaaggatataaactataaagggttcctgtcacatacacgcacaagatatggtaatggtcattgttagaa

SEQ ID NO: 109993 - DNA, 601 bp, Human
ctttttgcttcaaatttagagcagaaaagaaaattctaaagaagtaatcaatgtagaaaccaagtcaaggattttaaaaacatacatctataaaagcttaacacttattagatttccaagttgtaaaatctaactagaaagtcgacattcaaaacttaggatcctgttcaacttcttaagaatttgcattccaaatgagctataaatatagcatagtctatgcaataggttcaaattatcttgattgatggcccattcatgaactgattggcaattgtaacagtttatataatgctccaawcattacacacttatatgttgcattgtggcaaactatctagtaaagcatggattcaaattacttccgtaaatatttttctgttgcaaccaaaatagctaccgtttattgagcacatatagatactaaactcttaagatacattttttcactaatttaattagcaagactaatgactattataataattaataaactcaattcattctactgatgagaaaactgaccctctagagagggtaacttgtccagttaccctctagagagggtaactgcttcacagttcgcaagtggttgaatttg

SEQ ID NO: 109994 - DNA, 601 bp, Human
atggctctgtaagggaaagcccaaagagttaagaaaaatcaaccaatggggcaggaggggagaggtcaatatgcccttttagaacaatgataacattctataataatagagtcatagaaagatactttttcacagacagatgctatgaaaactagaagctacaagaaacatttttaagcaaaaagtagaattataagcctataattcctaaaaaactcaaactattcttgcgttcatcagagttttgcacatgcaagagaaggaaatattttgagctttttggaaatattcaaatgttgcwtcatctttatatttatacataaataatttaaaagtgtaaggtgaataaaatcaatttagtaccatttggaaagttctgcattttagccttggacaagctatcctctaaaatagaataactattatgtatatttaaaaatcagttcttttaaaataaatattcccatgtcctgttattctcctcaactagatatggggtttacttaattatattctggaaaacattaatacttaaaataatttgtttcctcttagaatcacaagaaaatacaaattatctccaagatattgtattaaaact

SEQ ID NO: 109995 - DNA, 601 bp, Human
gtctctaggaattgagaaaaatattcatgtaattcttattaaagaagatgggagtaaaattaaagatgtaactttaattcctctgcacagggtctattgtggtaaaatttgaagcaattaggttgtatacaaatgatttaattgtgaaaacttcattattggggttttaaaatttgtgcaatctctaaaaattggtagaggaaatctataataaagatatatgcatcttaggaactcaacagctttccaaattatttgcctgcagtttgaacattaattgctcttctgtatgtacaggttytgtgcttaacagcagctatctcttctgttaaggtccaatttctgttggcagaggggctcagctcagtgagtcacatcaatgcctaatggaatagataagctagctgaagatacaaggagctttacagaaggcaataaagctaatcttttcagctaaaacaaattcattctattggaaagaatatgggcaatcatagattcagtgtagataattagcttgattgatttaactcaaggcatagggaagactatcttattaagtgtattaatttgaaactgctctatgtagctagcctctcaa

SEQ ID NO: 109996 - DNA, 601 bp, Human
atgtctttttgaattatttattcttttttggaaataccaaaagatgtggcaatattcttgcagatggctgtgtatctaaggtaaatttatttagaattttttaataagaggataaagtgtcccctaaagcattgaaaatgttgtttttttttctttagctattgcagaggtggggaagagaagagagtagaagtagccaaagtaaaacaaaatgaacaaataacgacaataacacaaataaagctttctttccatgcttatattgcttatgtgtcctccaaaagatgcaaggttcaaaagwcatatgaaagaagtcatgaaagttgtaacattttacattaaaccagagtaatgtccttccagatctggatctgctgttgtcttcaagatgaatgtttgacttcccaaaaatagaaataaaacacctaacctcaaatctgctggcctcaatcaaggcctgacctatgtctgtatgacctagttacaagtcagctaaccaatgggcatgggttttctttcctctaaaaatggaaataatgcttccatatgatcatccatggaaaatggctgctcttgagcaattgccagaaaggggccttca

SEQ ID NO: 109997 - DNA, 601 bp, Human
atcatttagaataatacaaaactggtggagcatggttcatttataattcaaagtgaaaggattcaagtccagtgtacactttagcttgatgggattttttttcctgtctctttcatttagtgtaaataatgtcctgtgagaggaagggaaagatgattccatgttttttaagtgtgattgaggcagaattgaaatggtcagacaatctcaagctaaaggaagcatggttctttataaaacaagaatagtttttcaaaggtgatcaggctaactgtattctacagatcctatctctttaaasttcagtttctgatcatccatgactcaagtaatttacagggtgtcgagtctagaatttcacctgtctactaactctttggctacttgcttcccaactgggcagaagtagaatcaagcagtgaagagagagagagagagagagagagaagcaagtgccttctacaagcagctgttgcctgataatcaaagtagcttcactgagcataaaactgtcattgtcattgaaagttcatagcaatgtttgctggcccccttcaggtatgctaggctaagcctcagggttaaactttacatttatgtg

SEQ ID NO: 109998 - DNA, 601 bp, Human
gaccatgaaccccttttggtttttcaaaatatctcatacgactagtgccctaaagtagaatttatattcatagttactgggagattttctccctttaaagtgtgaatctaacattatgagtcactttttctgaatatcatgtattacatgtttttgttaaattctacctccatagagtgggcatgttggctcatgcctgtaatctcagcactttgggaatccaaggcaggaggattgcttaaggccaggaacttgagacagactcagcaacatagggaaacccctgtctcaataaaaaatwaaaaaataaaaataagccgatatggtggtacatgcttgtagtcctagctactttggaggctgaggcaagaggatcacttagtttcaggagttagaggctgcagcaagctatgatcacaccactgcactccagcctaggcaacagagcaagaccttgtcacaaagaaaaaactctgcctccatagatatgtaataaaagatgactgtcatatttgtaattttcttgagaatattttgacacaattcatttatccctttgagaacaaaaggaaagcaaatggttttaactgtctgtgtttgg

SEQ ID NO: 109999 - DNA, 601 bp, Human
attgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcasttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgt

SEQ ID NO: 110000 - DNA, 601 bp, Human; identical to SEQ ID NO: 109919

SEQ ID NO: 110001 - DNA, 601 bp, Human; identical to SEQ ID NO: 109920

SEQ ID NO: 110002 - DNA, 601 bp, Human; identical to SEQ ID NO: 109921

SEQ ID NO: 110003 - DNA, 601 bp, Human; identical to SEQ ID NO: 109922

SEQ ID NO: 110004 - DNA, 601 bp, Human; identical to SEQ ID NO: 109923

SEQ ID NO: 110005 - DNA, 601 bp, Human; identical to SEQ ID NO: 109924

SEQ ID NO: 110006 - DNA, 601 bp, Human; identical to SEQ ID NO: 109925

SEQ ID NO: 110007 - DNA, 601 bp, Human; identical to SEQ ID NO: 109926

SEQ ID NO: 110008 - DNA, 601 bp, Human; identical to SEQ ID NO: 109927

SEQ ID NO: 110009 - DNA, 601 bp, Human; identical to SEQ ID NO: 109928

SEQ ID NO: 110010 - DNA, 601 bp, Human; identical to SEQ ID NO: 109929

SEQ ID NO: 110011 - DNA, 601 bp, Human; identical to SEQ ID NO: 109930

SEQ ID NO: 110012 - DNA, 601 bp, Human; identical to SEQ ID NO: 109931

SEQ ID NO: 110013 - DNA, 601 bp, Human; identical to SEQ ID NO: 109932

SEQ ID NO: 110014 - DNA, 601 bp, Human; identical to SEQ ID NO: 109933

SEQ ID NO: 110015 - DNA, 601 bp, Human; identical to SEQ ID NO: 109934

SEQ ID NO: 110016 - DNA, 601 bp, Human; identical to SEQ ID NO: 109935

SEQ ID NO: 110017 - DNA, 601 bp, Human; identical to SEQ ID NO: 109936

SEQ ID NO: 110018 - DNA, 601 bp, Human; identical to SEQ ID NO: 109937

SEQ ID NO: 110019 - DNA, 601 bp, Human; identical to SEQ ID NO: 109938

SEQ ID NO: 110020 - DNA, 601 bp, Human; identical to SEQ ID NO: 109939

SEQ ID NO: 110021 - DNA, 601 bp, Human; identical to SEQ ID NO: 109940

SEQ ID NO: 110022 - DNA, 601 bp, Human; identical to SEQ ID NO: 109941

SEQ ID NO: 110023 - DNA, 601 bp, Human; identical to SEQ ID NO: 109942

SEQ ID NO: 110024 - DNA, 601 bp, Human; identical to SEQ ID NO: 109943

SEQ ID NO: 110025 - DNA, 601 bp, Human; identical to SEQ ID NO: 109944

SEQ ID NO: 110026 - DNA, 601 bp, Human; identical to SEQ ID NO: 109945

SEQ ID NO: 110027 - DNA, 601 bp, Human; identical to SEQ ID NO: 109946

SEQ ID NO: 110028 - DNA, 601 bp, Human; identical to SEQ ID NO: 109947

SEQ ID NO: 110029 - DNA, 601 bp, Human; identical to SEQ ID NO: 109948

SEQ ID NO: 110030 - DNA, 601 bp, Human; identical to SEQ ID NO: 109949

SEQ ID NO: 110031 - DNA, 601 bp, Human; identical to SEQ ID NO: 109950

SEQ ID NO: 110032 - DNA, 601 bp, Human; identical to SEQ ID NO: 109951

SEQ ID NO: 110033 - DNA, 601 bp, Human; identical to SEQ ID NO: 109952

SEQ ID NO: 110034 - DNA, 601 bp, Human; identical to SEQ ID NO: 109953

SEQ ID NO: 110035 - DNA, 601 bp, Human; identical to SEQ ID NO: 109954

SEQ ID NO: 110036 - DNA, 601 bp, Human; identical to SEQ ID NO: 109955

SEQ ID NO: 110037 - DNA, 601 bp, Human; identical to SEQ ID NO: 109956

SEQ ID NO: 110038 - DNA, 601 bp, Human; identical to SEQ ID NO: 109957

SEQ ID NO: 110039 - DNA, 601 bp, Human; identical to SEQ ID NO: 109958

SEQ ID NO: 110040 - DNA, 601 bp, Human; identical to SEQ ID NO: 109959

SEQ ID NO: 110041 - DNA, 601 bp, Human; identical to SEQ ID NO: 109960

SEQ ID NO: 110042 - DNA, 601 bp, Human; identical to SEQ ID NO: 109961

SEQ ID NO: 110043 - DNA, 601 bp, Human; identical to SEQ ID NO: 109962

SEQ ID NO: 110044 - DNA, 601 bp, Human; identical to SEQ ID NO: 109963

SEQ ID NO: 110045 - DNA, 601 bp, Human; identical to SEQ ID NO: 109964

SEQ ID NO: 110046 - DNA, 601 bp, Human; identical to SEQ ID NO: 109965

SEQ ID NO: 110047 - DNA, 601 bp, Human; identical to SEQ ID NO: 109966

SEQ ID NO: 110048 - DNA, 601 bp, Human; identical to SEQ ID NO: 109967

SEQ ID NO: 110049 - DNA, 601 bp, Human; identical to SEQ ID NO: 109968

SEQ ID NO: 110050 - DNA, 601 bp, Human; identical to SEQ ID NO: 109969

SEQ ID NO: 110051 - DNA, 601 bp, Human; identical to SEQ ID NO: 109970

SEQ ID NO: 110052 - DNA, 601 bp, Human; identical to SEQ ID NO: 109971

SEQ ID NO: 110053 - DNA, 601 bp, Human; identical to SEQ ID NO: 109972

SEQ ID NO: 110054 - DNA, 601 bp, Human; identical to SEQ ID NO: 109973

SEQ ID NO: 110055 - DNA, 601 bp, Human; identical to SEQ ID NO: 109974

SEQ ID NO: 110056 - DNA, 601 bp, Human; identical to SEQ ID NO: 109975

SEQ ID NO: 110057 - DNA, 601 bp, Human; identical to SEQ ID NO: 109976

SEQ ID NO: 110058 - DNA, 601 bp, Human; identical to SEQ ID NO: 109977

SEQ ID NO: 110059 - DNA, 601 bp, Human; identical to SEQ ID NO: 109978

SEQ ID NO: 110060 - DNA, 601 bp, Human; identical to SEQ ID NO: 109979

SEQ ID NO: 110061 - DNA, 601 bp, Human; identical to SEQ ID NO: 109980

SEQ ID NO: 110062 - DNA, 601 bp, Human; identical to SEQ ID NO: 109981

SEQ ID NO: 110063 - DNA, 601 bp, Human; identical to SEQ ID NO: 109982

SEQ ID NO: 110064 - DNA, 601 bp, Human; identical to SEQ ID NO: 109983

SEQ ID NO: 110065 - DNA, 601 bp, Human; identical to SEQ ID NO: 109984

SEQ ID NO: 110066 - DNA, 601 bp, Human; identical to SEQ ID NO: 109985

SEQ ID NO: 110067 - DNA, 601 bp, Human; identical to SEQ ID NO: 109986

SEQ ID NO: 110068 - DNA, 601 bp, Human; identical to SEQ ID NO: 109987

SEQ ID NO: 110069 - DNA, 601 bp, Human; identical to SEQ ID NO: 109988

SEQ ID NO: 110070 - DNA, 601 bp, Human; identical to SEQ ID NO: 109989

SEQ ID NO: 110071 - DNA, 601 bp, Human; identical to SEQ ID NO: 109990

SEQ ID NO: 110072 - DNA, 601 bp, Human; identical to SEQ ID NO: 109991

SEQ ID NO: 110073 - DNA, 601 bp, Human; identical to SEQ ID NO: 109992

SEQ ID NO: 110074 - DNA, 601 bp, Human; identical to SEQ ID NO: 109993

SEQ ID NO: 110075 - DNA, 601 bp, Human; identical to SEQ ID NO: 109994

SEQ ID NO: 110076 - DNA, 601 bp, Human; identical to SEQ ID NO: 109995

SEQ ID NO: 110077 - DNA, 601 bp, Human; identical to SEQ ID NO: 109996

SEQ ID NO: 110078 - DNA, 601 bp, Human; identical to SEQ ID NO: 109997

SEQ ID NO: 110079 - DNA, 601 bp, Human; identical to SEQ ID NO: 109998

SEQ ID NO: 110080 - DNA, 601 bp, Human; identical to SEQ ID NO: 109999

SEQ ID NO: 110081 - DNA, 601 bp, Human; identical to SEQ ID NO: 40102

SEQ ID NO: 110082 - DNA, 601 bp, Human; identical to SEQ ID NO: 40103

SEQ ID NO: 110083 - DNA, 601 bp, Human; identical to SEQ ID NO: 40104

SEQ ID NO: 110084 - DNA, 601 bp, Human
tcaacgccggtgccggatcccagcaccttgtactgtagcgtgcgcggctcaatcatctccaggggccgcccgttcaccttgatgagaccattgccgcgtttgcagtgcgccacagctgtcgctgtcttctgtaagatacaagagaaacaggggccccgtgagctccggctccagctcccatgttaccccctagattcctgcccaccgacctctcccagaccctggccttctccttcccctccccttcccatccggcgtctggctcaccttgcgtccgaagacctgcacagactgcagcggrcccttggacggcatggctccgagcgtggactagacaacctcaccgcgcggcgccgcaaccggaaaaggaaagctaggggccaccctggccgcttttcagggtctgcgcaggcgccttgagcactgcgtcgcgacgggagagagctttacggcttctgttgcggctaacgggcggggcgtctggtcagcggcgggaaggcccttaggcgctcagagcgggcgggccctgtgaggcggaagtggcgggctctgtgggcggaaggggcggggcctgggagtgtcgtgtgcggactgaagggaa

SEQ ID NO: 110085 - DNA, 601 bp, Human
tcctccatccactcaacgccggtgccggatcccagcaccttgtactgtagcgtgcgcggctcaatcatctccaggggccgcccgttcaccttgatgagaccattgccgcgtttgcagtgcgccacagctgtcgctgtcttctgtaagatacaagagaaacaggggccccgtgagctccggctccagctcccatgttaccccctagattcctgcccaccgacctctcccagaccctggccttctccttcccctccccttcccatccggcgtctggctcaccttgcgtccgaagacctgcacmgactgcagcgggcccttggacggcatggctccgagcgtggactagacaacctcaccgcgcggcgccgcaaccggaaaaggaaagctaggggccaccctggccgcttttcagggtctgcgcaggcgccttgagcactgcgtcgcgacgggagagagctttacggcttctgttgcggctaacgggcggggcgtctggtcagcggcgggaaggcccttaggcgctcagagcgggcgggccctgtgaggcggaagtggcgggctctgtgggcggaaggggcggggcctgggagtgtcgtgtgcg

SEQ ID NO: 110086 - DNA, 601 bp, Human
ggcgaaaccccgtctctactaaaaatacaaaaattagccgggcgtggtggtgcatgcctgtaatctcagctactcaagaggctgaggcaggagaatcgctttaacccgggaggcgaaggttgcagtgatccgagatcgcgccactacactccagcctgggcgacacagcgagactccctctcaaaacaaataaataaaataaaaaatagtcggtgtcccttcaccctttgggtccccccgccccagtgaggtgagcttcctaacatcccagttctcaaagcaaacccttaatcttcaacamccccatctcagcttttacatcttctgaaccccaagcccagctctattgccaaataccccactgttctacacccaacacaacttctaaacatcccgttgctgatgccagcccccccagctttcaagagctacaacatctctgtctccaagagtcctccatccactcaacgccggtgccggatcccagcaccttgtactgtagcgtgcgcggctcaatcatctccaggggccgcccgttcaccttgatgagaccattgccgcgtttgcagtgcgccacagctgtcgctgtcttctgtaagat

SEQ ID NO: 110087 - DNA, 601 bp, Human
ttattaaattctaggccaggcatggtgatcacacctgtaatcccagtccaggcagaaggatcacatgagaccaaggaccagcctgggcaataaagtgagaccccacgtctacagaaaaatatttctcaaatgagccaggcgtggtgatgtgcctgtagtcttggcaaccgaaaggctgaggtgggaggatctccaactcaggagtttaaggctgcagttcattaggattgtgctactgcactccagggtaggtgacagcaagatactgtttttaaaaaacaaccttataactcaaaaaaawtttttttaactgaccctgcaatgtagatattctttcttttaaaagtagtagagttcagaaggggcagaaatcagactctggtttctttccattctgagccaaagaaattgagagtcccaaaaagggaacagaggaaccccttttacaagcaagcatttaaacagacccaaattcggccgcacacggtggctgacgcctgcaatcccagcacttcgggaggccgaggctggtggatcacctgaggtaatgagttcgagaccactctggccaatatggcgaaaccccgtctctactaaaaat

SEQ ID NO: 110088 - DNA, 601 bp, Human
acaaaggaaatctcagaatttttattaaattctaggccaggcatggtgatcacacctgtaatcccagtccaggcagaaggatcacatgagaccaaggaccagcctgggcaataaagtgagaccccacgtctacagaaaaatatttctcaaatgagccaggcgtggtgatgtgcctgtagtcttggcaaccgaaaggctgaggtgggaggatctccaactcaggagtttaaggctgcagttcattaggattgtgctactgcactccagggtaggtgacagcaagatactgtttttaaaaaasaaccttataactcaaaaaaattttttttaactgaccctgcaatgtagatattctttcttttaaaagtagtagagttcagaaggggcagaaatcagactctggtttctttccattctgagccaaagaaattgagagtcccaaaaagggaacagaggaaccccttttacaagcaagcatttaaacagacccaaattcggccgcacacggtggctgacgcctgcaatcccagcacttcgggaggccgaggctggtggatcacctgaggtaatgagttcgagaccactctggccaatatggcga

SEQ ID NO: 110089 - DNA, 601 bp, Human
aaatacagtgacagccaataacagtaacattcaacatctgctacacaaaggaaatctcagaatttttattaaattctaggccaggcatggtgatcacacctgtaatcccagtccaggcagaaggatcacatgagaccaaggaccagcctgggcaataaagtgagaccccacgtctacagaaaaatatttctcaaatgagccaggcgtggtgatgtgcctgtagtcttggcaaccgaaaggctgaggtgggaggatctccaactcaggagtttaaggctgcagttcattaggattgtgctaytgcactccagggtaggtgacagcaagatactgtttttaaaaaacaaccttataactcaaaaaaattttttttaactgaccctgcaatgtagatattctttcttttaaaagtagtagagttcagaaggggcagaaatcagactctggtttctttccattctgagccaaagaaattgagagtcccaaaaagggaacagaggaaccccttttacaagcaagcatttaaacagacccaaattcggccgcacacggtggctgacgcctgcaatcccagcacttcgggaggccgaggctggtggat

SEQ ID NO: 110090 - DNA, 601 bp, Human
ctgtttcaagtagtcgaaagccatccctggactgttcaggtgccttttctatttcccacctgagctctctgccctttctttgagcctcacaggtttccagaattacagtacaacctgtccctggtccctagacccttcccagctccaggtcttttaccagtgcctctgtctggatacttcctttacctgctttcagctcacaggtctccttccccagttctgaccactttggatcagcttctggtattgggcccagtccttctccccaactaggctggcaggtccatgaaggcaagacctkaagtcatctggatcactgctatgtccccaaaactcaacagagggtacacatacaaatccttcaaatacagtgacagccaataacagtaacattcaacatctgctacacaaaggaaatctcagaatttttattaaattctaggccaggcatggtgatcacacctgtaatcccagtccaggcagaaggatcacatgagaccaaggaccagcctgggcaataaagtgagaccccacgtctacagaaaaatatttctcaaatgagccaggcgtggtgatgtgcctgtagtcttggcaaccgaaa

SEQ ID NO: 110091 - DNA, 601 bp, Human
acataaggccacacacagttcttgaaactttaaaatccctcaaaaactgtttattatacaagtgagttttgagtcacgatgggcttatcggtaggatttctggtagcgagcgcgggcaccagggcctccaaactttttggactcgcagcgacgagggtcagctaccagcagggtccggtcatactggatgaggatgtctttgatctccttcttggaagcctcatccacatctggcaagaagagcagggacgaggatttagataatcacacagagtccttgacttgatccccacacacccayctacctcatgggaaggacccatgctcactcacatttctggtaataggccaccagggctttggagatggactgacggatagctgtgagaaagacacacaattaaagggtacaggagcgctgtgaaggcctccctcccagagccacctcctccatgcgcccagttcctgggactcaccataaatctgggccacgtgaccaccaccctttacacggacacggatgtctacaccagcaaatcgctccttgccgagaagcagaactggctccagcagctaaaggaatggggaatgaacagggatt

SEQ ID NO: 110092 - DNA, 601 bp, Human
gacagagggtgcccagcagacccaggcaatgccgaggggcccccgacgcctgacctgggcttcaaatcccagctgtaccacctaccagtggtatgatcttggacaagtcacttaacctgcctctgcctcagtttctccatctagaaaatagagatgagcccatcctcataggagtgtgctgaggagtaaatccaacgaggcctatcaaagcactgagcacagggcctgatgcatggcagcagccgatggctgctagggaagacctgaccctgctcttccctctcacctcccccgtggagcwgagcagttaccaggtcagggtttgagtcagagtggtctgggttcaaatcctgtgaggctttgggcaaattacttagcttccctgaactttcattttcccacctgtaaaatggacctattaggtttggtgagaggataaatagagaaggctagattaaccccagagctggtacataggaaggaagtgataacgcgcgcctcctccaccctcagcatgcgaggctgggagcgggtgcaggtagctcagccgaagcccagaggccaagggacagctctgggccttcccctgccctgcgtggtt

SEQ ID NO: 110093 - DNA, 601 bp, Human
gatgtgggacagagggtgcccagcagacccaggcaatgccgaggggcccccgacgcctgacctgggcttcaaatcccagctgtaccacctaccagtggtatgatcttggacaagtcacttaacctgcctctgcctcagtttctccatctagaaaatagagatgagcccatcctcataggagtgtgctgaggagtaaatccaacgaggcctatcaaagcactgagcacagggcctgatgcatggcagcagccgatggctgctagggaagacctgaccctgctcttccctctcacctcccccrtggagcagagcagttaccaggtcagggtttgagtcagagtggtctgggttcaaatcctgtgaggctttgggcaaattacttagcttccctgaactttcattttcccacctgtaaaatggacctattaggtttggtgagaggataaatagagaaggctagattaaccccagagctggtacataggaaggaagtgataacgcgcgcctcctccaccctcagcatgcgaggctgggagcgggtgcaggtagctcagccgaagcccagaggccaagggacagctctgggccttcccctgccctg

SEQ ID NO: 110094 - DNA, 601 bp, Human
gattctgatccacaggtgtgcgcagagctggcaatccgcttttcccacaggcttctccaggggccagtgatgtgggacagagggtgcccagcagacccaggcaatgccgaggggcccccgacgcctgacctgggcttcaaatcccagctgtaccacctaccagtggtatgatcttggacaagtcacttaacctgcctctgcctcagtttctccatctagaaaatagagatgagcccatcctcataggagtgtgctgaggagtaaatccaacgaggcctatcaaagcactgagcacagggcytgatgcatggcagcagccgatggctgctagggaagacctgaccctgctcttccctctcacctcccccgtggagcagagcagttaccaggtcagggtttgagtcagagtggtctgggttcaaatcctgtgaggctttgggcaaattacttagcttccctgaactttcattttcccacctgtaaaatggacctattaggtttggtgagaggataaatagagaaggctagattaaccccagagctggtacataggaaggaagtgataacgcgcgcctcctccaccctcagcatgcgaggctgg

SEQ ID NO: 110095 - DNA, 601 bp, Human
cttcctaggagagcctgatccctgcccctgaaaggggggttcattaagatcaagaaatgagggccccagcgaggttctgcatggaccttggctctgaagctggacaggaccgtgtaagcctgggaggcaagcctcttagtggctgtgaggctcagcttccccatgggtgtcctgtgcatgctaatagccatctcccagggggatcaaatgagatcacacatgtgtgacatcttgcgcaggggccagcatgtggcaggcctttgctagatggtggctatgatcgatcttcctgtggtccttccacgatgtccaagtcaggtcaactcaaaacacatgtgttgtgtgtaaggtaatgcatgtgtcataccatgtagaagacactgtgctgagataatgggagacccacaaagagctggccatggctccctgccctccacaggctcatagtcatgggagagatcagataaagtcactctggggagtggagaccccttcgtggtagatcagaaaggcttcccggaggagggggcactggagctgcgcctggaggctttagacaggtggatgtggggagaaaaagcactatggggagagagaacag

SEQ ID NO: 110096 - DNA, 601 bp, Human
ggctttctaggctctctgctagggtttccctgccctctcctggctgcctgccttcctctagcctgggccagggcatctaaggcagctgagcagagtgtcccggggagagacagcagcagagagagcccagcccacccaagtctggggttgggggttgggtagtgaggaatcctctggggtgggttggaagcatctcggctccaggctctcttctcccttctgcctgccctcctcttcctaggagagcctgatccctgcccctgaaaggggggttcattaagatcaagaaatgagggccccmgcgaggttctgcatggaccttggctctgaagctggacaggaccgtgtaagcctgggaggcaagcctcttagtggctgtgaggctcagcttccccatgggtgtcctgtgcatgctaatagccatctcccagggggatcaaatgagatcacacatgtgtgacatcttgcgcaggggccagcatgtggcaggcctttgctagatggtggctatgatcgatcttcctgtggtccttccacgatgtccaagtcaggtcaactcaaaacacatgtgttgtgtgtaaggtaatgcatgtgtcatacc

SEQ ID NO: 110097 - DNA, 601 bp, Human
atctgcgaaacgggggatttgatgcaaagaactcacagggccctgccggctccaatatagggtctatacaacagagcaggcggcaagagccaatcacggtgcagccccacgagtcctggcaactgattggctgctcaggaaggtgtcagttccgaaggttcaggtccatccctttgctgttaacccctcatggctggcagcatggggagccagctctcaggcttatctgatcttgtatctgcagcaggggcctccccaacccccagcaaacctaccatcctcagcccagaagctctctccrccttaatctcaggtgccagagatttggggctgcctgtttttcccaacccaccttctctccctcttccccctccaatgtcaagggcccagtgtgactattttaccctcccttcacaggggcacaggcattggcagtagcaggatcccgctctggggtctcgtctggggctgagaaactttgtgcctgaagccatatgagggtgtgaggcaggattcaccacagaacttgcaagacccagtgcaaaatggaagtacagggcccatgctcaaaaatgattaagaatttcaagatgtagacatc

SEQ ID NO: 110098 - DNA, 601 bp, Human
ttacaggcatgagccacggcgcccagcctaactttcagttttaaaagctcaccagggcttccgtcgagcttggttctaacgaggtgaggtgtaagggggcgcccctctatgccacaggcacacgagggcactgtcttcctgccatgtttctgtatccccaacacctagcacggggccatccacagagcagactcaggctccccatctgcgaaacgggggatttgatgcaaagaactcacagggccctgccggctccaatatagggtctatacaacagagcaggcggcaagagccaatcacrgtgcagccccacgagtcctggcaactgattggctgctcaggaaggtgtcagttccgaaggttcaggtccatccctttgctgttaacccctcatggctggcagcatggggagccagctctcaggcttatctgatcttgtatctgcagcaggggcctccccaacccccagcaaacctaccatcctcagcccagaagctctctccaccttaatctcaggtgccagagatttggggctgcctgtttttcccaacccaccttctctccctcttccccctccaatgtcaagggcccagtgtgacta

SEQ ID NO: 110099 - DNA, 601 bp, Human
tcccaaagtgctgggattacaggcatgagccacggcgcccagcctaactttcagttttaaaagctcaccagggcttccgtcgagcttggttctaacgaggtgaggtgtaagggggcgcccctctatgccacaggcacacgagggcactgtcttcctgccatgtttctgtatccccaacacctagcacggggccatccacagagcagactcaggctccccatctgcgaaacgggggatttgatgcaaagaactcacagggccctgccggctccaatatagggtctatacaacagagcaggcrgcaagagccaatcacggtgcagccccacgagtcctggcaactgattggctgctcaggaaggtgtcagttccgaaggttcaggtccatccctttgctgttaacccctcatggctggcagcatggggagccagctctcaggcttatctgatcttgtatctgcagcaggggcctccccaacccccagcaaacctaccatcctcagcccagaagctctctccaccttaatctcaggtgccagagatttggggctgcctgtttttcccaacccaccttctctccctcttccccctccaatgtcaa

SEQ ID NO: 110100 - DNA, 601 bp, Human
cgagaggccaggcagaacctggtggggcctggcgcacacagctagggaggctgatgtcatcctgtccactggaatcccaggctggattcgccagtttaccgaagagaggatttcaaatgaaagtgaaaattaagtgccaaatgattcaacctcaattagcagcacacattcttccatgcagagctgagccctgccttcctccccggggtcggggaggcagtcatgacggagcaacaggaatgggctcagctctgttctagaaactggcgcgatggcagggagtgaggcagataagggcccygtcctcagggagcttccatccaagaggaggagtggcagcaaaggagcagcaagatgaagtcgggctgtcggggggcctatgaagacagccaagcagggtggtgggatggagagggcaggttggagacggggggctgctgtagacagggggtcaaggaggcgatgtttaagcagggaactgaatgacaggaagcagggagggttctgggtgtcataaaggggagtgaagaggttcgggggaggcagagatcatcaaggcagtctgtgtacttggagtgaagtgggtaaggggtgtggtaaa

SEQ ID NO: 110101 - DNA, 601 bp, Human
gctaaggcagaggcttgagccactggacatcatgaggcacccacacacacagcggcaggagcagggatggggctgccgagaggccaggcagaacctggtggggcctggcgcacacagctagggaggctgatgtcatcctgtccactggaatcccaggctggattcgccagtttaccgaagagaggatttcaaatgaaagtgaaaattaagtgccaaatgattcaacctcaattagcagcacacattcttccatgcagagctgagccctgccttcctccccggggtcggggaggcagtcatracggagcaacaggaatgggctcagctctgttctagaaactggcgcgatggcagggagtgaggcagataagggccccgtcctcagggagcttccatccaagaggaggagtggcagcaaaggagcagcaagatgaagtcgggctgtcggggggcctatgaagacagccaagcagggtggtgggatggagagggcaggttggagacggggggctgctgtagacagggggtcaaggaggcgatgtttaagcagggaactgaatgacaggaagcagggagggttctgggtgtcataaaggggagt

SEQ ID NO: 110102 - DNA, 601 bp, Human
ctagtgcctgtagaactctgaggcctggccctagaatggagtggaggaggggaatggggcaggtggaaggggccccagcacccaggtatcacctgaccaccaccgaagcccacccccacggaggaaggatggtgcattcaaggaacccagagaccacagggcacgcatggctagtgacttgggggtgagaaaggattgatgtcataggggcacggaccagtcaggtcttggttctcagggcaatggggaaccagcaaggggccaagccaggcagaggtgatgagatcagatttgcatttakaaaaggtcccagctgggcacggtggctcacgcctgtaatcccagcactttgggaggctgaggcaggtggatcaccaggtcaagagatcgagaccatcctggccaacatggtgaaaccctgtctctaccaaaaatacaaaacttagctgggtgtggtggtgcatgcctgtagtcccagctacttgggaggctgaggcagcagaatcgcttgaacccgggaggcagaggttgcagtgagccgagatcgcaccactgcactccagcctggtgacacagcgagactccgtcaggaaggaaggaa

SEQ ID NO: 110103 - DNA, 601 bp, Human
gaaattgaggcttacagagaggaagggacttgcccaagatctcccagccagtgggtggcagagcaaggctagatcctgttacccaattcagaaaggcccacatggtaagcatcgctgctatttcatggctggaaatggagttggagagagcagagaccatgttttcatctagtgcctgtagaactctgaggcctggccctagaatggagtggaggaggggaatggggcaggtggaaggggccccagcacccaggtatcacctgaccaccaccgaagcccacccccacggaggaaggatggwgcattcaaggaacccagagaccacagggcacgcatggctagtgacttgggggtgagaaaggattgatgtcataggggcacggaccagtcaggtcttggttctcagggcaatggggaaccagcaaggggccaagccaggcagaggtgatgagatcagatttgcatttagaaaaggtcccagctgggcacggtggctcacgcctgtaatcccagcactttgggaggctgaggcaggtggatcaccaggtcaagagatcgagaccatcctggccaacatggtgaaaccctgtctctaccaaaa

SEQ ID NO: 110104 - DNA, 601 bp, Human
ctccctgtgctggtccacacaaagcccctgcccagaatgtccttcccaccttagctgtccatatgttctcaccaacctggtctctggcccccacaccctccaggctgcccagccctccaagcctttgatcctgtctgtatctccctctggaatacgcttccagccccatttcactcccaacttctattcatgcttcaaaaccctgcccagacaagtcctcctctctggcggagcttcgtcgtcctctacctgtaaagagcccatggttccctctctcaggtgactactttgcctggaccaygagcaggcacttggtgagtctccaccccttcaagggctgtgggttctgtgtgggccaggccgatgcctgcttattctccacagtctcaggcctgtcacccagtgaatgcaggtggaagggaattaaaccacctcctccaggaagtcctcagagaacgctactcaatgttaggctgcagaagcgctaacacttcagagtaacacaaaagacacctctcctgagaggagtcccccacacccccaaaaagtgggcagcccagcctttttaatacactttgcctgtccagccctggacagaatt

SEQ ID NO: 110105 - DNA, 601 bp, Human
acgaccagtgctcactgccccaggccacagctgtgcctccgggaatgccctcaccgcctgcccctgagggttagggaatcactgtcacttttcccgctgtggtcccccacacaggccctgacctggtccactgagacctccggctcctctgacttctcctcctactcctcccctcgcacaccagccaagccgtttcccgggaaaggctcacactgcccacctccctgtgctggtccacacaaagcccctgcccagaatgtccttcccaccttagctgtccatatgttctcaccaacctggyctctggcccccacaccctccaggctgcccagccctccaagcctttgatcctgtctgtatctccctctggaatacgcttccagccccatttcactcccaacttctattcatgcttcaaaaccctgcccagacaagtcctcctctctggcggagcttcgtcgtcctctacctgtaaagagcccatggttccctctctcaggtgactactttgcctggaccacgagcaggcacttggtgagtctccaccccttcaagggctgtgggttctgtgtgggccaggccgatgcctgcttattctcca

SEQ ID NO: 110106 - DNA, 601 bp, Human
ttgtggtccagctccatgtcattcctcggaggctgagacctagagacagtctgcgactggcccaaagtcacacagcatttgcaattgggtttctttatttgtttcattactgattcattatattttttaaaaatgtaatacaagttaacaagaagaaaaaaagattgtctcttaatccttttcctacccgtacctgtcctttggaaaggtaattgaggctgtgtaacttttcctcccagtcttgatgagaataaacttacctctctccctatgctgccactcaatgtttgctttttgttgttttttgtttgtttgtttgttttttgaaatggaatcacgctctgtcgcccaggctggagtgcagtggcaccatctcggcccactgcaaactctgccccctgggttcaagtgattctcctgcctcggcctcccaagtagctgggattacaggcatgcaccaccacgcccagctaatttttgtatttttagtagaaacagggtttcaccatgttgaccaggctggtctcgaacccctgaacttaagtgatccgcccgcctcggcctctcaaagtgctaggattacaggcgtgagccactgcgc

SEQ ID NO: 110107 - DNA, 601 bp, Human
tctgtggataggagagcggccggagacggtcgtagtcctcctgcccagcagtgtcccacagccccaggttcactggcttgctgtccaccatcacattggctgaatagttgtcaaacctgtggggagcaggcaaggcggaggtaaggtcaatctcaaaccccagaacctgggaattgtggtccagctccatgtcattcctcggaggctgagacctagagacagtctgcgactggcccaaagtcacacagcatttgcaattgggtttctttatttgtttcattactgattcattatatttttwaaaaatgtaatacaagttaacaagaagaaaaaaagattgtctcttaatccttttcctacccgtacctgtcctttggaaaggtaattgaggctgtgtaacttttcctcccagtcttgatgagaataaacttacctctctccctatgctgccactcaatgtttgctttttgttgttttttgtttgtttgtttgttttttgaaatggaatcacgctctgtcgcccaggctggagtgcagtggcaccatctcggcccactgcaaactctgccccctgggttcaagtgattctcctgcctcggcc

SEQ ID NO: 110108 - DNA, 601 bp, Human
cactggggaccctctctgtatgcgacctctgctgccccagggaccagcctagagtcaccagttcctccctctgtccctcagggttacctgccccagagcccccaaggcccaccctgtccagctcaccttggcgcggacgttctcataagaggctgggctgacgagggagaagcagatgaggaagacgtcctggggacagagcaagcgagggttgctagtgaggagggcccagaggtgtcccaccatggcagccaccgagaggtggagcttggggctccctgagggtggaacaccccagggratgctggggacttaggatctgggcagagcagagatacccttctcgcctctaccacgaggctgctgtttgttaggacgctcactaaaggccagggcctctgcgaagtggttatcctcacatgtcactctgcagcaagcactgctggtagccccattcctcagacagggaaagtgaggcttccagaggttaaagagtttgccaacgtgcactctggtgaggggaggatctgggattctagagtccatactccaatccatatactatccaccatctgattaccggccttagccgcctccctgc

SEQ ID NO: 110109 - DNA, 601 bp, Human
ggaaagtgggggtatagctaactatcgcagcaccccccaccccaggtcctctgaatcttaccccctcaagtccctctgccagccctggttgacactggggaccctctctgtatgcgacctctgctgccccagggaccagcctagagtcaccagttcctccctctgtccctcagggttacctgccccagagcccccaaggcccaccctgtccagctcaccttggcgcggacgttctcataagaggctgggctgacgagggagaagcagatgaggaagacgtcctggggacagagcaagcgagggttgctagtgaggagggcccagaggtgtcccaccatggcagccaccgagaggtggagcttggggctccctgagggtggaacaccccagggaatgctggggacttaggatctgggcagagcagagatacccttctcgcctctaccacgaggctgctgtttgttaggacgctcactaaaggccagggcctctgcgaagtggttatcctcacatgtcactctgcagcaagcactgctggtagccccattcctcagacagggaaagtgaggcttccagaggttaaagagtttgccaacgtgca

SEQ ID NO: 110110 - DNA, 601 bp, Human
gaagatcagaggtgggcacgacggtgaggagagagagacgtgaggtggcacagggaggggaggccacgacgttgtgcaggaaggagggggcgcatgattgtaggaaaggaggaggcgaggttttgtgcagacataagaagcaaacatgaggttatgtgacaatcggaggcggacatgaggttgtgtggggaggaggagaatgcagccatggaaagtgggggtatagctaactatcgcagcaccccccaccccaggtcctctgaatcttaccccctcaagtccctctgccagccctggttgrcactggggaccctctctgtatgcgacctctgctgccccagggaccagcctagagtcaccagttcctccctctgtccctcagggttacctgccccagagcccccaaggcccaccctgtccagctcaccttggcgcggacgttctcataagaggctgggctgacgagggagaagcagatgaggaagacgtcctggggacagagcaagcgagggttgctagtgaggagggcccagaggtgtcccaccatggcagccaccgagaggtggagcttggggctccctgagggtggaacaccccaggg

SEQ ID NO: 110111 - DNA, 601 bp, Human
atggaggagagagggcctttggggattgtccaggtcagcttatgtggagagggagactgaggcccagagaggggcagccactaacccaaggtcacacagccaatcagtatcagagccaggaccagaatccaggcctccagcaccctccacatgatcccaaagcatgtgctttacaagggagaggtcagtgacagccaggccacaggctggagagctgcaccctgaatagaaggagtccaggggcaggggttggaggggtgctggttggtcagaaagagaaggcagggatgaatccttgatrtttaaaaggaaagacttgcaggctggggagctgtggccctaggacaggggaagggagccagggtgtgagccatagtctgaggcccccggggaagatggctgtgtcaccacgctagtcacagaaggagggaggtggtggctgcggtttctcttcctgtgaagagatgtgagtccccagggccctcccagttccggcagggggaggtggggcggggctggggcggtggggcgggaggaggtctagtggattcaatttgggggccaaaccctgggcctgcagagtcctgtggtgaggcagagg

SEQ ID NO: 110112 - DNA, 601 bp, Human
ggtgggggcagtggaggtgcagggaggacagatggccctcagctttgtggcttagggagccagtccacccctgtcagaatcctggctgggtggccttaagccagcaacatgtccccccgagcctgtttcctctctgtaaagtgaaggtgacaagagctcttcgtcatagctgctgtgagaatgaagtggctcccaggaagtgctcagtccacatcagctgtgattatcagctgggctcagggctgcccccaaaacttgtcatcccagggctggggagtccaggtgggcagaggcagttgcygcttccctcactatccctgccagtccccccaggactccccctaggcctaagctggtctgaggcacagttaaaatcactgcccctgccccagctccatgcagggtcagccaggaaagactggctagaggccaaggcaagaactctgagtcaccaccttatggaggagagagggcctttggggattgtccaggtcagcttatgtggagagggagactgaggcccagagaggggcagccactaacccaaggtcacacagccaatcagtatcagagccaggaccagaatccaggcctccagcac

SEQ ID NO: 110113 - DNA, 601 bp, Human
ctggcaagagcagggtgccctgggctcagcccggagtctggtcaccacagccccctgtgttgaggaggtgtcactgggcacttggccactgtctccttataagggaccacatctgcgtccacttcccccacatccaccaactgccttttccctggcacccagccacccactcacccaggacaagggtcctgagctggggggccagggctcactttggctcggcctctcactgctctaggactttagtcagttccccctctccgggcctcagtctcccatctgtctaggactcattgccatrcgatggctcatcaagctgaggcagggggcaggggagctacagagagggcaaggagggtgagggggcggtgggggcagtggaggtgcagggaggacagatggccctcagctttgtggcttagggagccagtccacccctgtcagaatcctggctgggtggccttaagccagcaacatgtccccccgagcctgtttcctctctgtaaagtgaaggtgacaagagctcttcgtcatagctgctgtgagaatgaagtggctcccaggaagtgctcagtccacatcagctgtgattatcagctgg

SEQ ID NO: 110114 - DNA, 601 bp, Human
tcactgaccccaccatctgccccctggggatcatagctcaggctctcccacctccacccacatatgtgggtgcaggatctccctggctcgactgggctctcctagggccagggaccaaggcatcttttccatcacctcctgcaggaatgggcagagtggggctccgtgacacccactccctggcccgggggtggggggttaccaggcattcattcataccttgggccttgcctctggaagatgagctccagagagtgagactggcccaggcagatgacaagtaggctgcggaaactgaggyaacctccatacccaccttctttctgtcctggcctaaatgccactcacagtgaaccaaaggccactgctcagccagggcctgctgtgtatgggagttgggcactagagtgggggactcttacccctagaggaggctgcaggcgcgcttctgctgccgcgtgggctgagggcacagcacggcccggatggcctcgtcgaacacggttttcaggcctctctgggtgagagctgagcactccaggtatttcaccgagtctggttggggagatggacaggagagccaaggcctaagtggcggggg

SEQ ID NO: 110115 - DNA, 601 bp, Human
tttgactcccaccaggactgccaatgctgctctccccacctcaccagtcctctctgtccttctggtcccacacctccaggaggccttgtgggctgcctccaactcactgaccccaccatctgccccctggggatcatagctcaggctctcccacctccacccacatatgtgggtgcaggatctccctggctcgactgggctctcctagggccagggaccaaggcatcttttccatcacctcctgcaggaatgggcagagtggggctccgtgacacccactccctggcccgggggtgggggrttaccaggcattcattcataccttgggccttgcctctggaagatgagctccagagagtgagactggcccaggcagatgacaagtaggctgcggaaactgaggcaacctccatacccaccttctttctgtcctggcctaaatgccactcacagtgaaccaaaggccactgctcagccagggcctgctgtgtatgggagttgggcactagagtgggggactcttacccctagaggaggctgcaggcgcgcttctgctgccgcgtgggctgagggcacagcacggcccggatggcctcgtcga

SEQ ID NO: 110116 - DNA, 601 bp, Human
agctggcctcaggagggagtaagagccccatccctgaaggtacacaagttgtggcagcaaccatctggcctgcagtttccagaggggagtcaggcgtggggtgggactggagtgaacgggtagatgcttccacatgcggcagttggcactgacggcaggaacacgggggtggcttaatgggtcctggggctcccctctggccctcaggaaggcaggagcatgaggggcttgggatgcagcacctgcaaatttgcacgttcctggcctcaggaggcctccagtacagaaaagaccatcaacraagctctgcagccatctgctaagaaacgccacagggaggggacagcatggccagccggggtgccatcaggctttgggtggggatcctggaggatcagacccatctaggtgggagcgctggggtgcaacctggaaggaagataagcagggaaagagaatttggggacatgcagaatccacagctctcgccttcctggctcacagctcattcccacctccaggtctttgctcaaggtttgactcccaccaggactgccaatgctgctctccccacctcaccagtcctctctgtccttctggt

SEQ ID NO: 110117 - DNA, 601 bp, Human
atttgaagctcagcctactcaagcagctgacctcatcatttcaaaacagatttgatttccagggttgcctgctgtcagtccagccttctttccattatattacagctgggcagcagcccgcaaagatcaggggtttgagaccgtacatcataataccaagacaacgagtctcaaaacacactttaaaaaatcgggttctgtcagaagctcaagaagggaagaggcccgaggctcgacctgcatcacctccctggaaagccagggatgagataccctggctttaataaatgtttttttttttaagagcagagcggaaccaggaggagaaactgagccgctcagcaaaaacgaagtaacagctgtactagtcacaggggcaggatagggaggttccaagagggcactcagaaggggctctgtggttggcaggccactacagatcataagccgtccatcgctgaacagggggtggggtagatttaagatcagagatcaaatctacttctctatcctagcctccagtttcacaaaaaaggaaagataacctatgcactgtgaattcctaagaacaggggccaaacaccgctcagcctggtacccc

SEQ ID NO: 110118 - DNA, 601 bp, Human
tagaggcaaaaatttgaagctcagcctactcaagcagctgacctcatcatttcaaaacagatttgatttccagggttgcctgctgtcagtccagccttctttccattatattacagctgggcagcagcccgcaaagatcaggggtttgagaccgtacatcataataccaagacaacgagtctcaaaacacactttaaaaaatcgggttctgtcagaagctcaagaagggaagaggcccgaggctcgacctgcatcacctccctggaaagccagggatgagataccctggctttaataaatrtttttttttttaagagcagagcggaaccaggaggagaaactgagccgctcagcaaaaacgaagtaacagctgtactagtcacaggggcaggatagggaggttccaagagggcactcagaaggggctctgtggttggcaggccactacagatcataagccgtccatcgctgaacagggggtggggtagatttaagatcagagatcaaatctacttctctatcctagcctccagtttcacaaaaaaggaaagataacctatgcactgtgaattcctaagaacaggggccaaacaccgctcag

SEQ ID NO: 110119 - DNA, 601 bp, Human
attgaccacccccccacccctactttagaggcaaaaatttgaagctcagcctactcaagcagctgacctcatcatttcaaaacagatttgatttccagggttgcctgctgtcagtccagccttctttccattatattacagctgggcagcagcccgcaaagatcaggggtttgagaccgtacatcataataccaagacaacgagtctcaaaacacactttaaaaaatcgggttctgtcagaagctcaagaagggaagaggcccgaggctcgacctgcatcacctccctggaaagccagggrtgagataccctggctttaataaatgtttttttttttaagagcagagcggaaccaggaggagaaactgagccgctcagcaaaaacgaagtaacagctgtactagtcacaggggcaggatagggaggttccaagagggcactcagaaggggctctgtggttggcaggccactacagatcataagccgtccatcgctgaacagggggtggggtagatttaagatcagagatcaaatctacttctctatcctagcctccagtttcacaaaaaaggaaagataacctatgcactgtgaattccta

SEQ ID NO: 110120 - DNA, 601 bp, Human
tagaaactataggaagaggacagaagaaaaagggtggtggtctcagaacaatttgtattaaataaatattgctgagctcctacgtgttaggccctataccagataatttaacaccattgaccacccccccacccctactttagaggcaaaaatttgaagctcagcctactcaagcagctgacctcatcatttcaaaacagatttgatttccagggttgcctgctgtcagtccagccttctttccattatattacagctgggcagcagcccgcaaagatcaggggtttgagaccgtacatcrtaataccaagacaacgagtctcaaaacacactttaaaaaatcgggttctgtcagaagctcaagaagggaagaggcccgaggctcgacctgcatcacctccctggaaagccagggatgagataccctggctttaataaatgtttttttttttaagagcagagcggaaccaggaggagaaactgagccgctcagcaaaaacgaagtaacagctgtactagtcacaggggcaggatagggaggttccaagagggcactcagaaggggctctgtggttggcaggccactacagatcataagccg

SEQ ID NO: 110121 - DNA, 601 bp, Human
aaaaaacaaaaatcaaatgtttcttggaggctggagagcaatcaaaagaacaggtatgctgaacttagtaaactctcctcaaagccccatgctggggagattgaggcttccttcagagatgacatttgggtgacagcaacacaggatgaacctagaagtttcatctttctaatagaaactataggaagaggacagaagaaaaagggtggtggtctcagaacaatttgtattaaataaatattgctgagctcctacgtgttaggccctataccagataatttaacaccattgaccacccccmcacccctactttagaggcaaaaatttgaagctcagcctactcaagcagctgacctcatcatttcaaaacagatttgatttccagggttgcctgctgtcagtccagccttctttccattatattacagctgggcagcagcccgcaaagatcaggggtttgagaccgtacatcataataccaagacaacgagtctcaaaacacactttaaaaaatcgggttctgtcagaagctcaagaagggaagaggcccgaggctcgacctgcatcacctccctggaaagccagggatgagataccctgg

SEQ ID NO: 110122 - DNA, 601 bp, Human
acaatcctgtgaggtaggagccaatgttatccgcactctccagataagaaaaccaaagcacagagaaatgaagaaattgcccaaagttgaaatgctagtggatgaaaaatgtgaaccaaagcagtctgaccccagagtctgcactctgcataatgctatagccctcttgggaattaaaaaaccggcgctgtatagcagatggctgcccgacacttctataaaaaaacctatgcatttatcttccgttgtaaccttctgaaaatgcttagaaggcgagttcctagaggaaaattcactacayaagtatttcttggaggccgggcgcggtggctcacgcctgtaatcccagcactttgagaggccgaggtgggcggatcacgaggtcagcagttcgagaccagcctggtcaacatggtgaaacccagtctctactaaaaatacaaaaattagctgggcgtggtggcgggcacctgtaataccagctactcaggaggcggaggttgcagtgagccaagatcctgccattacactccagcctgggcaacagagcaagactccgtctcaaaaaaacaaaaatcaaatgtttcttggaggctggaga

SEQ ID NO: 110123 - DNA, 601 bp, Human
ctcaggcccaaagttgccatgttaaatgttcacgaatactgccaggcactgttcttactgtttaccactcattcattcatacagtcctgccaacaatcctgtgaggtaggagccaatgttatccgcactctccagataagaaaaccaaagcacagagaaatgaagaaattgcccaaagttgaaatgctagtggatgaaaaatgtgaaccaaagcagtctgaccccagagtctgcactctgcataatgctatagccctcttgggaattaaaaaaccggcgctgtatagcagatggctgcccracacttctataaaaaaacctatgcatttatcttccgttgtaaccttctgaaaatgcttagaaggcgagttcctagaggaaaattcactacacaagtatttcttggaggccgggcgcggtggctcacgcctgtaatcccagcactttgagaggccgaggtgggcggatcacgaggtcagcagttcgagaccagcctggtcaacatggtgaaacccagtctctactaaaaatacaaaaattagctgggcgtggtggcgggcacctgtaataccagctactcaggaggcggaggttgcagtga

SEQ ID NO: 110124 - DNA, 601 bp, Human
caaggaggtccccacagacctcaggcccaaagttgccatgttaaatgttcacgaatactgccaggcactgttcttactgtttaccactcattcattcatacagtcctgccaacaatcctgtgaggtaggagccaatgttatccgcactctccagataagaaaaccaaagcacagagaaatgaagaaattgcccaaagttgaaatgctagtggatgaaaaatgtgaaccaaagcagtctgaccccagagtctgcactctgcataatgctatagccctcttgggaattaaaaaaccggcgctstatagcagatggctgcccgacacttctataaaaaaacctatgcatttatcttccgttgtaaccttctgaaaatgcttagaaggcgagttcctagaggaaaattcactacacaagtatttcttggaggccgggcgcggtggctcacgcctgtaatcccagcactttgagaggccgaggtgggcggatcacgaggtcagcagttcgagaccagcctggtcaacatggtgaaacccagtctctactaaaaatacaaaaattagctgggcgtggtggcgggcacctgtaataccagctactcag

SEQ ID NO: 110125 - DNA, 601 bp, Human
tttcaattttctgccatcaacgcaaatcctgtgtgcagtgcaagcggacataaagccaggcagaagaactgccagagggccaaggaggtccccacagacctcaggcccaaagttgccatgttaaatgttcacgaatactgccaggcactgttcttactgtttaccactcattcattcatacagtcctgccaacaatcctgtgaggtaggagccaatgttatccgcactctccagataagaaaaccaaagcacagagaaatgaagaaattgcccaaagttgaaatgctagtggatgaaaaaygtgaaccaaagcagtctgaccccagagtctgcactctgcataatgctatagccctcttgggaattaaaaaaccggcgctgtatagcagatggctgcccgacacttctataaaaaaacctatgcatttatcttccgttgtaaccttctgaaaatgcttagaaggcgagttcctagaggaaaattcactacacaagtatttcttggaggccgggcgcggtggctcacgcctgtaatcccagcactttgagaggccgaggtgggcggatcacgaggtcagcagttcgagaccagcctggtcaa

SEQ ID NO: 110126 - DNA, 601 bp, Human
ttcaattttcctttctcattgtttcaattttctgccatcaacgcaaatcctgtgtgcagtgcaagcggacataaagccaggcagaagaactgccagagggccaaggaggtccccacagacctcaggcccaaagttgccatgttaaatgttcacgaatactgccaggcactgttcttactgtttaccactcattcattcatacagtcctgccaacaatcctgtgaggtaggagccaatgttatccgcactctccagataagaaaaccaaagcacagagaaatgaagaaattgcccaaagttraaatgctagtggatgaaaaatgtgaaccaaagcagtctgaccccagagtctgcactctgcataatgctatagccctcttgggaattaaaaaaccggcgctgtatagcagatggctgcccgacacttctataaaaaaacctatgcatttatcttccgttgtaaccttctgaaaatgcttagaaggcgagttcctagaggaaaattcactacacaagtatttcttggaggccgggcgcggtggctcacgcctgtaatcccagcactttgagaggccgaggtgggcggatcacgaggtcagca

SEQ ID NO: 110127 - DNA, 601 bp, Human
caggctagtcttgaactcctgacctcaaatgatcctcccgcctcgacctcccaaagtgctgggattacaggcgtgagccaccacgtccagccaccttagtcttttccatctgcaaaataaacaagatccttgttctaagcactttgtataatgccacacaagtattcagacttgcaaaagtgcatttatgtatatagagtgctgagaaaaaaagatctttaagtatatcctgaaattcaattttcctttctcattgtttcaattttctgccatcaacgcaaatcctgtgtgcagtgcaagyggacataaagccaggcagaagaactgccagagggccaaggaggtccccacagacctcaggcccaaagttgccatgttaaatgttcacgaatactgccaggcactgttcttactgtttaccactcattcattcatacagtcctgccaacaatcctgtgaggtaggagccaatgttatccgcactctccagataagaaaaccaaagcacagagaaatgaagaaattgcccaaagttgaaatgctagtggatgaaaaatgtgaaccaaagcagtctgaccccagagtctgcactctgcataat

SEQ ID NO: 110128 - DNA, 601 bp, Human
gcctaaagaactttctaagccaagaatctgaaggactcaaactaacccatttcactctctgcgttattgtgtgagaatctgaggtatttattgctaaccaccatctccattatcaggggcccatggcaggtatgtctaatagatcacgatatactttcttgccaatctcagcctcagctatcctaacttagttctccaggcagccacctccaactatctgaagtggcagagagaaaaagcctttttatggtaccaggatcttaaaaccaggggttttacttttttttttttttttttttttggagacaggatctggctctgtcaccaggctggagtacaatagcatgatctctgctcactgcaacctctaacttctgggttcaagtgattgtcctgcctcagccacccgagtagctgggattacaggtgcacgccaccacgcccagctaatgttttcaacaggtttttaaaagggcccaaaaccccattttaataggctagacctctttaatgaatggtctaagttttgagggctatttccaaaaatgtggttattgttaaagcccagaatacatccctaaaagttatgaattattgttgg

SEQ ID NO: 110129 - DNA, 601 bp, Human
aactacgaaaaatgggcttagagaaaggaagagacccagacggtgcatactggaggtgttagaaaaggtacactgcctccaaatactgaccagatgattttacttcatctatagtgactgttcactgatagttccaatctggggtgtagtggccgctggaccacacaacaccaggaggctcaaaggaccagcatacagggggcttcctagagttgacccacagcagaactgagcccaggtaagctccagagcctcttcttgcctgcctgtgtttccctttagtgcgcatgaccagcacaasgagttagtttcctgcccatgctatctgccatgaaccagcctgagaacgacaagctaaaagggggcttaactggttgtagaaagtattttccttttttgcagtggtggggaatacaaccatcctcctgctttggtcctgtggtttccaaatacggccagtctgggaagggtgtcttgttccagcaggatgaaaatctcacctctctttctgtttggcactcttaggcaggatctgcaggttgaactgcaacatgttccgacgatctttgtctctgcggaggttcctctgggcatcagcaag

SEQ ID NO: 110130 - DNA, 601 bp, Human
accactaaattgtacggtatgtgaagtatatctcatctaagctattaataaagacaaccaaataaacagaaccaaattccaaggcagaattctggtataaatacattacctgtgatttctgatcccatttctgcctaaccccaaattgtttctggaactttttctgcagtcgaatgcgttctctggaaagacagacatatgatctcagtgcagacctttaaaccagtggcttcttcaaaaggcacacgctgccattctcttcagctaaaccttaccatcaccactaactcctttaaactaygaaaaatgggcttagagaaaggaagagacccagacggtgcatactggaggtgttagaaaaggtacactgcctccaaatactgaccagatgattttacttcatctatagtgactgttcactgatagttccaatctggggtgtagtggccgctggaccacacaacaccaggaggctcaaaggaccagcatacagggggcttcctagagttgacccacagcagaactgagcccaggtaagctccagagcctcttcttgcctgcctgtgtttccctttagtgcgcatgaccagcacaaggagtt

SEQ ID NO: 110131 - DNA, 601 bp, Human
tgatgaaaatggtctgaaattgaccagttacagaactcttcaaatatattaaaaaccactaaattgtacggtatgtgaagtatatctcatctaagctattaataaagacaaccaaataaacagaaccaaattccaaggcagaattctggtataaatacattacctgtgatttctgatcccatttctgcctaaccccaaattgtttctggaactttttctgcagtcgaatgcgttctctggaaagacagacatatgatctcagtgcagacctttaaaccagtggcttcttcaaaaggcacaygctgccattctcttcagctaaaccttaccatcaccactaactcctttaaactacgaaaaatgggcttagagaaaggaagagacccagacggtgcatactggaggtgttagaaaaggtacactgcctccaaatactgaccagatgattttacttcatctatagtgactgttcactgatagttccaatctggggtgtagtggccgctggaccacacaacaccaggaggctcaaaggaccagcatacagggggcttcctagagttgacccacagcagaactgagcccaggtaagctccagagc

SEQ ID NO: 110132 - DNA, 601 bp, Human
atggatgactcttgaaaacacgctaaataaaagctgccagttactaaagaccacatattgtatgattccatttatgtaaaatgtctagaacaaaaaatcccgagacagaaaacagattcatagctgcctactgctgggctactgggggtgctggtgtttgggtgtgcctcctggaattcatttggcaatctggttgctactgcggcagtgtcgggaggtagggcctttaagagattaggtcgttaaaaggaataaatgcctcatgcccttctctcaggaatgggctaactacccaaagttyagcccttttctctgttgcaccctgctcccgcttctgctttttctgccatgctatcaagcagcatgaggccctcaccagatgtggctcctgatctgggacttcccagtccccagaaccatgagctaaagaaaccgctttataacttacccactctcaggtattctgttctagcaacggaaaacagatcaagacagggtgactgctaaagggtaagggattcttttgagggtgatgaaaatggtctgaaattgaccagttacagaactcttcaaatatattaaaaaccactaaattgtacgg

SEQ ID NO: 110133 - DNA, 601 bp, Human
tcacctgatgaacatgtagaaggtcctttatatttctctcgggttattaactattcttgatacagcatcatatccaacaaaatgtagcttcacttttgcttacatgtgttctgttctcagaatgcccacacaagcacacgcaggtgaacgttcacagcagcatcaataatagtcaaaaagtgaaaaacaactcaaatgttcatcagcatgtgaatggctcaaaacaacatgatgtataattcaaaggactcttatttggcaataaacaagaaaagaagctcatctgggctgggtgtggtgyctcacgcctgtaatcccagcactttgggaggctgaggtgggtggatcatctgaggtcaggagtttgaaaccagccgggccaacatggtaaaaccctgtctctacaaaacatatgaaaaaaaaaaaaaaaaagccagacatgttggcacgtgcctgtaatcctagctacctgggaggctgaggtgtgagaatcactttaacccgggaggcggaggttgcagtgagccaagatcgcgccactggcactgcagcttgggtgacagagtgagattccatcttaaaaaaacaaaaaacaaaaacc

SEQ ID NO: 110134 - DNA, 601 bp, Human
gggttccactcccaggtaatgatgtcacctgatgaacatgtagaaggtcctttatatttctctcgggttattaactattcttgatacagcatcatatccaacaaaatgtagcttcacttttgcttacatgtgttctgttctcagaatgcccacacaagcacacgcaggtgaacgttcacagcagcatcaataatagtcaaaaagtgaaaaacaactcaaatgttcatcagcatgtgaatggctcaaaacaacatgatgtataattcaaaggactcttatttggcaataaacaagaaaagargctcatctgggctgggtgtggtgcctcacgcctgtaatcccagcactttgggaggctgaggtgggtggatcatctgaggtcaggagtttgaaaccagccgggccaacatggtaaaaccctgtctctacaaaacatatgaaaaaaaaaaaaaaaaagccagacatgttggcacgtgcctgtaatcctagctacctgggaggctgaggtgtgagaatcactttaacccgggaggcggaggttgcagtgagccaagatcgcgccactggcactgcagcttgggtgacagagtgagattccatc

SEQ ID NO: 110135 - DNA, 601 bp, Human
taacatttgggccaggtgtgttggctcacacctctaatcgcagcactttgggaggccaaggctgatggatcacttgaggccaggagttcgagaccagcctcgccaacatggtgaaaccgtctctactaaaaatatagaaagtagccaggcgtaatggcacatgcctgtaatcccagctattcgggaggctgaggcagaagaatcacttgaatgtgggaggcagacgctgcagtgagccaagactgcgccactgcactccagcctgggtgacagagtgagactctctgtctcaattaaaaaaaaaaaaaaacaacaaaaaagcaacatttggaagcttgctattagggtgctgtgaggactccaaaagctgaggcctcaagcaggtactgcagtgacagtctcttctcctaacctctaaagagtgtgggagattcagacactgctgctgtcaattcccttgggaagacagaccactttctatccattctctagtaccagagacttgttctgtaccaacaaaaatactcaatgcctttgagttgctccccaggcacgcttcttaccaaagtcagagttgtctctcttgtcaaagaagagtttg

SEQ ID NO: 110136 - DNA, 601 bp, Human
tgaggatgaggtatttgccctcctccagcttcatgcagatgtcaatgacgcagcgtaaaatgccccaggcattctccacgctcaggttgatctggctggcaaactcattaggcttgaactgctgggtgcctaggatgacgtggcgtgaggagtctttcacgtggtaccgagacacataactaacaggggaagggatatcagtggtcagagcagggcagcacagagacagcaacacttgggatcaaatgtcaattaaatggtgatacctggtccactgctattttttcttttttttttttttgagacggagtctggctctgttgcccaggctggagtgcagtggcgccatcttggctcactgcaagctccgcctcccgggttcacaccattctcctgcctcagccccctgagtagctggggctacaggcgcccgccactacgcccggctaattttttgtatttttagttgagacagggtttcatcgtgttagccaggatggtcttgatctcctgacctcgtgatctgccagcctgggcctcccaaagtgctaggattacaggcatgagccaccgcgcccggcagtccactgctattttcaag

SEQ ID NO: 110137 - DNA, 601 bp, Human
cccagattctgaattccacatagaaattgctgaatctcatccccactctgtcaggaatctttgaagaaacgactgtaaatcgttaatgcaggcagacgatgagggaaagactaaacagatatatattttatttcatctgctaaatgtcagagagcaagttagacacacattccactaagcatcaaaggccctcgtagtctcggtggaaggacaaactccagctccacatcactggtttaagtttcttcctctgaaagacacaaaaaatgtaagagaaatgagccaggttgtgtgatatgaygttcactttcctttctgaacctctgctggactgtgcgtgagttttcaacacttccattccgaagttaagcctttcagatgctcacagggctgggcaggtatttccttcagtcaccagctggtggagcaggagagacaactttcaggctatttaacccggagcggagcttttccctctagaccaccggcttcaatctgggacttccctcatcttcctctacctctgccacagtccagccgcttctctaaaacaccgctatcctccccaaccacttgatgtgatctaaaggctctagaagaa

SEQ ID NO: 110138 - DNA, 601 bp, Human
aggttcctgctccagcgcggctcctggactggccccgggtgctggccccgggggtttcaatccaagcataattcagtgaagcatgtgtttggcagcgggacccagctcaccgttttaggtacgtggctctaacttcccagcctgtcccaccctctcctgtctctggaaaaatctgttttctttctctgggtcttcttcccctctggcctccaggccttaggcatgaaaccctccctttctccttggggtctgggggaagtgggctagtctcaggtcaactggcttgaagggcctctacagwgggagcagccgccttcaggttccaacagtgggacacagcctggtcccgggacctgggctgggattgggcggggtcagtgctcctcccctctcccagggcaagtgtctgagtgagggacagaggccggttctgataaggggccctgcagtggccttagagacagtccccgggaccccagggtctaggctgagggctggatgcccatccagcctgggagggccacacagggccctggggacacaggcgtcaccccaaggggagaccaatggagggcacagagagggctctgggtctaggctg

SEQ ID NO: 110139 - DNA, 601 bp, Human
gggtttcaatccaagcataattcagtgaagcatgtgtttggcagcgggacccagctcaccgttttaggtacgtggctctaacttcccagcctgtcccaccctctcctgtctctggaaaaatctgttttctttctctgggtcttcttcccctctggcctccaggccttaggcatgaaaccctccctttctccttggggtctgggggaagtgggctagtctcaggtcaactggcttgaagggcctctacagtgggagcagccgccttcaggttccaacagtgggacacagcctggtcccgggrcctgggctgggattgggcggggtcagtgctcctcccctctcccagggcaagtgtctgagtgagggacagaggccggttctgataaggggccctgcagtggccttagagacagtccccgggaccccagggtctaggctgagggctggatgcccatccagcctgggagggccacacagggccctggggacacaggcgtcaccccaaggggagaccaatggagggcacagagagggctctgggtctaggctgcagctctgtggcctgtgctgggtcgtaaggacatggggacatagagggatg

SEQ ID NO: 110140 - DNA, 601 bp, Human
agggtctcttagtgcagagatgtgtctgtccctggagccctatcacctctggggcctggtgtctccattcacaggtcggcctcctgccttcatttgaggaagggcaccttagactcagaaggtgactagcggggagtaaacgggagtgcagagaactccacggctgacaggtgaagtccaggggcatcagaggctgctggggtgggcatgggggctgtggtaccccaacatctgtgttagcagccccaagaacccagccgatgtgaagggtcctgtggttgggctggtggggacaggggcracggcagagccccagggtgtgtctgggtggagcccacgcttcaccaggagagctgagtgggccaggctgggtcacagcctggtgccccaggggatgggaagctccaggccatgccaggcttgggcctccccacaccctgccaggtcagttttgtgtgctgtgagggagacccctagattccaaactcagactccagaaaccaggaaggagggagcacagcctgccctgggtgcacacggggaaactgaggctgcagaggaaagggctgggccaggacacctgggaaaggtgacttgggaa

SEQ ID NO: 110141 - DNA, 601 bp, Human
ctcatcatcttcctgggtgacggtgagtgagccaggccttccagccccgcagccctcacagccccggcgcccggaccctcagtggttccaggacagccctggggagcaagcctcacacacttctgctccttcagggatgggggtgtctacggtgacagctgccaggatcctaaaagggcagaagaaggacaaactggggcctgagaccttcctggccatggaccgcttcccgtacgtggctctgtccaaggtaagtgctgggctaccttagagtcctccaagcagagaaggggaatcctgrctatggagtgtggtaggagggagggaccctaaacagctggggctccaataaggagctggaggcagttggaatcccagaggacagagatcagggtcttgtttgtctgccccagagaagagctcagagtgtctctgtccccagacatacagtgtagacaagcatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaat

SEQ ID NO: 110142 - DNA, 601 bp, Human
tctgcatcctttgagaatgggataccatagcagtggcaatgaagatggaggagggaggcagaaggatccagaagcatgtcaaagatagacactgatgggaattgagcctcaggaggaagaggctgccctagtttcattgcttatacaccccatgaggtcatggactgtgtctgctgcagctagcatagggcctcgtacacagtaagcattcaagggacagctggtgaacaagaagggttgatggatgaatgaaggacaccaataacagagaaagaaactgaagaggagatgcaagtttgggctagtaacgaggtagaataatggattttattttagacacatggttataggtctgtggtcctcaaaagtgctgattaccaaatatttctgcattttctcctgccaggcacatgtggtcctcaaaagtgctgattagcaaatatttctgctttttctcctgccaggcacatggtagactgcacttgcccacacgctttaaagggaggcatggccacacaacatgcttagtcaatgaaatatgaaattacgtcacttctaaacaaaaactttaagagataatacaacttctgctactttccca

SEQ ID NO: 110143 - DNA, 601 bp, Human
gtttgcatttgacttttctggagtctgaccatcagctctcagaatttgggactctttttggctgatcccactacagactggcctcagcctccagggcaggcttcacttatcacttttaggtggtactgtccccagagccagacacctgtcccaacccacttcatttgctggtctcagatgccaagttccagcccttcttggtctcacccatcctactgttccctgagttccacattctagtctgacaaagatcaggagtctgcatcctttgagaatgggataccatagcagtggcaatgargatggaggagggaggcagaaggatccagaagcatgtcaaagatagacactgatgggaattgagcctcaggaggaagaggctgccctagtttcattgcttatacaccccatgaggtcatggactgtgtctgctgcagctagcatagggcctcgtacacagtaagcattcaagggacagctggtgaacaagaagggttgatggatgaatgaaggacaccaataacagagaaagaaactgaagaggagatgcaagtttgggctagtaacgaggtagaataatggattttattttagacacatg

SEQ ID NO: 110144 - DNA, 601 bp, Human
tctctgggaccctgtgtttgcatttgacttttctggagtctgaccatcagctctcagaatttgggactctttttggctgatcccactacagactggcctcagcctccagggcaggcttcacttatcacttttaggtggtactgtccccagagccagacacctgtcccaacccacttcatttgctggtctcagatgccaagttccagcccttcttggtctcacccatcctactgttccctgagttccacattctagtctgacaaagatcaggagtctgcatcctttgagaatgggataccayagcagtggcaatgaagatggaggagggaggcagaaggatccagaagcatgtcaaagatagacactgatgggaattgagcctcaggaggaagaggctgccctagtttcattgcttatacaccccatgaggtcatggactgtgtctgctgcagctagcatagggcctcgtacacagtaagcattcaagggacagctggtgaacaagaagggttgatggatgaatgaaggacaccaataacagagaaagaaactgaagaggagatgcaagtttgggctagtaacgaggtagaataatggattt

SEQ ID NO: 110145 - DNA, 601 bp, Human
ccataaagcacctaacatggtgcctggctaatactcagctgatacgtagaggccctgccttacccattattgaaaagagtgaaatacctcctgacctgctaagagaaccactgctctgatgccctcagctgcctttccccaacctggcccctctcaggaactcctcagacttccccatcatccagcaactaaagtattaatgcccaacacagcatgggagactccagggtgggaatctggagtctgtgaagggctggtggttgacattcttcaatcacaacctctgtttgcctggtaggcrttacaggaaaaaaaaaattacatagagcaaggcatatctaatactcaggcaaatgttagctaaggaatgtccccgtctcttaggatggccgtcaatacagggctccctggctgcctgccacctctggacattgatgctggactttctttccttgtcctcctctagctttgacccccactctgaccccatctgtgaactcttacctctggaagcttgactcatgtcccttctcctttgttctctgggaccctgtgtttgcatttgacttttctggagtctgaccatcagctctcagaattt

SEQ ID NO: 110146 - DNA, 601 bp, Human
tgctctgccctttcagtaccagcgaggagggaagtaactcactgctttgacaaatcaagcgggaactggaggtggtttacgtgctcctgtgtctcctgatgctacattctatagcaaatagggaagggcaggaagagacatgccattttggttgtaataaattccctagtgtgctacattcttcttctctctgcaaacccggattgatgaccagcggcttttgttttacgcaggaaaccgtgatcttgatgcagcatccctgaggcactgcagtatatttctatgtgacattttctattayatattttggaagacagaaacgaaatgtatacaccagggttttcctgagacttcctttctccacccagaaacataggtgtctccacctccatgaaagcttggagggaacgtgtctgaaaatccaggcacaaaagatcaacacggggtgactagtcgtttgccagaggaaagcacgtggaacccccgtccctggcccgctgtgggttcatggagggtccagtctccaatgcactgagaaaacagcgtctgggagagcttgctgggacaggaaacagagtgccatgtttaatcagagcaggcc

SEQ ID NO: 110147 - DNA, 601 bp, Human
tctggggattttcaaagtaaaacacagcgaggaagctgatatgcgaactaaatagtcattttttttcctaatgtgatataaaaagctaaccttttcagatagtaaagagatacaggaaaaactgctaggtagctggattacacctggggaaagtaaaatacttactcgttctttctgaccaaagggcttgggagaccttagcaaaccccagtcaatcacataacctcctttttccagtcggtaaatctcattccctgatagagcaagtggcagaaaaatgcaagaggagaaagaccaagayttactaagtacttactttgtgccctggatcaggctaggctcattaaacaagttacaacattaattgctaatcctcacatactaggtttgttatgtcttttttttttttttttgagacagagtctcagtctgtcgcccagctggagtgcagtggcatgatctcggctcactgcaacctccacctcctgggttaagcaattctctgcctcagcctcccgagtagctgggattacaggcacacaccaccatgcccagctaattttttgtatttttagtagagatggggtttcaccatcttggc

SEQ ID NO: 110148 - DNA, 601 bp, Human
taaaaaataagaaaatgagcctagggtgggggtgcacagctgtagtccaagctactctggaggctgaggtgagaggatcgcttgagcctgcaaggtctgcttgagcctaggaggtcgaggctgcagcgagctgtgtctgcgccactgtactccagcctgactgacagagcaagaccctatctcaaaaaataaaataaaatactttaaaatcctaattcctaatgagacagtattagaaggtggggcctttgggaagtaattagggtcatgaaggtagggacttcattaatgtgattaatgmccttgtaagaagagacacaaggctgggcgcggcagctcacgcctgtaatcccagcactttgggaggcggaaacgggtggatcatgaggttaggagttcaagaccagcctgatcaacgtggtgaaacctcacctccactaaaaatacaaaaattagccaggtgtggtggcgtgtgcctgtaatcccagctactcaggaggctgaggcaggagaatcgcttgaacccgggaggtggaggttgcagtgagccgagatattgccattgcacttcagcctgggtgacagagcaagactctgtctc

SEQ ID NO: 110149 - DNA, 601 bp, Human
aattgtttgataatggccactgcatatcattcaggtcagagtgtcacttccaaagagaaaaagtggagctatctaaaggtggtcaaccaatcaggattggaaaaggtgtagaagccatctctcacagaattcctacctatggacagaaggttttggaaggatgctcgcttcagttatgcaatgacacacagcagagtgattaagcaggtgcaatgatatggtacctgcaatggactgaatgtcatatctcccccaaattcacacattaaagtcctaaacccgtccaggcatagtggctcayacctgtaatcctagcactttgggaagcagaggtgggaggattgcttgagctcaggattcgagaccagcctgagcaacaaagtgagaccctgtctatataaaaaataagaaaatgagcctagggtgggggtgcacagctgtagtccaagctactctggaggctgaggtgagaggatcgcttgagcctgcaaggtctgcttgagcctaggaggtcgaggctgcagcgagctgtgtctgcgccactgtactccagcctgactgacagagcaagaccctatctcaaaaaataaaataaaatact

SEQ ID NO: 110150 - DNA, 601 bp, Human
ctaggtactggttctcaaacttaagtaaccatcggaatcaagtagggagcatgtttaaaagaacagtcacccagcctcatctctagacattgagattcactttctctgggggcagggccctgaggttgacattttaaacaggaattttaagtgattcagaacagtgagcggaagtttacaggtggaggtgtgaaccttcaattgtttgataatggccactgcatatcattcaggtcagagtgtcacttccaaagagaaaaagtggagctatctaaaggtggtcaaccaatcaggattggaraaggtgtagaagccatctctcacagaattcctacctatggacagaaggttttggaaggatgctcgcttcagttatgcaatgacacacagcagagtgattaagcaggtgcaatgatatggtacctgcaatggactgaatgtcatatctcccccaaattcacacattaaagtcctaaacccgtccaggcatagtggctcacacctgtaatcctagcactttgggaagcagaggtgggaggattgcttgagctcaggattcgagaccagcctgagcaacaaagtgagaccctgtctatataaa

SEQ ID NO: 110151 - DNA, 601 bp, Human
tggctgaaaagtcattcatggagcttctcagttgaactcaagttcaatttgagctagaagtgcaatgtggcagtaaaagtacatcatcagaggcctaggtactggttctcaaacttaagtaaccatcggaatcaagtagggagcatgtttaaaagaacagtcacccagcctcatctctagacattgagattcactttctctgggggcagggccctgaggttgacattttaaacaggaattttaagtgattcagaacagtgagcggaagtttacaggtggaggtgtgaaccttcaattgttkgataatggccactgcatatcattcaggtcagagtgtcacttccaaagagaaaaagtggagctatctaaaggtggtcaaccaatcaggattggaaaaggtgtagaagccatctctcacagaattcctacctatggacagaaggttttggaaggatgctcgcttcagttatgcaatgacacacagcagagtgattaagcaggtgcaatgatatggtacctgcaatggactgaatgtcatatctcccccaaattcacacattaaagtcctaaacccgtccaggcatagtggctcacacctgta

SEQ ID NO: 110152 - DNA, 601 bp, Human
atgaaatgccgagtgctggtaatgtatcagtaccattcagcactcgtaggcgtcacagtgaagacagttctatcccaaatacaggcacagaagcatctgaccactttattaggtcatttactatagccaaacctgaccattacacgttgaagtaaatattattttataataattttattttatttactctttatattaaagccagggcactatattaattttctttaaaaaaattataattatggctgggcacggtggctcacgcctgtaatcccagcactttgggaggctgaggtgggcrgatcacttgaggtcaggagtatgagaccagcctggccaacacagtgaaaccccgtctctattaaaaaaaatacataaattagctgggcatggtggtgtgcgcctgtaatcccagctactcaggaggctgaggcgcgggaatggcttgaaccccggagacgaaggttgcagtgagcagagattgcaccactgccctccagcctgggctctgctgtgagattctgtctcaaaaaaaaaaaaaaaaaattacacttgtaggcaatataatatagatgtaatccttgaatttcattccaggatt

SEQ ID NO: 110153 - DNA, 601 bp, Human
ggctggtctcgaactcctgacctcatgatcctctgcgcccggccatacacacttttaaacaaccagatctcatgagaactcactcactatcatgagaacggcaccaaggtgatggtgctaaaccattcatgagaaatccacccccatgatccaatcacttcccaccaggccccacctaaacactggggattacaattcaacatgagatttgggcagggaaacagatccaaaccctatcaatatttgagcctggaactaacactacttacgggatattttttaaaaccatttttttttttttgcatggtttgaatagtcactgaacttggagaacaagtcaagcgaagatggtacttcctgttatctgatactttaccaagagttgttcactactttggaaaaatgtaccacaaatttggcaaaccccactcatgaaatgccgagtgctggtaatgtatcagtaccattcagcactcgtaggcgtcacagtgaagacagttctatcccaaatacaggcacagaagcatctgaccactttattaggtcatttactatagccaaacctgaccattacacgttgaagtaaatattattttataat

SEQ ID NO: 110154 - DNA, 601 bp, Human
gggcgcggtggctcatgcctgtaatctcagcagtttgggaggccgaggggggtgaatcacctgaggtcaggagttcgagaccagcccggccaacatggtgaaaccccatctctaccaaaaatacaaaaaattagccaggtgtggtgatgcatgcctgtagtcccaggtacttgggaggctgaggtaggaaagttgcttgaacccaggaggtggaggttgcagtgagcagagatcacgccactgcactccagccttgggcgacagagtgagcctctgtttcaaaaaataaaaaataaaatataatcaatcaatcaatcaatcaatcaatcaataaaggagtgggaaaatactaatatctaacatttattgacccagacactgtcccatgcactttgaaaacattaactccttttctcctgaaggcatctgtgtgaaatatgaattctttttatcctgaaatgaaaaagttgttcattccccagaataagggagctagtaacaggtggaggtgggacttggaccaaagactgttcaactccagaatacaagcaatacagtctcttaatagcaaaaataaaatatgagctataggatcccaggt

SEQ ID NO: 110155 - DNA, 601 bp, Human
ctgggcgcggtggctcatgcctgtaatctcagcagtttgggaggccgaggggggtgaatcacctgaggtcaggagttcgagaccagcccggccaacatggtgaaaccccatctctaccaaaaatacaaaaaattagccaggtgtggtgatgcatgcctgtagtcccaggtacttgggaggctgaggtaggaaagttgcttgaacccaggaggtggaggttgcagtgagcagagatcacgccactgcactccagccttgggcgacagagtgagcctctgtttcaaaaaataaaaaataaaacaaaatcaatcaatcaatcaatcaatcaatcaataaaggagtgggaaaatactaatatctaacatttattgacccagacactgtcccatgcactttgaaaacattaactccttttctcctgaaggcatctgtgtgaaatatgaattctttttatcctgaaatgaaaaagttgttcattccccagaataagggagctagtaacaggtggaggtgggacttggaccaaagactgttcaactccagaatacaagcaatacagtctcttaatagcaaaaataaaatatgagctataggatcccag

SEQ ID NO: 110156 - DNA, 601 bp, Human
cactcactttggcctcccaaagtgctgagattataggcatgagccactgcacctgacccagatgaatctttgttatggggggactgtctggtgtactagtggcatccctggcctctacccactaagtgcccgtagaacctcctggctgtgacaagaaaaatgtctccagacattgccggtgtcccatgggttgtaaaatttcccacgagcaaccatgagaaatgctgctctatatcactgtcttcgaaacacttatcttccaaaattatttattttattcaacaacaaatacttagtgccyaatacaggccaggcatgattccaggtatgggggataaagcagtgaaattcagatgagattgggtgcattcagggtggtatggccatagacagcagtgaaattgacagaaaaaaattactacctttgaggaacttatatcctcatggaaagacacagggaaattaaaagaaaatgaaccaaactgtagttggtcagatggtacttaaaagtgctggaggagaataaggtggaaaacggaatagcatggaggctgtagtttggaggcagagaggctcacatttaaataggtgtgttcaaaga

SEQ ID NO: 110157 - DNA, 601 bp, Human
gcctgaccatatcaaccactcatgcattactagataaaggtgacaagagcagagggtgcagtgccaggaatgatgagggccatgatcatgagagggaaacacgatcacccaagtacacgcctgcttggtggcctttgcacgtgccgtcctctctatctgggatgctcattccagctctcagcatggctgccgcctttccatccttcaggtcttagctcaaatgtcgtcttctcagagactctacccaaagaaacggtcctttctagaagaatccaattccctcaaaacttgcttttctgtkagggttccactagtggtatttgtggccagatgaatctttgttttttgttgttgttgttgttgttttttgtttgtttgttttgagatggagtctcgctctattgcccaggctgaagtgtagtggcacgatctcagctcactgcagcctctgcctcctgggtccgagcgattctcgtgcctcagcctcccaaatagctgggattacaggcgcctaccaccatcacacccagctaatttttgtgtttatagtagaggtggggtttcaccatgttggccaggctggtctcgaactcctgacctc

SEQ ID NO: 110158 - DNA, 601 bp, Human
gcacaggaaaaatcgccaccttaaaaaacctcagatctcaggagaactcactatcacaagtacagcataggggaaccacccccataatgcaattgcctcccatcaggttcctcctttgacacatggggattacaattcaagatgagatctgggtggagacacagggcctgaccatatcaaccactcatgcattactagataaaggtgacaagagcagagggtgcagtgccaggaatgatgagggccatgatcatgagagggaaacacgatcacccaagtacacgcctgcttggtggccttygcacgtgccgtcctctctatctgggatgctcattccagctctcagcatggctgccgcctttccatccttcaggtcttagctcaaatgtcgtcttctcagagactctacccaaagaaacggtcctttctagaagaatccaattccctcaaaacttgcttttctgtgagggttccactagtggtatttgtggccagatgaatctttgttttttgttgttgttgttgttgttttttgtttgtttgttttgagatggagtctcgctctattgcccaggctgaagtgtagtggcacgatctcagc

SEQ ID NO: 110159 - DNA, 601 bp, Human
ttccaaagtgtgttagtacgagtcagagagtccagagggcatggagggaagaaagcgagggcacttggggtctgaacacctgaagaatcccattgtattagtccatcctcaccctgctataaagacattcccgagactgggtaatttatgaagaaaagaggtttaattgactcgcagttccgcatggctggggaggcctcaggaaacttacaatcatggtggaaagggaagcaggcacgtcttacatggtggcaggcaagagagaagtccagttgcaagcacaggaaaaatcgccaccttraaaaacctcagatctcaggagaactcactatcacaagtacagcataggggaaccacccccataatgcaattgcctcccatcaggttcctcctttgacacatggggattacaattcaagatgagatctgggtggagacacagggcctgaccatatcaaccactcatgcattactagataaaggtgacaagagcagagggtgcagtgccaggaatgatgagggccatgatcatgagagggaaacacgatcacccaagtacacgcctgcttggtggcctttgcacgtgccgtcctctctatct

SEQ ID NO: 110160 - DNA, 601 bp, Human
tagctgggattacaggcacccgccaccagcccggctaattttttgtatttttagtagagatggggtttcactatgttggtcaggctggtcttgaactcctgaccttgtgatctgctaccaaggccttggcctcccaaagtgctgggattacaggtgtgaggcaccacgcccggacttttttttttttttttttttgagacagagtctcgctgtgtcaccaggctggagtgcagtggtgtgatctcagctcactgcaacctccgcctcccgggttcaagcgattctcctgcttcagcctccygagtagctgggactacaggcgtgtgtcaccacgcccagctaatttttgtatttttactagagatggggtttcaccatgttggccaggatgctctctatctcttgacctcgtgatccgcctgcctcggcctcccaaaatgctgggattacaggcgtgagccaccgtgcccagcctttctttttaatttctactcctaatgccaatcatgattccaggcacctagtatctgctggacaactgcctactaaatgggcagccggcaggacctaggaatatggaatgtttcccaccagtggcttt

SEQ ID NO: 110161 - DNA, 601 bp, Human
cggagtctcgcattgtcgcccagcctggagtacaaaggtgcgatctcggctcactgcaacctccaactcctgggttcaggcgattttcttacctcagcttctagagtagctgggattacaggcacccgccaccagcccggctaattttttgtatttttagtagagatggggtttcactatgttggtcaggctggtcttgaactcctgaccttgtgatctgctaccaaggccttggcctcccaaagtgctgggattacaggtgtgaggcaccacgcccggacttttttttttttttttttttgagacagagtctcgctgtgtcaccaggctggagtgcagtggtgtgatctcagctcactgcaacctccgcctcccgggttcaagcgattctcctgcttcagcctcccgagtagctgggactacaggcgtgtgtcaccacgcccagctaatttttgtatttttactagagatggggtttcaccatgttggccaggatgctctctatctcttgacctcgtgatccgcctgcctcggcctcccaaaatgctgggattacaggcgtgagccaccgtgcccagcctttctttttaatttctactcc

SEQ ID NO: 110162 - DNA, 601 bp, Human
tctgcaaagtccatgccaccatcccccacttccagttctacccactttgaagcttttctccacccacccgtgcaggcctccactctagctctcggaattgtgtacagactcctccatcatagtgcaggccacattgcatttcactgtccttaatcttctgatttttggctctatgtgggtcatctagtgttttgtgtgttttttttggggggcgggggaggcaatggtggtgcaagtagacacccattttcttttttactttctttttttttgagacggagtctcgcattgtcgcccagcytggagtacaaaggtgcgatctcggctcactgcaacctccaactcctgggttcaggcgattttcttacctcagcttctagagtagctgggattacaggcacccgccaccagcccggctaattttttgtatttttagtagagatggggtttcactatgttggtcaggctggtcttgaactcctgaccttgtgatctgctaccaaggccttggcctcccaaagtgctgggattacaggtgtgaggcaccacgcccggacttttttttttttttttttttgagacagagtctcgctgtgtcacc

SEQ ID NO: 110163 - DNA, 601 bp, Human
cctacaagctgcaccttcagtgaaactaaaaaccaccgtgtgtgctgctctggccatcccaagtattttcacaccttccaacctgggctgggggcttgctgctctgttgaacagcaagctctgcaaagtccatgccaccatcccccacttccagttctacccactttgaagcttttctccacccacccgtgcaggcctccactctagctctcggaattgtgtacagactcctccatcatagtgcaggccacattgcatttcactgtccttaatcttctgatttttggctctatgtgggtcmtctagtgttttgtgtgttttttttggggggcgggggaggcaatggtggtgcaagtagacacccattttcttttttactttctttttttttgagacggagtctcgcattgtcgcccagcctggagtacaaaggtgcgatctcggctcactgcaacctccaactcctgggttcaggcgattttcttacctcagcttctagagtagctgggattacaggcacccgccaccagcccggctaattttttgtatttttagtagagatggggtttcactatgttggtcaggctggtcttgaactcct

SEQ ID NO: 110164 - DNA, 601 bp, Human
aataaaaaaaaaatcctatcctttggcagtaatctagaaccagaatctcacagattcactagtaactggcaatgtctatagtggagttttaaagcaactgaaccactctttctgaaagagtggtataataatttttaacttctactcctacctattgtgtggcacattctgcaaaaagagccacagtttattaaatgcctgctatatgccagaatacaaatttttcctacatatattttatatatatgccatatgatatccctacctctcccccgaaacactctgacataggcatcattaytgggggctttttattttattttattattattattatttttagaaggagtcttgctctgtcgcccagactggagtgcagtggcgagatcttggctcactgcaacctctgcctgcccaattcaagcaattctcctgcctcagcctcctgagtacccgggactacaggtgtgtgccaccatgcccggctaatttttttgtatttttagtagagatggggtttcaccatgctggccaggctggtcttgaactcctgaccttgtgatctgcccgcctcggcctcccaaagtgctgggattacagg

SEQ ID NO: 110165 - DNA, 601 bp, Human
tagtcagagatcatctgcctaaattgaaaaagctcaagttgggttcctatgaagtagctccttggcaaaatactgattctttgcaaatacacagactgtgtgcctaacacagaaaacaaacaagcaaatcacatgcatacataaacatgcacacatctgtttaatttaaaattttatctcgattgtaaactgacacatttggcaaatttaaattttgatctatcagaatttaaaatatccataacatttaatatagcagtaccagaatagcttaggagctattgtgtaccaatacttgcayaagcaaacaaacaaacaaacatgggtaatgagaatatctatgtatggtattgtttataattgaggggaaaacctaggtacagctaaaataccaactcataaaaaatggaataaacgaattatagcacctccatcaaatggcaaaactatgcagttcttaacaagaaagaaaatacaccattgtattaatgtagaagacacccaatattttatttttaagtaaacaagtctattcaaaaagaatatgcatatatacagagaaatagataattacatatgtggaaagcagaagtcaagactg

SEQ ID NO: 110166 - DNA, 601 bp, Human
ttcccctatttatcagggttttctaatattagtgattccatcttgatcctgacaactttcatacagccatagacaaaataaaaatgaatgctgtggctgtgagcccacaaaacttttattaatggacactgcaattagaatttcatatgattttcatgtgccacaaaatagacttgtctttttttttttttttctttttgccttaactatctgaaaatggaaaaacccagcgtgggacatacaaaaatggccagggggggtcaactcctgttgttaataattaaatattcagtaggcagayattaaatagacttcgaaaagggttaaaaaagaaaaccaatgtttcctcagtatattcgcccggccactccaacttaatcctaggtttgttgacaagggccgtgttttctatttcttttgttgcctcccttgagccttgctagaggtgagtctgtttgcattgagctcggtatgaagtctatgcttcataaatgttggctcaataagcaaagcagaacgatgcctgctgagataggctatttctcttggataattgtcttcatggagattcccttcacttggagcagtcccatagggctct

SEQ ID NO: 110167 - DNA, 601 bp, Human
atctacccgcctcggcccccaaagtgctgggattacaggcttgagccacaaagcccagccaaagataaacatttttaaaggaaaaaataaggaggagtacataattgttttgagtaattatctttggctacaaagatcaatgataaggatgacactggtccgaggttggagaggcagatgtccttgcacacatgtttttgtgtaaggtcgtgaggtgtttgtgcaaggctgtgttttttgtagagtctgtttcattatcaggcatataagtgtgagaatcatgtcttcgtggccttccccyatttatcagggttttctaatattagtgattccatcttgatcctgacaactttcatacagccatagacaaaataaaaatgaatgctgtggctgtgagcccacaaaacttttattaatggacactgcaattagaatttcatatgattttcatgtgccacaaaatagacttgtctttttttttttttttctttttgccttaactatctgaaaatggaaaaacccagcgtgggacatacaaaaatggccagggggggtcaactcctgttgttaataattaaatattcagtaggcagacattaaa

SEQ ID NO: 110168 - DNA, 601 bp, Human
gccatgttggccaggatggtctcgatctcctgacctcaggtgatctacccgcctcggcccccaaagtgctgggattacaggcttgagccacaaagcccagccaaagataaacatttttaaaggaaaaaataaggaggagtacataattgttttgagtaattatctttggctacaaagatcaatgataaggatgacactggtccgaggttggagaggcagatgtccttgcacacatgtttttgtgtaaggtcgtgaggtgtttgtgcaaggctgtgttttttgtagagtctgtttcattatsaggcatataagtgtgagaatcatgtcttcgtggccttcccctatttatcagggttttctaatattagtgattccatcttgatcctgacaactttcatacagccatagacaaaataaaaatgaatgctgtggctgtgagcccacaaaacttttattaatggacactgcaattagaatttcatatgattttcatgtgccacaaaatagacttgtctttttttttttttttctttttgccttaactatctgaaaatggaaaaacccagcgtgggacatacaaaaatggccagggggggtcaac

SEQ ID NO: 110169 - DNA, 601 bp, Human
tcagcaaattttttctgaaagggccaataagtatgtatctttggctttggaagcgaaaaggactctgttgcaactacttaatttctgtctttgcagcctcaaagcagctgtcaatctaaataataagcagagagacactctgtaaaagaaaatacgtttatttgggaattaaatattgtaatgggaatacacatgtcatagtaaagtctgcatgcattcagggtggtaaggaagataaactttttttttttttttttgagacggagtctttttctgtcgcccaggctggagtgcagtggcrcgatctcggctcactgcaacctctgcctcctgggttcaagaggttctcctgcctcagcctcctaagtagctgggattacaggcgtgcaacaccacgcccagctaatttttttttgtatttttaacaaagacggggttttgccatgttggccaggatggtctcgatctcctgacctcaggtgatctacccgcctcggcccccaaagtgctgggattacaggcttgagccacaaagcccagccaaagataaacatttttaaaggaaaaaataaggaggagtacataattgttttgagtaatt

SEQ ID NO: 110170 - DNA, 601 bp, Human
gtctgctcccgagaccatgctttctgctatgctgtggacctcggtcagcaaattttttctgaaagggccaataagtatgtatctttggctttggaagcgaaaaggactctgttgcaactacttaatttctgtctttgcagcctcaaagcagctgtcaatctaaataataagcagagagacactctgtaaaagaaaatacgtttatttgggaattaaatattgtaatgggaatacacatgtcatagtaaagtctgcatgcattcagggtggtaaggaagataaactttttttttttttttttgagacggagtctttttctgtcgcccaggctggagtgcagtggcacgatctcggctcactgcaacctctgcctcctgggttcaagaggttctcctgcctcagcctcctaagtagctgggattacaggcgtgcaacaccacgcccagctaatttttttttgtatttttaacaaagacggggttttgccatgttggccaggatggtctcgatctcctgacctcaggtgatctacccgcctcggcccccaaagtgctgggattacaggcttgagccacaaagcccagccaaagataaacatttt

SEQ ID NO: 110171 - DNA, 601 bp, Human
atttcccagcacaaccacagttccacggatggctttgtatttggccacgtgctggttctgcagtgttgtaaacacttagaaggtctgaggcctaggttaattctagtctgctacttgttttcggtcttacctggaccataccggctcatttcttttcttttttttttgagacggagtttcgtccttgtcacccaggctggagtgtagtggcgcgatctcggctcactgcaacctctgcctcttgggttcaagcgattctcctgcctcagcctcccgagtagctgggattacaagtgcctgycaccacgcctggctaatttttgtatttttagtagagacggggttttgtcatgttggccaggcttgtctcgaactcctgatctcaggcgatccacccacctcccaaagcgttgggattacaggcgtgagccaccgcgcccggcccatactagctcatttctataaacttctctttcctagtttgcaaaatagttatgatgatattatgtttttccttagaccagtatcttctgcaagtctcctatgtaccagaacccatctgaaaatagaaatcatagtcctcgggaagcctatgtgctaa

SEQ ID NO: 110172 - DNA, 601 bp, Human
gaggtcatacagctggtgagtggcagagctggggtttcagctgaggtctttctaactctgatgacattggctttggtaggtctgctgtgtgatgaatgaaagagccatatcccagaaccagaggcccaggggctgggcatcactaagtcaacgtcttcattttatagatgaggaaaccaagacttcggagtgaggtcagcagcctgaggtcaggaagcttatgcagtggcagaatacaggcttgaataaaagcctcttgatgctagatttggtactttttgctgcttctctgactaatttkggaatgacagcaagaatacagtcacctccccagtgcacactttgatgacctggggcagctgagcaaaaaaatcaagggtcagggtcctagcatctacccacacagcacgcatgaccttgggcaggttacttaataactgctctgtgctttatggtactcttctgcaaaatggatattcatcataacttataggactgttgggagaatcaaataagataacgaaatactcagcatagcacagtgactaatacacgttagtcttaattaaataagggactattgttattacctggggtatat

SEQ ID NO: 110173 - DNA, 601 bp, Human
gaggcaaatgagacatcctcgtgtgctgtgaagcatctagccagattgatgaggagaggccagcccattagtcataaaaaaaataaaaagaaaaagaaaatctccatgccaaccagccagtcagcagatcagatttctgtttagagagtggtagccatttttttagtagctggtatatagcctgtggggcttcaccctccatgaagaggctctgcagtgctgtctcaggctaatccaataggactggtgccctcatgtgaagaagcaattaggaggcagacatgcgcagaagtgagattayagacgtagggagaggaagcatctatatagaagccaaggagagaagggtgcgataaaaccaaccttgtcaataccttggtcccagacttctagcttctagaactgtgagaaaaaaataaatctatgttgtttaagccacccagtctgtggtattttgttacggcagccctagcaaactaacacacatctctcagcccagaactggtaccagctctcagctttggctagtccctgggtgccccagcatcccttgctgatgccttcaatcctgcccattcacccccatatgcagtcccttcat

SEQ ID NO: 110174 - DNA, 601 bp, Human
tcgcatgtgggtgggcaacgttcccagcaatggctgtgtcctccacttcagtctctgcttggcagccatctccatggttcaagccttcagtggcttctggcaccattattgcttccctttgtatcttgttatgagttgattgtgtcctcctccaaattcatctgttgaagctctaatccccagcaacctcagaatgggactgaatttggaaacagggtctttaaaaaggtagttaagttaaaatgaggtcagacgggtgaccaatgtccaatcaactggtcagaaatgcttggccatccaygctgtctcgtccttcttgggaggcaaatgagacatcctcgtgtgctgtgaagcatctagccagattgatgaggagaggccagcccattagtcataaaaaaaataaaaagaaaaagaaaatctccatgccaaccagccagtcagcagatcagatttctgtttagagagtggtagccatttttttagtagctggtatatagcctgtggggcttcaccctccatgaagaggctctgcagtgctgtctcaggctaatccaataggactggtgccctcatgtgaagaagcaattaggaggcagac

SEQ ID NO: 110175 - DNA, 601 bp, Human
aagcccttcaagcattaggtatttgtcctaattctctccctccgcttccccccgccccgaccaagaggcccccatgtgtgatgttctgctccctgtgtccatgtgttctcattgttcaactctcacttacgagtgagaacaggtggtacttggttttctcttcctgtgttagttgctgataatattggcttccagcttcatccatgtccctgcaaaggacatgaactcattcttttttatggctgcatagtattccatggtatatatgtgccacattttctttatccagtctgtcattgawgggcatttgggttgattccaagtctttgctattgtaaatagtgctgcaataaacatacgtgtgcatgtgtctttatagtagaatgatttgtaatcctttgggtatatacccagtaatgggattgctgggtcaaccactgtggaagacagcgtggcgattcttcaaggatctagaaccagaaacttctgctttttttttgcccaggctggagtgcaatggtgcgatctcggctcactgcaagctccacctcccgggttcacaccattctcctgcctcagcctcctgagtagctgggactac

SEQ ID NO: 110176 - DNA, 601 bp, Human
gcgtggtggcgggcccctgtagtcccagctatttgggaggctgaggcaggagaatggtgtgaaccccggaggcggagcttgcagtgagccgagatcgcgccgctgcactccagcctgggtgacgcagcgactctgcctcaaaaaaaaaaaaaaaaaaaaagccaggaaaactagggcttccctgaggacagtcctgtatgaaaaggaagctgtaggcctagggtagggcctgatccaagattagtgatagtgggtaaccggatggagccaataaatattcaactcaggacactgtgtcagmgctaacttatgtcaactttccctcctgcatggtaggaacattcccttctttctgcatctgaaaccatccaagtaacttcatagcatgtagaggactacttgcaggcaagaactctttaaaacttttttagcaaaggggaatgccttaagcttgcattatgaaaactgtttaagagaaggttctgccactattccctccctgccctattttcattctttaggctagctacaagaatgtagctagaattgggttggtcaattcagaccacatacctccttggctcaggaggagaaagtaggg

SEQ ID NO: 110177 - DNA, 601 bp, Human
ctaaataaataaatgaataaataaattaaaaatcaaaggattctctcatgaacatctggtcaagtagcagggcttttcatctgtggatcagagggccatgttttctttttagcaacagctcagtaatcaagatggcagggaaagaaaagtaggtatctgtgcagagaggaaagtgagaataatgctattttatgagctagacattattttttgccagtgcaactgccaaaaaaaaaaaaaaaaagagaagctaaacagggtgacaatgatgataatacctactatttatcaagcaactgcwgtatactagagagaaggaacttaacttagatgacctctgattcttttttttttttttttttgagacagagtctcgctctgtcacccaggctgtagtgcagtggcacaatctcggctcactgcaacctctgcctcccaggttcaagtgattcttctgcctcagcctcctgagtagctggcactacaggcgtgtgccaccacacccagctaattttttgtatttttagtagagacggggtttcaccatgttggccaggctggtctcgaactcctgacctcgtaatccgcatgcctcggcctc

SEQ ID NO: 110178 - DNA, 601 bp, Human
tctgagtcctgatatcactgcttaatatcaatatgattcttgaaaaaagtcactgtgtttctaagcctcagatccttatttgtaatatagtgacaatcccacattaactccaaggtgattgtgaggaacaaaaaagaaaatgggggccaggtgcggtggctcacgcctgtgatcccagcactttgagaggcagaggagggtggatcacctgaggtcaggagttcgagaccagcctggtcaatacggcaaaaccctgtctctactaaaaatacaaaaattagccagatgtggtggtgggtgsctgtaatcacagttacttaggaggctgaggcagaagaattgcttgaacctgggaggcggatgttgtggtgagccaagatggccccactgtactcccgcctgggcaacacagcgagactctgtcttaaaaacaacaacaacaacaacaaaagcaagaaaaatggcatctttaaagtggatgccactttaaagatttaaatggcatctggtacagtggaagagtatccaccagtgctgtagtgggaattattaatggataattaatgtccaaacctagtaaatcatttttctttgtaatcca

SEQ ID NO: 110179 - DNA, 601 bp, Human
tgctggcaactgcttcttactgccctgtttatcttagaacattagaactaataaagaccctgtgcttcctgtgccagcagaacccatgggtggctcttctttgtacctagacatttttaaagaccatgcttcctcttaaacatgaatgtcacacgtgtgctcggctgacacaggctcatgtgggcttctgggaatcagggctcccagacaccacagctgggccataggcaagctgctcttggcatgccaaaccagaggggactctgtctgcttttgttgtgtgttttttttttttttttttgagacagagtcttactctgctgcccaggctggagtgcagtgagtggcacgatctcagctcactgcaccctccgcctcccaggtttaagccattcttgtgcctcagcctcctgagtaagtaggaccacaggtgtgcgccaccaggcctggctaatgttttttgtatttttaagagagaaggggtttcaccatgttagccaggctggtctcgaattcctgaactcaagtgatccgcccaccttggcctcccaaagtgctgggaacacaggtgtaaaccaccacacccagctaattttttgta

SEQ ID NO: 110180 - DNA, 601 bp, Human
gaccacttcatccaggaaaactggcactctgccataaaacaaccgcaacctctgcctctgtgaatttgatgagctgattctcaggctgcttttctctttggaattccagaacgtttactaaatataccactctctgtaccccgattcaaccaagaatcagaatccaaagcagacaaaaacattcatgagcaaacatgtcacaaagcttatgaatttcactctcagcttcctgagcctcctctaatctcacaacattcttagaaaggggggctggttagaccttactgctaagtttgcatcsatgtgggaaccgaggtgctgaggatggaggtgatgtttccgatgtcacagtgctggcaactgcttcttactgccctgtttatcttagaacattagaactaataaagaccctgtgcttcctgtgccagcagaacccatgggtggctcttctttgtacctagacatttttaaagaccatgcttcctcttaaacatgaatgtcacacgtgtgctcggctgacacaggctcatgtgggcttctgggaatcagggctcccagacaccacagctgggccataggcaagctgctcttggcatgccaa

SEQ ID NO: 110181 - DNA, 601 bp, Human
tttactgttaaaaaattaaagcattacagataaatctaaagttcatctcattctacctcctctcttcctcaaaggcagccagtattcccaggggtctgtgttttattcctaggcttgtttttatatttttatcctctatgcacataataacacatggtatttttagtgtgttttggattgcgtatttcctattctaacttgccttttcacccactgttatgtctttaagatttaactatgttagtatttcctatctagtttagtcactgtaatcacatcatccattttatacctataccayaatttatttatccattcctctcctgaaggacattttggttgtttactatgtttttgccattatgaacaatgctgcaataaatatcctaatcttgattcatgtctcgagagcttagctagggtgcagcttccaaagttggaccgggattgccgtgttgaaggcgctccttgtcttgaaacatcttcaactactccatcttccatttctcttacagtcagccattactgagtccacagattctaaatttaaaacaccttttacatttcttttattcattcattcaacagttatttactgagt

SEQ ID NO: 110182 - DNA, 601 bp, Human; identical to SEQ ID NO: 31183

SEQ ID NO: 110183 - DNA, 601 bp, Human; identical to SEQ ID NO: 20836

SEQ ID NO: 110184 - DNA, 601 bp, Human; identical to SEQ ID NO: 20837

SEQ ID NO: 110185 - DNA, 601 bp, Human; identical to SEQ ID NO: 20838

SEQ ID NO: 110186 - DNA, 601 bp, Human; identical to SEQ ID NO: 20839

SEQ ID NO: 110187 - DNA, 601 bp, Human; identical to SEQ ID NO: 20840

SEQ ID NO: 110188 - DNA, 601 bp, Human; identical to SEQ ID NO: 20841

SEQ ID NO: 110189 - DNA, 601 bp, Human; identical to SEQ ID NO: 20842

SEQ ID NO: 110190 - DNA, 601 bp, Human; identical to SEQ ID NO: 20843

SEQ ID NO: 110191 - DNA, 601 bp, Human; identical to SEQ ID NO: 20844

SEQ ID NO: 110192 - DNA, 601 bp, Human; identical to SEQ ID NO: 20845

SEQ ID NO: 110193 - DNA, 601 bp, Human; identical to SEQ ID NO: 20846

SEQ ID NO: 110194 - DNA, 601 bp, Human; identical to SEQ ID NO: 20847

SEQ ID NO: 110195 - DNA, 601 bp, Human; identical to SEQ ID NO: 20848

SEQ ID NO: 110196 - DNA, 601 bp, Human; identical to SEQ ID NO: 20849

SEQ ID NO: 110197 - DNA, 601 bp, Human; identical to SEQ ID NO: 20850

SEQ ID NO: 110198 - DNA, 601 bp, Human; identical to SEQ ID NO: 20851

SEQ ID NO: 110199 - DNA, 601 bp, Human; identical to SEQ ID NO: 20852

SEQ ID NO: 110200 - DNA, 601 bp, Human; identical to SEQ ID NO: 20853

SEQ ID NO: 110201 - DNA, 601 bp, Human; identical to SEQ ID NO: 20854

SEQ ID NO: 110202 - DNA, 601 bp, Human; identical to SEQ ID NO: 20855

SEQ ID NO: 110203 - DNA, 601 bp, Human; identical to SEQ ID NO: 20856

SEQ ID NO: 110204 - DNA, 601 bp, Human; identical to SEQ ID NO: 20857

SEQ ID NO: 110205 - DNA, 601 bp, Human; identical to SEQ ID NO: 20858

SEQ ID NO: 110206 - DNA, 601 bp, Human; identical to SEQ ID NO: 20859

SEQ ID NO: 110207 - DNA, 601 bp, Human; identical to SEQ ID NO: 20860

SEQ ID NO: 110208 - DNA, 601 bp, Human; identical to SEQ ID NO: 20861

SEQ ID NO: 110209 - DNA, 601 bp, Human; identical to SEQ ID NO: 20862

SEQ ID NO: 110210 - DNA, 601 bp, Human; identical to SEQ ID NO: 20863

SEQ ID NO: 110211 - DNA, 601 bp, Human; identical to SEQ ID NO: 20864

SEQ ID NO: 110212 - DNA, 601 bp, Human; identical to SEQ ID NO: 20865

SEQ ID NO: 110213 - DNA, 601 bp, Human; identical to SEQ ID NO: 20866

SEQ ID NO: 110214 - DNA, 601 bp, Human; identical to SEQ ID NO: 20867

SEQ ID NO: 110215 - DNA, 601 bp, Human; identical to SEQ ID NO: 20868

SEQ ID NO: 110216 - DNA, 601 bp, Human; identical to SEQ ID NO: 20869

SEQ ID NO: 110217 - DNA, 601 bp, Human; identical to SEQ ID NO: 20870

SEQ ID NO: 110218 - DNA, 601 bp, Human; identical to SEQ ID NO: 25135

SEQ ID NO: 110219 - DNA, 601 bp, Human; identical to SEQ ID NO: 27202

SEQ ID NO: 110220 - DNA, 601 bp, Human; identical to SEQ ID NO: 27203

SEQ ID NO: 110221 - DNA, 601 bp, Human
tgctgtgagaacacagtgggggacatgcagtgcaccgggcaggctctgcgaggaaagtcaggatgaaccaacacatgggacaatgagtggggctaagctaagagacagatgggagtggggtgggaaaagctggagaaaagagggacaagttcagagtaaccggtgcaggtacaaggtggggaattcaaggagacacctgaagctggatcctaaaagatttttttgttttttttttgagacagggtctcactctgtggcccaggctggagtgcagtggtgtgatcatggctcactggcagcmttgacttcctgggctcaggtgatcctcccacctcagcctcccaagtagctgggactacaggtgcacaccactatgcctggctcatttttgtattttctggtagagacagggtcttgctatgttgcccaggctggctaaaaggtcctataagttatgtcagacagcacggacttcgtcctgaaggcaaagggaagccgtcagcagttttggcgctgggagtgacagaccatccagactgaacacttgaagcggtgcggagaactgaaaggcagggagactcgttagaagctgctgtagtaa

SEQ ID NO: 110222 - DNA, 601 bp, Human
ctgatacagaaattatgtttttcttttcttttggccaaggatcaatatatgaacatttaacgtgcagaaaaatgcccatgtcagccgcaacactcttcccagaatgacacagagaacaggggcatctctcagttggcacaagctgtgtacccagaaccctgccccaggcagggagatgtccacacttgcaacacatgctcactgcgactctcttagacatcaagaaaatccacctttggccctagaccagacacacccagccacactgcatactgccttttttttttttttttttttttttaataaacggagttttgctcttgttgtccaagctggagtggaatggcacgatctcggctcactgtaacctccgcctcccaggttcaagcgattctcctgcctcagcctcccaagtagctggggttacaggcatgcaccaccatgcccggataactttttgtatttttagtagaaacggggtttcaccaagttagccaggccggtcttgaactcctgacctcaagtaatccgcctgcctcagcctctcaaagtgctaggattacaggcatgagccaccgtgcccgaccctgtcttttaagaa

SEQ ID NO: 110223 - DNA, 601 bp, Human
ctacctcccggggcacagagcagggtgctttggccatgcactgtatctgcctcctgcacccttcctctcgctgtaatcaaacctcccaggctctgcactcctgctcattgtaatgggaaccccttagaaagcatggttcaattatttatcagagaaaatgactgcacctctcatgtcactggggaacagactagctctgctcctgagaccgcccggttcattctgtaccctctgaatttaggacctatgtccacttctgctggctgccccactgccatgtttgtagagtgtgtggggtaayaaactccagaactgaagttaaggtgaccccggagcacaaaatgaggcaaagttgaaatataaagagtaagagctatcacgcacagaaataacccaaaagactgtcagtaattcccccatacccaacgaaagacacttagaaggaagcaccagattaagattacaactgaaaggcctacactgaagtaactgccctgttagcagcttcaagaaaaccacgttagaataagaaaaggaaatcatgggtatagtatctcgtcagcagaaattctcctgtgccgtggtgggccccggaggccca

SEQ ID NO: 110224 - DNA, 601 bp, Human
ttaatgaagatgaagaaatatctgccccccaccccccacaaggaggacgaatggcagagtgtactttactccctgtggcttattccacggtcacctccaagccccagtgagtcagaaataccttaacgcaccaaccctcaaatttcactcagacaaacatcccaaaaaaccaaacagggaatttaattaaagcgacgccgctatgggcttcttgggattcttttcagcagggcactgacagggaccagctctgatcagcagaggtgccgcaactcatcactctggcatcagagctttctcsggcgcctcccacccctaccccagcctctacctcccggggcacagagcagggtgctttggccatgcactgtatctgcctcctgcacccttcctctcgctgtaatcaaacctcccaggctctgcactcctgctcattgtaatgggaaccccttagaaagcatggttcaattatttatcagagaaaatgactgcacctctcatgtcactggggaacagactagctctgctcctgagaccgcccggttcattctgtaccctctgaatttaggacctatgtccacttctgctggctgccccactg

SEQ ID NO: 110225 - DNA, 601 bp, Human
aaaagattaatgaagatgaagaaatatctgccccccaccccccacaaggaggacgaatggcagagtgtactttactccctgtggcttattccacggtcacctccaagccccagtgagtcagaaataccttaacgcaccaaccctcaaatttcactcagacaaacatcccaaaaaaccaaacagggaatttaattaaagcgacgccgctatgggcttcttgggattcttttcagcagggcactgacagggaccagctctgatcagcagaggtgccgcaactcatcactctggcatcagagckttctcgggcgcctcccacccctaccccagcctctacctcccggggcacagagcagggtgctttggccatgcactgtatctgcctcctgcacccttcctctcgctgtaatcaaacctcccaggctctgcactcctgctcattgtaatgggaaccccttagaaagcatggttcaattatttatcagagaaaatgactgcacctctcatgtcactggggaacagactagctctgctcctgagaccgcccggttcattctgtaccctctgaatttaggacctatgtccacttctgctggctgcc

SEQ ID NO: 110226 - DNA, 601 bp, Human
gaggcaaggacatggaaagaagagagaaaaagattaatgaagatgaagaaatatctgccccccaccccccacaaggaggacgaatggcagagtgtactttactccctgtggcttattccacggtcacctccaagccccagtgagtcagaaataccttaacgcaccaaccctcaaatttcactcagacaaacatcccaaaaaaccaaacagggaatttaattaaagcgacgccgctatgggcttcttgggattcttttcagcagggcactgacagggaccagctctgatcagcagaggtgcygcaactcatcactctggcatcagagctttctcgggcgcctcccacccctaccccagcctctacctcccggggcacagagcagggtgctttggccatgcactgtatctgcctcctgcacccttcctctcgctgtaatcaaacctcccaggctctgcactcctgctcattgtaatgggaaccccttagaaagcatggttcaattatttatcagagaaaatgactgcacctctcatgtcactggggaacagactagctctgctcctgagaccgcccggttcattctgtaccctctgaatttag

SEQ ID NO: 110227 - DNA, 601 bp, Human
gatcacttgaggtcacaagatcgagaccagtctggccaacagtggtgaaacccgtctctactaaaaatacaaaaattatccaggcatggtggcgggtgcctgtaatcccagctactcgggaggctgaggcaggagaatcgcctgaacccaggaggcagaagttgcagggagccgagattgcaccactgcactccagtctaggaaacaacagcaagactccgtttcgaaaaaaaaaaaaaagtcacagagatcacgacagagttgggtctcaaaacagtttcgtctgacttcagaatccatrcatttagccactctgggtagtaagcagtgtggaaagagcacagaagacttcctaacccatcgaagatactcaccatggcccctttccctccaactagcctgtggctaaggccttaagttttcttctcagtaactgaacccttcaagctaattattgcctccctccctcccttcctgcttcttaaaaattggaacttctcaaaggaggaacacattcacccattaacgcctcagcaggaaccagtttcccagagacagccagtgtttaccggcagggacaaggcactcagatgagtgtgct

SEQ ID NO: 110228 - DNA, 601 bp, Human
ctgagagctctgtagaatcaccctcattttacagatgaggttcaaagaggttaggtgacttaaccaaagtcacagagatcgggccaggcatggtggctcacgcctgtcatctcagcactttgggaggccgaggcgggcggatcacttgaggtcacaagatcgagaccagtctggccaacagtggtgaaacccgtctctactaaaaatacaaaaattatccaggcatggtggcgggtgcctgtaatcccagctactcgggaggctgaggcaggagaatcgcctgaacccaggaggcagaagytgcagggagccgagattgcaccactgcactccagtctaggaaacaacagcaagactccgtttcgaaaaaaaaaaaaaagtcacagagatcacgacagagttgggtctcaaaacagtttcgtctgacttcagaatccatacatttagccactctgggtagtaagcagtgtggaaagagcacagaagacttcctaacccatcgaagatactcaccatggcccctttccctccaactagcctgtggctaaggccttaagttttcttctcagtaactgaacccttcaagctaattattgcctcc

SEQ ID NO: 110229 - DNA, 601 bp, Human
gatggagtcttgctgcgacgcccaggctggagtgcaatggcgcgatctcggctcactgcaaactctgcctcccgggttcaagcgattatcctacctcagcttcctgagtatctgggattacaggcgtgggctaccacgcccagctaatttttgtatttttagtagaaacagggtttcaccatgttggccaggctgatctcaaactactgacttcaagtgttccacccgccttggcctcccgcccagcccccgctggattttaagtgacatgactgagaacgaatgctctgactattgaggstaaacgtcacttctgcaggtcaaaacgccttccggatgtttacggtgcccacaccatttccatgtgttcccggctgtacagactgtaaacccttctagagatggtgtctgtttagcaacatgctgacccgctgtaaagactgtaaacccttctagagatggcgtctgtttagcaacatgctgattattttgatcaggctgtacatgcacataatacaaaattatgacacaaattcaaaattacaaaaggatacaatatagagtaactagagtaactcctcttcttgcttgtccctcgtcc

SEQ ID NO: 110230 - DNA, 601 bp, Human
tcccgtctcagcctcctgaggagctgggcccgagcaatcctcctgtcacagcctcctgaggagctgggcccgagtgatcctcctgtctcagcctcctgaggagctgggcctgagtgatcctcctgtctcagcctcctgaggagctgggactataggtgcacaacactgaacccagctggattgtttgtttgtctgagatggagtcttgctgcgacgcccaggctggagtgcaatggcgcgatctcggctcactgcaaactctgcctcccgggttcaagcgattatcctacctcagcttccygagtatctgggattacaggcgtgggctaccacgcccagctaatttttgtatttttagtagaaacagggtttcaccatgttggccaggctgatctcaaactactgacttcaagtgttccacccgccttggcctcccgcccagcccccgctggattttaagtgacatgactgagaacgaatgctctgactattgaggctaaacgtcacttctgcaggtcaaaacgccttccggatgtttacggtgcccacaccatttccatgtgttcccggctgtacagactgtaaacccttctagagatgg

SEQ ID NO: 110231 - DNA, 601 bp, Human
tcctgtcacagcctcctgaggagctgggcctgagtgatcctcctctctcagtctcctgcctgggcctgagtgatcctcctgttacagcctcctgaagagctgggcccgagtgatcctcccgtctcagcctcctgaggagctgggcccgagcaatcctcctgtcacagcctcctgaggagctgggcccgagtgatcctcctgtctcagcctcctgaggagctgggcctgagtgatcctcctgtctcagcctcctgaggagctgggactataggtgcacaacactgaacccagctggattgtytgtttgtctgagatggagtcttgctgcgacgcccaggctggagtgcaatggcgcgatctcggctcactgcaaactctgcctcccgggttcaagcgattatcctacctcagcttcctgagtatctgggattacaggcgtgggctaccacgcccagctaatttttgtatttttagtagaaacagggtttcaccatgttggccaggctgatctcaaactactgacttcaagtgttccacccgccttggcctcccgcccagcccccgctggattttaagtgacatgactgagaacgaatgctct

SEQ ID NO: 110232 - DNA, 601 bp, Human
aatgtgggctcaggagatacaaacttatagcatctacttaacaaaaataacaaagataataaatttctctctctcataaagtatttcccaaagctgagaagttttttttttttttcttttttttttgagagggagtctcgctctgttggccaggctggagtgcagtagcgcgatctcggctcactgcaagctccatctcccaagttcacgccattctcctgcctcagcctccccagcaactgggacgacaggtgcccgccaccatgcccggctaattttttttgtatttttagtagagacrgggtttcaccgtgttagccaggatggtctcgatctcctgacctcgtgatccgcccaccttggcctcccacagtgctgggattacaggcgtgagccaccgcgccctgccttatttttttattttatttttttgagacagcatctcactctgttggccaggctggagtgcagtggcacgatctcagctcactgcaacttccacctcctgggttcaagcgattctcctgcctcagcctcctgagtagctggcattacaggcgcctgcgaccacgccagggtaatttttgtatttttgtagaga

SEQ ID NO: 110233 - DNA, 601 bp, Human
acggagtcttgctctgtcgcccaggctggagtgcaatggcatgatctctgctcactgcaacctctgcctcctgggttcaagcgattctcctgcctcagcctcctgagcagctgggattacaggtgtccgccaccacgcctggctaattttttttatttttagtagagacagggtttcaccatgttggccaagttggtctcagactcctgacctcgtgatctgcccaccttagcctcccaaagtgctgggattacaggtgtgagccaccgtgcctggccgagaaagattttcaaaagggtckgagagattaaaaaataactctctaacactgagggctctcaaagtttggatctgaacaaagcagatccagtagatcctctggagagttcttctagctccaagaatttgagttctacccgaaggaatgaaaggtggacagcaaatacttccacgaaccccaacatacgtcatgctggcctttgtcaggcagtggatggctgaagctccaggctaaaactccaatgaaagtctccatgtttcctcatttgttaacattttccctttctttttgtcaggactagggtgaccaaaagcctcaggc

SEQ ID NO: 110234 - DNA, 601 bp, Human
ccagcctgggtgacacagcaaggttctgtctcaaaaaaaataaaataaaattttagattcttggctgggcacagtggctcacaactgtaatcctagcaccttgggaggctgaggcgggtgggtcacctgagctcaggagttccagaccagcccgggcaacatggggaaaccctgtctctactaaaaatacaaaaattagccaggcgtggtggcgggcacctgtagtcccagctactcaggaggctgtgacatgagaattgcttgaattggggagttggaggttgcaatgagccaagattgyaccactgtactccagcctgggtgacagagcgagactctgtttcaaaagaaaaaaaaaaaaagaaaacaagttttcttaacattttttaagtgaattctcttttctgaatctcattatctaaagagttaatggccaaaggccaagaggtacttgttcagtgaattataaaacgtcctcaacttctgtgagccacagtttatctataaaatgaaactaatacctgtgttacaggttgccatgaaaactgggtgatgtaatacatgtgaaactcttagcatacgtgataggcacacaggaagt

SEQ ID NO: 110235 - DNA, 601 bp, Human
ttgagacggagtctcgctcagtcacccaggctggtgtgcagtggcacgatcttggctcactgcaagctctgcctcctgggttcacgccattctcctgcctcagcctcccgagtagctgagactataggtgcccaccaacacgcccggctaattttttgtgtttttagtagagacggggtttcaccatgttagccaggatggtctccatgtcctgacctcatgatccgcccgccttggcctcccaaagtgctgggattacaggcgtgagccatcgcacctggccttttttttttttttttttgagacagggtctcactgtgtcactcaggctggagtgcagtggtgcgatcaccatgcaaggctaatttttgtattttttgtagagagagagttttgccatgctgcccaggctggtctcacactcctggactcgagcaatccacccacctcagcttcccaaagtgcttagattacaggtttgagccactgggtatggcctaagccccaatttctataataataaaatagagataacagtacataggattgtgatgaagatttaagatgtgcggtcaggagttcaagaccagcctggccagca

SEQ ID NO: 110236 - DNA, 601 bp, Human
ttctgactccatcactaattgtatgaccttgagtaagttactgcaatgctctctaagcctcagtttttttcttttttcttttttttttttttttgagacggagtctcgctcagtcacccaggctggtgtgcagtggcacgatcttggctcactgcaagctctgcctcctgggttcacgccattctcctgcctcagcctcccgagtagctgagactataggtgcccaccaacacgcccggctaattttttgtgtttttagtagagacggggtttcaccatgttagccaggatggtctccatstcctgacctcatgatccgcccgccttggcctcccaaagtgctgggattacaggcgtgagccatcgcacctggccttttttttttttttttttgagacagggtctcactgtgtcactcaggctggagtgcagtggtgcgatcaccatgcaaggctaatttttgtattttttgtagagagagagttttgccatgctgcccaggctggtctcacactcctggactcgagcaatccacccacctcagcttcccaaagtgcttagattacaggtttgagccactgggtatggcctaagccccaat

SEQ ID NO: 110237 - DNA, 601 bp, Human
gtattctgactccatcactaattgtatgaccttgagtaagttactgcaatgctctctaagcctcagtttttttcttttttcttttttttttttttttgagacggagtctcgctcagtcacccaggctggtgtgcagtggcacgatcttggctcactgcaagctctgcctcctgggttcacgccattctcctgcctcagcctcccgagtagctgagactataggtgcccaccaacacgcccggctaattttttgtgtttttagtagagacggggtttcaccatgttagccaggatggtctcsatgtcctgacctcatgatccgcccgccttggcctcccaaagtgctgggattacaggcgtgagccatcgcacctggccttttttttttttttttttgagacagggtctcactgtgtcactcaggctggagtgcagtggtgcgatcaccatgcaaggctaatttttgtattttttgtagagagagagttttgccatgctgcccaggctggtctcacactcctggactcgagcaatccacccacctcagcttcccaaagtgcttagattacaggtttgagccactgggtatggcctaagcccc

SEQ ID NO: 110238 - DNA, 601 bp, Human
tgtattctgactccatcactaattgtatgaccttgagtaagttactgcaatgctctctaagcctcagtttttttcttttttcttttttttttttttttgagacggagtctcgctcagtcacccaggctggtgtgcagtggcacgatcttggctcactgcaagctctgcctcctgggttcacgccattctcctgcctcagcctcccgagtagctgagactataggtgcccaccaacacgcccggctaattttttgtgtttttagtagagacggggtttcaccatgttagccaggatggtctycatgtcctgacctcatgatccgcccgccttggcctcccaaagtgctgggattacaggcgtgagccatcgcacctggccttttttttttttttttttgagacagggtctcactgtgtcactcaggctggagtgcagtggtgcgatcaccatgcaaggctaatttttgtattttttgtagagagagagttttgccatgctgcccaggctggtctcacactcctggactcgagcaatccacccacctcagcttcccaaagtgcttagattacaggtttgagccactgggtatggcctaagccc

SEQ ID NO: 110239 - DNA, 601 bp, Human
ctggattgtattctgactccatcactaattgtatgaccttgagtaagttactgcaatgctctctaagcctcagtttttttcttttttcttttttttttttttttgagacggagtctcgctcagtcacccaggctggtgtgcagtggcacgatcttggctcactgcaagctctgcctcctgggttcacgccattctcctgcctcagcctcccgagtagctgagactataggtgcccaccaacacgcccggctaattttttgtgtttttagtagagacggggtttcaccatgttagccaggayggtctccatgtcctgacctcatgatccgcccgccttggcctcccaaagtgctgggattacaggcgtgagccatcgcacctggccttttttttttttttttttgagacagggtctcactgtgtcactcaggctggagtgcagtggtgcgatcaccatgcaaggctaatttttgtattttttgtagagagagagttttgccatgctgcccaggctggtctcacactcctggactcgagcaatccacccacctcagcttcccaaagtgcttagattacaggtttgagccactgggtatggcct

SEQ ID NO: 110240 - DNA, 601 bp, Human
gacggaagaattctgcatatggactcgaagccatacatttccagatctgtgtcactggtctcaccatccatgatttctagttctctcgtgtcacggtgtttgaagcacctttttttttttttttttttttggtagagaggtgtgtgtggggggggtcttcctatgttgaccaggctggtcttgggctcctggcctcacacgatcctttgcctcaacctcccaaagtgctgggattacagcataggtgtgagccaccacacttggcccgtttcattcatttattcattcaacaaatacttaygaaacatctttttttttttgagacggagtctcgctctgccgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcg

SEQ ID NO: 110241 - DNA, 601 bp, Human
tccctgtccattgtctctatctgggtggttctttggaaaatgtccctgaaatgtcccaagggccataatctcctagtggaagtggagagctatcgagcgtggcaaccatcattactagagggaaggaggaataggttttctgactccatagtgagctgctgaggccttgaaacccaaactgattttagcgtctgtgacacgcacagtgagaaatttggtacgtacagtgcagaggggaaaggcggctttagtcatctgctgtcattcctttcactgggtccttttgtctcatctggaacaraaaaagcaggacaaatggaaggctcctgctgctgatggaactcctgccttctcagtcctgcccataggtggggtggggcatattttgtgtaaaaagcaagacactggaaggacggaagaattctgcatatggactcgaagccatacatttccagatctgtgtcactggtctcaccatccatgatttctagttctctcgtgtcacggtgtttgaagcacctttttttttttttttttttttggtagagaggtgtgtgtggggggggtcttcctatgttgaccaggctggtcttgggctcct

SEQ ID NO: 110242 - DNA, 601 bp, Human; identical to SEQ ID NO: 110222

SEQ ID NO: 110243 - DNA, 601 bp, Human; identical to SEQ ID NO: 110223

SEQ ID NO: 110244 - DNA, 601 bp, Human; identical to SEQ ID NO: 110224

SEQ ID NO: 110245 - DNA, 601 bp, Human; identical to SEQ ID NO: 110225

SEQ ID NO: 110246 - DNA, 601 bp, Human; identical to SEQ ID NO: 110226

SEQ ID NO: 110247 - DNA, 601 bp, Human; identical to SEQ ID NO: 110227

SEQ ID NO: 110248 - DNA, 601 bp, Human; identical to SEQ ID NO: 110228

SEQ ID NO: 110249 - DNA, 601 bp, Human; identical to SEQ ID NO: 110229

SEQ ID NO: 110250 - DNA, 601 bp, Human; identical to SEQ ID NO: 110230

SEQ ID NO: 110251 - DNA, 601 bp, Human; identical to SEQ ID NO: 110231

SEQ ID NO: 110252 - DNA, 601 bp, Human; identical to SEQ ID NO: 110232

SEQ ID NO: 110253 - DNA, 601 bp, Human
aatatactccccctcagcctcccaaagtgccgctgggattacacaggcatgagctaccacatctggtctcattgacctaattttcaatgactggattttatagtcacaagagaaaaacaaagacttgcctatgtttggttatttccaaaactaagttgtaaagacagcaaacagtaatcaaatcatatccaattcaataggtattttatatttgaaataagtagtgttcttttatttaatattaaagcatcaagcataaatgttcagggtagtcctcaacatttaagtatattttagaatrataaatgcacatttgaaacttcaaacgatatgaattaaaaaaaaattccattttagtggaatacgagattaagccatgcagtcaaatcagtttttaatttcttccatataggccagaaaacataaaatttcattcaattttaaaaatttcattcaaattttaaaatataaaaaaatgaaaaaaagatgtttagtatatgggccacgaagtggggcacttattcaattttaatgtataggattatcatgggaaaatgtaaatataaaacaaggagcatgactgaaggagggagtagataca

SEQ ID NO: 110254 - DNA, 601 bp, Human
gaatgacaaccataagtgtccctgcaacaagatattatataaatacgccgaagtttgaataggacagaacctagaggcagaaagagaagttataaaaaaaaggccctaggagaacagtgcttgacctagtagataagccataaatgaagataagaatatttatcgggggtgtggtggctcacgcctataatcccagcactttgggaggccaaggcgggtggatcacctgaggttgggagttcgagaccatcctggccaacatggagaaacccccatctctactaaaaataaaaaattagcygggtgtggtggcacatgcctgtaatcccagctactcaggaggctgaggcaggagaaatcacttgaacccgggaggcggaggttgcggtaagccaagatagcgccactgcactccagcctgggcaacgagcgaaactgtcttttgtcaaaaaaaaaaaaaaaaaaaaaaaaaaaacaacaaaccaaaaccaaaacaaaccaacagacaaacttatcagagtatagatgaatcagctggtaaatgaattcaagaggggtagaaaaataagcgaaactggaaggctaggggactaaaaacagt

SEQ ID NO: 110255 - DNA, 601 bp, Human
gcacagtggttcatgcctgtaatcccagcactttgggaggccaaggcgggtggatcacttgaggtcaggagttcaagaccagcctggccaacagggtaaaaccccatctctactaaaataatacaaaaattagccaggcatggtggcacccacctataattccagctacttaggaggctaagtcacgagaatcgcttgaacccaggagatggaggttgcagtgatccaagatcatgccactgcacaccagcctgggtgacagagcaagactccatctcaaaaaaaaaacaacaacaacaamaaaaaaaaaaaacgaggaggccaaggcaagtggatcgttaggggccaggagtttgaggctgcagtgagctaggattgcgccactgcactccaacctgggtgacaaagcaagaacctgtctcaaaaaaaatgagaggcaatgtcattggcccatttttcatttgaaggaactgaggcccagagagggcaggtcctgtggccaagattgcacagcaggttgtggcagagcccaaacctgctatatgactttcagtggctgccgcaaaaattaccaccaactaggtggcttcaaacaatggaa

SEQ ID NO: 110256 - DNA, 601 bp, Human
accaggcctcacactccccgacttgcccgagcagttctccccacctgatgtggctccccctcttctggtgaagcttgtggaggccattgaaaggacaggtaagttccagcctggctgcagcccctggattctgcttgcttacctctagtgacaggcgactcatcctctcacagggcctccaagctcatgctgcacggaaacaggctgagcctggatgccctgggcctctatgttgaatagggcacagagtgactcctaagggaagatgggaaggtgaacatgaccaggccactgcatgtgytgtgccctctcccagttctccctccccacccctcccatgcccttatctctgggcagcaaagggagactgcaggggggttgagcggccagtccaggcctcacgaggtcggggcagcatttgagagctgactcgcctgtccccttcacccccagggctggacagcgaatctcactaccgcccggagctgcccgcaccgcgtacaggtgaaggggagcctcaatggggttgggaggaggctgggggccccagtacacatgagttggacgtgtgcccccctgcacccgcagactggtccctgag

SEQ ID NO: 110257 - DNA, 601 bp, Human
ctgtgcacatgcgtgggcggacaggccctacccagccctcaccacactccccttccccctaaggagtgagcccagccctgacttcccggcgctgctggtggagaagctgcttcaggaacacttggaagagcaggaggttgcgcccccaggtgagtcccctgtattgctgtcatttcttcccgttgggggccgtaaatactgatccctgagtgctgccggcatcagcaggctggttgcagtgggaggcagccacagtatacagtcggtgctcaggatgcatttgttttcctgtcccccagcrctgccgcctaaaccccccaaggcaaagccggcccccacagtcctggccaatggagggagcccaccctccctgcaggatgctgagtggtactggggggacatttcaaggtaggttgctggcagggggccagggaccaaggaggtgtcacagggtgagcggggtctccaggtggctcggcagtcccaatgttggatgttcccacagggaggaggtgaacgagaaactccgggacactcccgatggcaccttcctagtccgagatgcttctagcaagatccagggcgagtacacgctgaccct

SEQ ID NO: 110258 - DNA, 601 bp, Human; identical to SEQ ID NO: 34454

SEQ ID NO: 110259 - DNA, 601 bp, Human; identical to SEQ ID NO: 34455

SEQ ID NO: 110260 - DNA, 601 bp, Human; identical to SEQ ID NO: 34456

SEQ ID NO: 110261 - DNA, 601 bp, Human
ttttattttttttattttttatttttttcataggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctatattttccatcctttacatccttctgtctgttcaagaaccagtctgggatcttgyactggcgtggattctgcataatggtgatcacacgttccacctcatcatcagtgagttctcccgccctcttggtgaggtcagtgtctgctttcctcaacaccacatgagcatatcttcggcccacacccttaatggcagtgatggcaaaggctattttccgctgcccatcgatgttggtgttgagtactcgcaaaatatgctggaacttttcagggatcactagcgacatggcggcagcacaagcggcggcgtgtaggcctcctgtggaggagcaatttttgtatttttagtagagacgag

SEQ ID NO: 110262 - DNA, 601 bp, Human
ccaagtagctgggactacaggcgcgggccaccacgcccagctaatttttgtatttttattttttattttttttattttttatttttttcataggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggaccwggctatattttccatcctttacatccttctgtctgttcaagaaccagtctgggatcttgtactggcgtggattctgcataatggtgatcacacgttccacctcatcatcagtgagttctcccgccctcttggtgaggtcagtgtctgctttcctcaacaccacatgagcatatcttcggcccacacccttaatggcagtgatggcaaaggctattttccgctgcccatcgatgttggtgttgagtactcgcaaaatatgctggaacttttcagggatcactagcgacatggcggcagcac

SEQ ID NO: 110263 - DNA, 601 bp, Human
ggctgtttccagatgacccacgggaagggcaggtgaagcaggggctgctgggggattgctggttcctgtgtgcctgcgccgcgctgcagaagagcaggcacctcctggaccaggtgcggggccccttccctgtgtttgtcctggagccggtttctttttgcgtttctccagcctgctgagtaccaggaggccttgcgaaagcagagctgtgccgcagccggatctcctgctgtgttgggggaaggcaggagagttccaaggcagaggctgaggactgcactctgtccctctgctgcagggrggggtgccttggcctcgccagaaggctccatcagggaggttcgccctgctctgtgctctcctgacccccggactccatggagtcagatcaccacgtttagaataaagagacaaatgtgccagctcacaggaggacggggctggctggcagcctctgcctcagatctctcctcagctagctcgctggttttcttacaggttttgaatataagtttgcaaaaagttattaaacctgtttctgtgggtagacagatactctgggaggagaaggccttctcaggttttccttacctgggagtgt

SEQ ID NO: 110264 - DNA, 601 bp, Human
tgtcctggagccggtttctttttgcgtttctccagcctgctgagtaccaggaggccttgcgaaagcagagctgtgccgcagccggatctcctgctgtgttgggggaaggcaggagagttccaaggcagaggctgaggactgcactctgtccctctgctgcaggggggggtgccttggcctcgccagaaggctccatcagggaggttcgccctgctctgtgctctcctgacccccggactccatggagtcagatcaccacgtttagaataaagagacaaatgtgccagctcacaggaggacrgggctggctggcagcctctgcctcagatctctcctcagctagctcgctggttttcttacaggttttgaatataagtttgcaaaaagttattaaacctgtttctgtgggtagacagatactctgggaggagaaggccttctcaggttttccttacctgggagtgttcaccgttttatgcttggcttgttgctaagtgttgctgattaatgcagcggcgtcaacagtgtgacctcattcagagtttcactcatgtcccaggccccatggtaagcgtgtcacagtcactggctttcagacaca

SEQ ID NO: 110265 - DNA, 601 bp, Human
tcaccgttttatgcttggcttgttgctaagtgttgctgattaatgcagcggcgtcaacagtgtgacctcattcagagtttcactcatgtcccaggccccatggtaagcgtgtcacagtcactggctttcagacacatggtcttaccagctttgactttttttttaaacgagagtgctaaaatcactgccattgtgtttctggccgtaaagtggcagagccaggaccgcaccaggtgcctggtgcccagcctgcactcccccgatgctgggtcagaatgcttacccctgaaggagccctgcrgtggacgctgtgggtgcaagcagctggcccagtgtcggggcgccaggctcccagcagcaggaggggctgctgttcctgtggtgacgtgttgcttgcagccagctcggtcaagaactgggtcactcatgcccttgaatgtcacatttgttttggcttcaggtcagatgcttttagtgagggcagcagagtgtgtcccgggatatgtggctccctcggtgtggtcctcaagttttgcaatgagaggtctgttaatttcatgtgggtgatgcagccctgtgcaggcgccgacatccaggtgtg

SEQ ID NO: 110266 - DNA, 601 bp, Human
cactcatgcccttgaatgtcacatttgttttggcttcaggtcagatgcttttagtgagggcagcagagtgtgtcccgggatatgtggctccctcggtgtggtcctcaagttttgcaatgagaggtctgttaatttcatgtgggtgatgcagccctgtgcaggcgccgacatccaggtgtgccgaagagttctctgcgacatccaggtgtgccgtagagttctctgcgacatccaggtgtgccgtagagttctctgcgacatccaggtgtgccgtagagttctctgcgacatccaggtgtgcgttagagttctctgcagaccgcggtgcctgtggagcactcagctgtggccacaccgcggccgggacactggagtagcgccgggtggtgcttatatcacgctcgccttttgcttctccctgtgcatggcaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggct

SEQ ID NO: 110267 - DNA, 601 bp, Human
gggcctggcctggggcaagtgggagctgccactaccatgggctgccccaggagggtctctgctcactctgggctgcagagcccccttcagttctgagggtctggcagctcattctgtgagtcaggctgacaggccaggtgcagagattcttcttttgggcctgtggattgcccactccctgctttcccttcccttgttccaaagcccagcgtggagtcgttctccacagagaacatgtgtgccgtcctccttattttatcggccccagcaagaaagatgcttctttatatttgttgtggartggttgggacaggcagactcattgtgtagtcgttggggaggaatgaggctaccccagcataccaacacttgtgtatcacggtgcttgctggctcaggggaccaggaccctcaccatgagtcataattgaatagccttccctcttagaatgcatttgtcttcttgccaaaggcaactggactgacaggcaggcagggaagctggtgaacatgggaaggctggctggtgacatcagtgcccagtgagcccttccatcccaagggctgttttaggaaaagcagggttggagcttgagagccaa

SEQ ID NO: 110268 - DNA, 601 bp, Human
ctgggctgcagagcccccttcagttctgagggtctggcagctcattctgtgagtcaggctgacaggccaggtgcagagattcttcttttgggcctgtggattgcccactccctgctttcccttcccttgttccaaagcccagcgtggagtcgttctccacagagaacatgtgtgccgtcctccttattttatcggccccagcaagaaagatgcttctttatatttgttgtggaatggttgggacaggcagactcattgtgtagtcgttggggaggaatgaggctaccccagcataccaacrcttgtgtatcacggtgcttgctggctcaggggaccaggaccctcaccatgagtcataattgaatagccttccctcttagaatgcatttgtcttcttgccaaaggcaactggactgacaggcaggcagggaagctggtgaacatgggaaggctggctggtgacatcagtgcccagtgagcccttccatcccaagggctgttttaggaaaagcagggttggagcttgagagccaagggatgtgggcatccatagcttccacgcctcctgccctgctcctgtgcccacaccggatgccagaga

SEQ ID NO: 110269 - DNA, 601 bp, Human
cctgaagggcgtagcaggaagcggaggccagcaggacaggccaggccgctgggagcacaggacttgtcggcagctgctccacctgaaggaccagtgtctgatcagctgctgcgtgctcagccccagagcaggtgaggcacgtggccagcatgggagggctgcagccagcgtgccccccactgccaggcctcaggcacactgtagctttttatgtgactggctacacagccctgtcaggactaagtgggaagaagtaagcttgttctcaagggtggtgtcctcagtttgtgaccttcccctrctgtcctcttccagagggacgtggcccttctctcccctgaccagtcctttccactagtgcgaggcaggaagaggtggcaccgagtcaaagcccactgtctgtgccatccctggcccagctggcaacctggcaaaatcaaaacctgttttttattttagtgatagataacattcgttaaaaacagtttgtctccaaaaaatgaaaggggccaggtgtggtggctcacacctgtaatcccagaactttgggaggctgaggtgggagtatcgctggagcccaggagttcaagagacccgcctg

SEQ ID NO: 110270 - DNA, 601 bp, Human
caacatggcaagatctcatctctacaaaaaatgaaggaaaaaaatcacttagatggaaccacatgtgacttttgagtgcgctctcagttttccatgagcacgcacggtttacgtgttcccttccgcaccgcttctcacactgccacacacgcgctgtcaaatgttcgccccatgagcgggtttgccacagtctcttaatcattcccctgatgttggatattaagatctctctggttttatataattataagcagtatcaatgaacatctttatcatttttttcatacttaggattattttwaaaatatgggttaaagaatatgaatatcacagtaaactgaaacaagttgtcataggccttggtctgggtcccccataagcagaccctgagatgaggttcaggagcacgttgagaggttcagagagcctggagggcgtgtactccccgccagccccgctggggtgccaggaaggacgctggcctcagagcctcccacctgggagtgagggcgctggtctggtgggcattagctcggggagctgttggttttgggtgctccagggtggggtagcgctaagtcctagcacttcaggctttaga

SEQ ID NO: 110271 - DNA, 601 bp, Human
gagagatggcagctggcactgactggaggtgcattggagcctgctgaggtggcaaggggccgcggcgtgggcgagactgaagtccttccaggagaccctcctctctagaccgttgccccgccacagatgtggccttcctctctgtttggctctttcttttctatgcccatctgtctcaaggtctctggccaggtggagctgttgcccccctgggcctccatgcctccagtgggcttctagccagggcactatctgaatgtcctacctctagcaggctttgccaagagaaacactctctagrtttctggcagttgcagatgcatctgtgcagcatgtttgagaactggtgctgtgccaggcatcgtgcacagatgggtacggacgatgactgaggcctagagaaggggatgacttacccagcaccagacccggatggcagccgagtcaggccccgtgtgcttgctcctggagatgctcctgagctgatgggtcacagctgctaagaaaggagctctcgtggtccatggggatctggggtctcccgtgtagccatagtggggtgggctggagcatctccagaggaggaggcagaggcctgtgt

SEQ ID NO: 110272 - DNA, 601 bp, Human
actgaggcctagagaaggggatgacttacccagcaccagacccggatggcagccgagtcaggccccgtgtgcttgctcctggagatgctcctgagctgatgggtcacagctgctaagaaaggagctctcgtggtccatggggatctggggtctcccgtgtagccatagtggggtgggctggagcatctccagaggaggaggcagaggcctgtgtgtccttgtcagtttgggactccatggtgcccttcctgcctgtgcctgcgccattcctcatgcaggtgcccgggagctgggggagttycatgccttcattgtctcggacctgcgggagctccagggtcaggcgggccagtgcatcctgctgctgcggatccagaacccctggggccggcggtgctggcaggggctctggagagaggggtgagtgctggggcctggaccatgctgctgtcgggaggggggcccagtgccagtctggcctgtgtcctggtcaccttcagctgtcaggactgtacttggctgtctccagcaaggcccctgagtccctgctctcgtgacaccatgcttgtcttggctccaggcaatccttgtgaggcctggg

SEQ ID NO: 110273 - DNA, 601 bp, Human
ggctacccggtcacggaggccggccacctgcagagcctctacacaggtagtgccccgaggggctgtgctgggcacgtgctctgcctgccgaagtgaggaggctgggcaggtgcctgggttccccctgcccaggcccagtttggttctcttcagcgtggagagatgattctgtcccaggagccgggaggagggtgatgattctgtcccaggagctgggaggagggtgggcttgtgggaggggctggctctgtctgtggccgtagctgctgcttataccctgccagggttcatgaggccaccrtggcgggaggccagcgaggagccgtgtcccacagctgatgcctggtgttttctcactagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatccc

SEQ ID NO: 110274 - DNA, 601 bp, Human
gccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtaactcagccccgtctggctcacgctcggttcagcaggtggtgtggaggcccatggaggtctgggttctaggactggctctgccgggacacatgtgactctgccacgggccccaccagtctcccccctccttgggctgttgcacggggttgacgtctgytggtgctcccagacccggctctgacctgagactgcaggtctttctgccttgccgtgtgcctcattggccaaaggaaagcaacagagtctgcagccagggcaggacccgcaggaggggcctggacccggggggctcctggcagcgccgtgcctttctgaggcaaggaggtagagccagcggctgaggacctgtcagggccagtcccagctctgcagcttgctgtgtgacctggcacacatcctctccctgcctccctcagtctcttcccctgcaagacggggtcctgacacggatctcatg

SEQ ID NO: 110275 - DNA, 601 bp, Human
ctgagctcagccagcagccccttgtccacttaccctgactcagaatgactgtgtcccaaggttcattctctgcagacatgtgtcccctggaatgcaggggccctgacgaggaaggcactgcaaccctcggttcacagtgggctgcctggggacccttggaccctcgctgtttgccctgggccaccggctcaggtcccctagagctctgaggaaaacacatgccagggccagtgggagcccttggggcgggctgggcagtcacaggtgttaaagcccctgatgatgtgacaggcctccaggygggggccccactgccggcaccttctggcaagggtggccaggccttggtgaggaggcgagtccagtgtccaggcctggcagcccctcctcagagaaggggctgtatgtgactcaagagggccaagggcatccgagcagatggccctgggctgggctccctaccccaaggctggccccctcagtctgagcctgcgctttcctcaggtcccagagggtggaaggagccaggacgcacccccactgctgctgcaggagccgctgctgagctgcgtgccacatcgctacgcccaggaggtgagcc

SEQ ID NO: 110276 - DNA, 601 bp, Human
ccttctggcaagggtggccaggccttggtgaggaggcgagtccagtgtccaggcctggcagcccctcctcagagaaggggctgtatgtgactcaagagggccaagggcatccgagcagatggccctgggctgggctccctaccccaaggctggccccctcagtctgagcctgcgctttcctcaggtcccagagggtggaaggagccaggacgcacccccactgctgctgcaggagccgctgctgagctgcgtgccacatcgctacgcccaggaggtgagccggctctgcctcctgcctgcrggcacctacaaggttgtgccctccacctacctgccggacacagagggggccttcacagtgaccatcgcaaccaggattgacaggtggggctctgggacttgggggcggccagctggaggctggggtgctggagtcttagtgctcgcctgtccccccacgtctcctgcctgcccctcaccctcaagcccctatctgtcctggcagaccagggctgtcctgcctacctggggacccttccttgctggtctgagcctggaaggagagtctagtgggaggtgggccaggagcacacagccactt

SEQ ID NO: 110277 - DNA, 601 bp, Human
tcttcctgtgagagccccgggcggtgccttgaagggcagggggagctgaggctgcgtcccattccctggctgcactcggggtggggtgtgagaaggggcgagtgccaccgctgcccgggccccccatctgtctttgcaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggrggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtc

SEQ ID NO: 110278 - DNA, 601 bp, Human; identical to SEQ ID NO: 110263

SEQ ID NO: 110279 - DNA, 601 bp, Human; identical to SEQ ID NO: 110264

SEQ ID NO: 110280 - DNA, 601 bp, Human; identical to SEQ ID NO: 110265

SEQ ID NO: 110281 - DNA, 601 bp, Human; identical to SEQ ID NO: 110266

SEQ ID NO: 110282 - DNA, 601 bp, Human; identical to SEQ ID NO: 110267

SEQ ID NO: 110283 - DNA, 601 bp, Human; identical to SEQ ID NO: 110268

SEQ ID NO: 110284 - DNA, 601 bp, Human; identical to SEQ ID NO: 110269

SEQ ID NO: 110285 - DNA, 601 bp, Human; identical to SEQ ID NO: 110270

SEQ ID NO: 110286 - DNA, 601 bp, Human; identical to SEQ ID NO: 110271

SEQ ID NO: 110287 - DNA, 601 bp, Human; identical to SEQ ID NO: 110272

SEQ ID NO: 110288 - DNA, 601 bp, Human; identical to SEQ ID NO: 110273

SEQ ID NO: 110289 - DNA, 601 bp, Human; identical to SEQ ID NO: 110274

SEQ ID NO: 110290 - DNA, 601 bp, Human; identical to SEQ ID NO: 110275

SEQ ID NO: 110291 - DNA, 601 bp, Human; identical to SEQ ID NO: 110276

SEQ ID NO: 110292 - DNA, 601 bp, Human; identical to SEQ ID NO: 110277

SEQ ID NO: 110293 - DNA, 601 bp, Human; identical to SEQ ID NO: 110263

SEQ ID NO: 110294 - DNA, 601 bp, Human; identical to SEQ ID NO: 110264

SEQ ID NO: 110295 - DNA, 601 bp, Human; identical to SEQ ID NO: 110265

SEQ ID NO: 110296 - DNA, 601 bp, Human; identical to SEQ ID NO: 110266

SEQ ID NO: 110297 - DNA, 601 bp, Human; identical to SEQ ID NO: 110267

SEQ ID NO: 110298 - DNA, 601 bp, Human; identical to SEQ ID NO: 110268

SEQ ID NO: 110299 - DNA, 601 bp, Human; identical to SEQ ID NO: 110269

SEQ ID NO: 110300 - DNA, 601 bp, Human; identical to SEQ ID NO: 110270

SEQ ID NO: 110301 - DNA, 601 bp, Human; identical to SEQ ID NO: 110271

SEQ ID NO: 110302 - DNA, 601 bp, Human; identical to SEQ ID NO: 110272

SEQ ID NO: 110303 - DNA, 601 bp, Human; identical to SEQ ID NO: 110273

SEQ ID NO: 110304 - DNA, 601 bp, Human; identical to SEQ ID NO: 110274

SEQ ID NO: 110305 - DNA, 601 bp, Human; identical to SEQ ID NO: 110275

SEQ ID NO: 110306 - DNA, 601 bp, Human; identical to SEQ ID NO: 110276

SEQ ID NO: 110307 - DNA, 601 bp, Human; identical to SEQ ID NO: 110277

SEQ ID NO: 110308 - DNA, 601 bp, Human; identical to SEQ ID NO: 110263

SEQ ID NO: 110309 - DNA, 601 bp, Human; identical to SEQ ID NO: 110264

SEQ ID NO: 110310 - DNA, 601 bp, Human; identical to SEQ ID NO: 110265

SEQ ID NO: 110311 - DNA, 601 bp, Human; identical to SEQ ID NO: 110266

SEQ ID NO: 110312 - DNA, 601 bp, Human; identical to SEQ ID NO: 110267

SEQ ID NO: 110313 - DNA, 601 bp, Human; identical to SEQ ID NO: 110268

SEQ ID NO: 110314 - DNA, 601 bp, Human; identical to SEQ ID NO: 110269

SEQ ID NO: 110315 - DNA, 601 bp, Human; identical to SEQ ID NO: 110270

SEQ ID NO: 110316 - DNA, 601 bp, Human; identical to SEQ ID NO: 110271

SEQ ID NO: 110317 - DNA, 601 bp, Human; identical to SEQ ID NO: 110272

SEQ ID NO: 110318 - DNA, 601 bp, Human; identical to SEQ ID NO: 110273

SEQ ID NO: 110319 - DNA, 601 bp, Human; identical to SEQ ID NO: 110274

SEQ ID NO: 110320 - DNA, 601 bp, Human; identical to SEQ ID NO: 110275

SEQ ID NO: 110321 - DNA, 601 bp, Human; identical to SEQ ID NO: 110276

SEQ ID NO: 110322 - DNA, 601 bp, Human; identical to SEQ ID NO: 110277

SEQ ID NO: 110323 - DNA, 601 bp, Human; identical to SEQ ID NO: 110263

SEQ ID NO: 110324 - DNA, 601 bp, Human; identical to SEQ ID NO: 110264

SEQ ID NO: 110325 - DNA, 601 bp, Human; identical to SEQ ID NO: 110265

SEQ ID NO: 110326 - DNA, 601 bp, Human; identical to SEQ ID NO: 110266

SEQ ID NO: 110327 - DNA, 601 bp, Human; identical to SEQ ID NO: 110267

SEQ ID NO: 110328 - DNA, 601 bp, Human; identical to SEQ ID NO: 110268

SEQ ID NO: 110329 - DNA, 601 bp, Human; identical to SEQ ID NO: 110269

SEQ ID NO: 110330 - DNA, 601 bp, Human; identical to SEQ ID NO: 110270

SEQ ID NO: 110331 - DNA, 601 bp, Human; identical to SEQ ID NO: 110271

SEQ ID NO: 110332 - DNA, 601 bp, Human; identical to SEQ ID NO: 110272

SEQ ID NO: 110333 - DNA, 601 bp, Human; identical to SEQ ID NO: 110273

SEQ ID NO: 110334 - DNA, 601 bp, Human; identical to SEQ ID NO: 110274

SEQ ID NO: 110335 - DNA, 601 bp, Human; identical to SEQ ID NO: 110275

SEQ ID NO: 110336 - DNA, 601 bp, Human; identical to SEQ ID NO: 110276

SEQ ID NO: 110337 - DNA, 601 bp, Human; identical to SEQ ID NO: 110277

SEQ ID NO: 110338 - DNA, 601 bp, Human; identical to SEQ ID NO: 110263

SEQ ID NO: 110339 - DNA, 601 bp, Human; identical to SEQ ID NO: 110264

SEQ ID NO: 110340 - DNA, 601 bp, Human; identical to SEQ ID NO: 110265

SEQ ID NO: 110341 - DNA, 601 bp, Human; identical to SEQ ID NO: 110266

SEQ ID NO: 110342 - DNA, 601 bp, Human; identical to SEQ ID NO: 110267

SEQ ID NO: 110343 - DNA, 601 bp, Human; identical to SEQ ID NO: 110268

SEQ ID NO: 110344 - DNA, 601 bp, Human; identical to SEQ ID NO: 110269

SEQ ID NO: 110345 - DNA, 601 bp, Human; identical to SEQ ID NO: 110270

SEQ ID NO: 110346 - DNA, 601 bp, Human; identical to SEQ ID NO: 110271

SEQ ID NO: 110347 - DNA, 601 bp, Human; identical to SEQ ID NO: 110272

SEQ ID NO: 110348 - DNA, 601 bp, Human; identical to SEQ ID NO: 110273

SEQ ID NO: 110349 - DNA, 601 bp, Human; identical to SEQ ID NO: 110274

SEQ ID NO: 110350 - DNA, 601 bp, Human; identical to SEQ ID NO: 110275

SEQ ID NO: 110351 - DNA, 601 bp, Human; identical to SEQ ID NO: 110276

SEQ ID NO: 110352 - DNA, 601 bp, Human; identical to SEQ ID NO: 110277

SEQ ID NO: 110353 - DNA, 601 bp, Human; identical to SEQ ID NO: 110263

SEQ ID NO: 110354 - DNA, 601 bp, Human; identical to SEQ ID NO: 110264

SEQ ID NO: 110355 - DNA, 601 bp, Human; identical to SEQ ID NO: 110265

SEQ ID NO: 110356 - DNA, 601 bp, Human; identical to SEQ ID NO: 110266

SEQ ID NO: 110357 - DNA, 601 bp, Human; identical to SEQ ID NO: 110267

SEQ ID NO: 110358 - DNA, 601 bp, Human; identical to SEQ ID NO: 110268

SEQ ID NO: 110359 - DNA, 601 bp, Human; identical to SEQ ID NO: 110269

SEQ ID NO: 110360 - DNA, 601 bp, Human; identical to SEQ ID NO: 110270

SEQ ID NO: 110361 - DNA, 601 bp, Human; identical to SEQ ID NO: 110271

SEQ ID NO: 110362 - DNA, 601 bp, Human; identical to SEQ ID NO: 110272

SEQ ID NO: 110363 - DNA, 601 bp, Human; identical to SEQ ID NO: 110273

SEQ ID NO: 110364 - DNA, 601 bp, Human; identical to SEQ ID NO: 110274

SEQ ID NO: 110365 - DNA, 601 bp, Human; identical to SEQ ID NO: 110275

SEQ ID NO: 110366 - DNA, 601 bp, Human; identical to SEQ ID NO: 110276

SEQ ID NO: 110367 - DNA, 601 bp, Human; identical to SEQ ID NO: 110277

SEQ ID NO: 110368 - DNA, 601 bp, Human; identical to SEQ ID NO: 110263

SEQ ID NO: 110369 - DNA, 601 bp, Human; identical to SEQ ID NO: 110264

SEQ ID NO: 110370 - DNA, 601 bp, Human; identical to SEQ ID NO: 110265

SEQ ID NO: 110371 - DNA, 601 bp, Human; identical to SEQ ID NO: 110266

SEQ ID NO: 110372 - DNA, 601 bp, Human; identical to SEQ ID NO: 110267

SEQ ID NO: 110373 - DNA, 601 bp, Human; identical to SEQ ID NO: 110268

SEQ ID NO: 110374 - DNA, 601 bp, Human; identical to SEQ ID NO: 110269

SEQ ID NO: 110375 - DNA, 601 bp, Human; identical to SEQ ID NO: 110270

SEQ ID NO: 110376 - DNA, 601 bp, Human; identical to SEQ ID NO: 110271

SEQ ID NO: 110377 - DNA, 601 bp, Human; identical to SEQ ID NO: 110272

SEQ ID NO: 110378 - DNA, 601 bp, Human; identical to SEQ ID NO: 110273

SEQ ID NO: 110379 - DNA, 601 bp, Human; identical to SEQ ID NO: 110274

SEQ ID NO: 110380 - DNA, 601 bp, Human; identical to SEQ ID NO: 110275

SEQ ID NO: 110381 - DNA, 601 bp, Human; identical to SEQ ID NO: 110276

SEQ ID NO: 110382 - DNA, 601 bp, Human; identical to SEQ ID NO: 110277

SEQ ID NO: 110383 - DNA, 601 bp, Human; identical to SEQ ID NO: 110263

SEQ ID NO: 110384 - DNA, 601 bp, Human; identical to SEQ ID NO: 110264

SEQ ID NO: 110385 - DNA, 601 bp, Human; identical to SEQ ID NO: 110265

SEQ ID NO: 110386 - DNA, 601 bp, Human; identical to SEQ ID NO: 110266

SEQ ID NO: 110387 - DNA, 601 bp, Human; identical to SEQ ID NO: 110267

SEQ ID NO: 110388 - DNA, 601 bp, Human; identical to SEQ ID NO: 110268

SEQ ID NO: 110389 - DNA, 601 bp, Human; identical to SEQ ID NO: 110269

SEQ ID NO: 110390 - DNA, 601 bp, Human; identical to SEQ ID NO: 110270

SEQ ID NO: 110391 - DNA, 601 bp, Human; identical to SEQ ID NO: 110271

SEQ ID NO: 110392 - DNA, 601 bp, Human; identical to SEQ ID NO: 110272

SEQ ID NO: 110393 - DNA, 601 bp, Human; identical to SEQ ID NO: 110273

SEQ ID NO: 110394 - DNA, 601 bp, Human; identical to SEQ ID NO: 110274

SEQ ID NO: 110395 - DNA, 601 bp, Human; identical to SEQ ID NO: 110275

SEQ ID NO: 110396 - DNA, 601 bp, Human; identical to SEQ ID NO: 110276

SEQ ID NO: 110397 - DNA, 601 bp, Human; identical to SEQ ID NO: 110277

SEQ ID NO: 110398 - DNA, 601 bp, Human; identical to SEQ ID NO: 110263

SEQ ID NO: 110399 - DNA, 601 bp, Human; identical to SEQ ID NO: 110264

SEQ ID NO: 110400 - DNA, 601 bp, Human; identical to SEQ ID NO: 110265

SEQ ID NO: 110401 - DNA, 601 bp, Human; identical to SEQ ID NO: 110266

SEQ ID NO: 110402 - DNA, 601 bp, Human; identical to SEQ ID NO: 110267

SEQ ID NO: 110403 - DNA, 601 bp, Human; identical to SEQ ID NO: 110268

SEQ ID NO: 110404 - DNA, 601 bp, Human; identical to SEQ ID NO: 110269

SEQ ID NO: 110405 - DNA, 601 bp, Human; identical to SEQ ID NO: 110270

SEQ ID NO: 110406 - DNA, 601 bp, Human; identical to SEQ ID NO: 110271

SEQ ID NO: 110407 - DNA, 601 bp, Human; identical to SEQ ID NO: 110272

SEQ ID NO: 110408 - DNA, 601 bp, Human; identical to SEQ ID NO: 110273

SEQ ID NO: 110409 - DNA, 601 bp, Human; identical to SEQ ID NO: 110274

SEQ ID NO: 110410 - DNA, 601 bp, Human; identical to SEQ ID NO: 110275

SEQ ID NO: 110411 - DNA, 601 bp, Human; identical to SEQ ID NO: 110276

SEQ ID NO: 110412 - DNA, 601 bp, Human; identical to SEQ ID NO: 110277

SEQ ID NO: 110413 - DNA, 601 bp, Human; identical to SEQ ID NO: 110263

SEQ ID NO: 110414 - DNA, 601 bp, Human; identical to SEQ ID NO: 110264

SEQ ID NO: 110415 - DNA, 601 bp, Human; identical to SEQ ID NO: 110265

SEQ ID NO: 110416 - DNA, 601 bp, Human; identical to SEQ ID NO: 110266

SEQ ID NO: 110417 - DNA, 601 bp, Human; identical to SEQ ID NO: 110267

SEQ ID NO: 110418 - DNA, 601 bp, Human; identical to SEQ ID NO: 110268

SEQ ID NO: 110419 - DNA, 601 bp, Human; identical to SEQ ID NO: 110269

SEQ ID NO: 110420 - DNA, 601 bp, Human; identical to SEQ ID NO: 110270

SEQ ID NO: 110421 - DNA, 601 bp, Human; identical to SEQ ID NO: 110271

SEQ ID NO: 110422 - DNA, 601 bp, Human; identical to SEQ ID NO: 110272

SEQ ID NO: 110423 - DNA, 601 bp, Human; identical to SEQ ID NO: 110273

SEQ ID NO: 110424 - DNA, 601 bp, Human; identical to SEQ ID NO: 110274

SEQ ID NO: 110425 - DNA, 601 bp, Human; identical to SEQ ID NO: 110275

SEQ ID NO: 110426 - DNA, 601 bp, Human; identical to SEQ ID NO: 110276

SEQ ID NO: 110427 - DNA, 601 bp, Human; identical to SEQ ID NO: 110277

SEQ ID NO: 110428 - DNA, 601 bp, Human; identical to SEQ ID NO: 110263

SEQ ID NO: 110429 - DNA, 601 bp, Human; identical to SEQ ID NO: 110264

SEQ ID NO: 110430 - DNA, 601 bp, Human; identical to SEQ ID NO: 110265

SEQ ID NO: 110431 - DNA, 601 bp, Human; identical to SEQ ID NO: 110266

SEQ ID NO: 110432 - DNA, 601 bp, Human; identical to SEQ ID NO: 110267

SEQ ID NO: 110433 - DNA, 601 bp, Human; identical to SEQ ID NO: 110268

SEQ ID NO: 110434 - DNA, 601 bp, Human; identical to SEQ ID NO: 110269

SEQ ID NO: 110435 - DNA, 601 bp, Human; identical to SEQ ID NO: 110270

SEQ ID NO: 110436 - DNA, 601 bp, Human; identical to SEQ ID NO: 110271

SEQ ID NO: 110437 - DNA, 601 bp, Human; identical to SEQ ID NO: 110272

SEQ ID NO: 110438 - DNA, 601 bp, Human; identical to SEQ ID NO: 110273

SEQ ID NO: 110439 - DNA, 601 bp, Human; identical to SEQ ID NO: 110274

SEQ ID NO: 110440 - DNA, 601 bp, Human; identical to SEQ ID NO: 110275

SEQ ID NO: 110441 - DNA, 601 bp, Human; identical to SEQ ID NO: 110276

SEQ ID NO: 110442 - DNA, 601 bp, Human; identical to SEQ ID NO: 110277

SEQ ID NO: 110443 - DNA, 601 bp, Human
tgtagtgtcactgaacggtgcagaagacagttccagacatgggtggggagggctgtcactaagcccttttgttttagagacagggtcttgctctgttgctcaggctggagtgcagtggcatgatcatagctcactgcagcctcgaccttctgggctcaggtgatcctccctcttcagcctcccaggtgggtaggaaaacaggcgcacactccatgcctggttagttttttcaagttttgaatgcttaggggtcttagtatgtggttgcctaggctggcctcagtgatcctcctgccttggyctcccaaagcactaagattgcaggcatgaccgccaaccccagctctaatcccttttaaattccattcgcttcctgagtccctttgtgcctggggagaccccgtgtattggtcctttttcacattgctgtaaacaactctgagactggtaatttataaagaaaagaggtttgattgcctcagttccgaagactgtacaggaagcatggctggggaggcctcaggaaacttagaatcatggcggagggaaagcaggcagtctgcaggtgtctggagaaggaggaagagagcgaaggggaggt

SEQ ID NO: 110444 - DNA, 601 bp, Human
aggaagcatggctggggaggcctcaggaaacttagaatcatggcggagggaaagcaggcagtctgcaggtgtctggagaaggaggaagagagcgaaggggaggtgctgtgcacttttaaatgaccagatcttaggagaactcactatcaccaaaacagcaagggggatatccgctcccatgatccaatcatctcccaccaggctcctccaacactggggattataattcgacatgagatttgggcaggaacacaaattcaaaccatagcacccagtgagcctgatttgggccttgctgccsgatcacgaccatctctggagtcctggtgtctgttcccactgggacctgtgccgctgtccccctctccacgccctggccacgccaagccaccctcctgactcacccacaggaagctgccctggccctggagcctgccccgtgagcccctctgcttgctggttcaatggccctccagcagcagtggctgtggcagctgggttctcggcatcttcagacacggattcttgagcagcaggatggggctccatctccctgcgtgcagagcctgccacagatctccctcatccactggcttctgtg

SEQ ID NO: 110445 - DNA, 601 bp, Human
gttgaggtgggacagttggggtcaaggtatttctcaggcacagtgcctatgaagggaagacagttgcagggactgtgtccatgtcaggatagactggtggggaccccgtgaagagttctggagcaaaccctgcctgcagggccccacctgggctggccaggcccttatgttgagcatcccttcccccaggccctcaggagccactgtccccgaggcaggccctgaaggtggcggccacaccctcctgctgggcagctctgcccaaaggccacagccaggacctgcttcccgcgtcccaggstactgcctgagaggaggcctcgaaagcgcagggttccgtgactttagaggccatggttggcacccatcatcgccccagtgtagattggctccactcgacctggctgctttggccatttggtctaccagctggaaccatgttcctgggtgtggaaaacgctccctccgaagcctgcggagagccctgaggccttgtgcttccttctgatgggaggttccagatgcagttggaggggatgtctggcagggctctaacccccagccaacctaaacatttctggtgcagaaggccccggcctgg

SEQ ID NO: 110446 - DNA, 601 bp, Human
tgaaggtggcggccacaccctcctgctgggcagctctgcccaaaggccacagccaggacctgcttcccgcgtcccaggctactgcctgagaggaggcctcgaaagcgcagggttccgtgactttagaggccatggttggcacccatcatcgccccagtgtagattggctccactcgacctggctgctttggccatttggtctaccagctggaaccatgttcctgggtgtggaaaacgctccctccgaagcctgcggagagccctgaggccttgtgcttccttctgatgggaggttccagaygcagttggaggggatgtctggcagggctctaacccccagccaacctaaacatttctggtgcagaaggccccggcctggtgttgtttgtccctggctgcctcctgctctgacaccatcagcatcctgttgccaaggtcatggatcagtgcggtgctcttcagggtgtccggccagctggggtctctgtcctgtattccggcagaggccccaggagaaacagcaaatgcctttgtccattccatacaaatttcatataaatgtgagcagcttctgatcttccgtggcgtattcgtccagttg

SEQ ID NO: 110447 - DNA, 601 bp, Human
ttccgtgactttagaggccatggttggcacccatcatcgccccagtgtagattggctccactcgacctggctgctttggccatttggtctaccagctggaaccatgttcctgggtgtggaaaacgctccctccgaagcctgcggagagccctgaggccttgtgcttccttctgatgggaggttccagatgcagttggaggggatgtctggcagggctctaacccccagccaacctaaacatttctggtgcagaaggccccggcctggtgttgtttgtccctggctgcctcctgctctgacrccatcagcatcctgttgccaaggtcatggatcagtgcggtgctcttcagggtgtccggccagctggggtctctgtcctgtattccggcagaggccccaggagaaacagcaaatgcctttgtccattccatacaaatttcatataaatgtgagcagcttctgatcttccgtggcgtattcgtccagttgatggccaaccctgggtacctggacctccaggacctgctgcactgggctgcccctcggctgtgtgtgcactcgccacgtggccctccaggaatcccatcccacggggccacac

SEQ ID NO: 110448 - DNA, 601 bp, Human
catgttcctgggtgtggaaaacgctccctccgaagcctgcggagagccctgaggccttgtgcttccttctgatgggaggttccagatgcagttggaggggatgtctggcagggctctaacccccagccaacctaaacatttctggtgcagaaggccccggcctggtgttgtttgtccctggctgcctcctgctctgacaccatcagcatcctgttgccaaggtcatggatcagtgcggtgctcttcagggtgtccggccagctggggtctctgtcctgtattccggcagaggccccaggaraaacagcaaatgcctttgtccattccatacaaatttcatataaatgtgagcagcttctgatcttccgtggcgtattcgtccagttgatggccaaccctgggtacctggacctccaggacctgctgcactgggctgcccctcggctgtgtgtgcactcgccacgtggccctccaggaatcccatcccacggggccacactgaaccaaatggagagagcagggccaccaccctctctccgcatgccacggctgctctgggacccgggcaggaggggacagtcttggccttccagtgtccctc

SEQ ID NO: 110449 - DNA, 601 bp, Human
tggtgcagaaggccccggcctggtgttgtttgtccctggctgcctcctgctctgacaccatcagcatcctgttgccaaggtcatggatcagtgcggtgctcttcagggtgtccggccagctggggtctctgtcctgtattccggcagaggccccaggagaaacagcaaatgcctttgtccattccatacaaatttcatataaatgtgagcagcttctgatcttccgtggcgtattcgtccagttgatggccaaccctgggtacctggacctccaggacctgctgcactgggctgcccctcrgctgtgtgtgcactcgccacgtggccctccaggaatcccatcccacggggccacactgaaccaaatggagagagcagggccaccaccctctctccgcatgccacggctgctctgggacccgggcaggaggggacagtcttggccttccagtgtccctcttggccttcccacggccatctctaccccaaggatgcagcagagatatcggtcgctccccaggtgtcaatcccagtcacaggctcagagaccgggacatggccccgggtgggtctgtaggccctgtgggctcatgtgagctgg

SEQ ID NO: 110450 - DNA, 601 bp, Human
gcctcctgctctgacaccatcagcatcctgttgccaaggtcatggatcagtgcggtgctcttcagggtgtccggccagctggggtctctgtcctgtattccggcagaggccccaggagaaacagcaaatgcctttgtccattccatacaaatttcatataaatgtgagcagcttctgatcttccgtggcgtattcgtccagttgatggccaaccctgggtacctggacctccaggacctgctgcactgggctgcccctcggctgtgtgtgcactcgccacgtggccctccaggaatcccaycccacggggccacactgaaccaaatggagagagcagggccaccaccctctctccgcatgccacggctgctctgggacccgggcaggaggggacagtcttggccttccagtgtccctcttggccttcccacggccatctctaccccaaggatgcagcagagatatcggtcgctccccaggtgtcaatcccagtcacaggctcagagaccgggacatggccccgggtgggtctgtaggccctgtgggctcatgtgagctggtcctgggcaggactccattattaactgcctgtgatgtgtcc

SEQ ID NO: 110451 - DNA, 601 bp, Human
tgtgagcagcttctgatcttccgtggcgtattcgtccagttgatggccaaccctgggtacctggacctccaggacctgctgcactgggctgcccctcggctgtgtgtgcactcgccacgtggccctccaggaatcccatcccacggggccacactgaaccaaatggagagagcagggccaccaccctctctccgcatgccacggctgctctgggacccgggcaggaggggacagtcttggccttccagtgtccctcttggccttcccacggccatctctaccccaaggatgcagcagagakatcggtcgctccccaggtgtcaatcccagtcacaggctcagagaccgggacatggccccgggtgggtctgtaggccctgtgggctcatgtgagctggtcctgggcaggactccattattaactgcctgtgatgtgtcccactgtcatggagccctggtgactcttggggaccagcatcagctcggggcctgtgtgctcagtggttcccagatgcctggatattctcttcctggtgcacatagtccccggggaggtccttgtcatgcacacttgctgatgtggggagtgtccttcatcttg

SEQ ID NO: 110452 - DNA, 601 bp, Human
ccctctctccgcatgccacggctgctctgggacccgggcaggaggggacagtcttggccttccagtgtccctcttggccttcccacggccatctctaccccaaggatgcagcagagatatcggtcgctccccaggtgtcaatcccagtcacaggctcagagaccgggacatggccccgggtgggtctgtaggccctgtgggctcatgtgagctggtcctgggcaggactccattattaactgcctgtgatgtgtcccactgtcatggagccctggtgactcttggggaccagcatcagctyggggcctgtgtgctcagtggttcccagatgcctggatattctcttcctggtgcacatagtccccggggaggtccttgtcatgcacacttgctgatgtggggagtgtccttcatcttgcaggcctggccacctcttcagtcagcagatacctgggctgaaaaccgactcgggcagtgtgggcccaactggggctctatcggagtgaccaccctcagccctcctggacccctctgccggctccacctgagcgctgccctcgctggcagccctgccttgctctgctgccattccgtaagccct

SEQ ID NO: 110453 - DNA, 601 bp, Human
ggtgactcttggggaccagcatcagctcggggcctgtgtgctcagtggttcccagatgcctggatattctcttcctggtgcacatagtccccggggaggtccttgtcatgcacacttgctgatgtggggagtgtccttcatcttgcaggcctggccacctcttcagtcagcagatacctgggctgaaaaccgactcgggcagtgtgggcccaactggggctctatcggagtgaccaccctcagccctcctggacccctctgccggctccacctgagcgctgccctcgctggcagccctgcsttgctctgctgccattccgtaagccctgcaggcaggccccttggcgcccttcagccgtgttcatgattgtctcctggcctctgctgtttagaggtctaatgccctccgcccccggcgagccaaacccagtgatggtggttcctgccaccagcttcctgtggcaccgctgccactcccgccaggctcctggggcaccgccaccactcccgccaggctcctggggcaccgccggccactcccgccaggctcctggggcaccgccgcccactccctccaggctcctggggcaccgccgccact

SEQ ID NO: 110454 - DNA, 601 bp, Human
catcagctcggggcctgtgtgctcagtggttcccagatgcctggatattctcttcctggtgcacatagtccccggggaggtccttgtcatgcacacttgctgatgtggggagtgtccttcatcttgcaggcctggccacctcttcagtcagcagatacctgggctgaaaaccgactcgggcagtgtgggcccaactggggctctatcggagtgaccaccctcagccctcctggacccctctgccggctccacctgagcgctgccctcgctggcagccctgccttgctctgctgccattccrtaagccctgcaggcaggccccttggcgcccttcagccgtgttcatgattgtctcctggcctctgctgtttagaggtctaatgccctccgcccccggcgagccaaacccagtgatggtggttcctgccaccagcttcctgtggcaccgctgccactcccgccaggctcctggggcaccgccaccactcccgccaggctcctggggcaccgccggccactcccgccaggctcctggggcaccgccgcccactccctccaggctcctggggcaccgccgccactcccgccaggctcctggggc

SEQ ID NO: 110455 - DNA, 601 bp, Human
atgcacacttgctgatgtggggagtgtccttcatcttgcaggcctggccacctcttcagtcagcagatacctgggctgaaaaccgactcgggcagtgtgggcccaactggggctctatcggagtgaccaccctcagccctcctggacccctctgccggctccacctgagcgctgccctcgctggcagccctgccttgctctgctgccattccgtaagccctgcaggcaggccccttggcgcccttcagccgtgttcatgattgtctcctggcctctgctgtttagaggtctaatgccctcygcccccggcgagccaaacccagtgatggtggttcctgccaccagcttcctgtggcaccgctgccactcccgccaggctcctggggcaccgccaccactcccgccaggctcctggggcaccgccggccactcccgccaggctcctggggcaccgccgcccactccctccaggctcctggggcaccgccgccactcccgccaggctcctggggcaccgccgccactcctgccagcctcctgcggcacagctgccactccctattaaccagcatggcacaggtgagcggtgtgaccttggtct

SEQ ID NO: 110456 - DNA, 601 bp, Human
ggctcctggggcaccgccgcccactccctccaggctcctggggcaccgccgccactcccgccaggctcctggggcaccgccgccactcctgccagcctcctgcggcacagctgccactccctattaaccagcatggcacaggtgagcggtgtgaccttggtcttcccagggaaccagtgcttggcagctcacaccacacacgcctacgcctaccctccaccagccacagcagttgtggcatctctaccctgcccagcaaaagtggaagtgttgcctgtgccgctaggaacctccaggtttrctccacctccaggggccttgccagggtgtcaaacctgtgtctcgggacactgctgttaggtctccagcttccctatcaggcgcctcagcacccagtcctaccagtgctcccgcctcccgtccccagctggctgggcctgcagccccctcctgtgccccgagctggccgggcccgcagcccactccctggtcactggatgttgctgacacttcactcggtcagagccctagcacccaaggggggccagggcctgacgggggtggagcgaggggtgggccgcgtctgtgcaggctcagaagc

SEQ ID NO: 110457 - DNA, 601 bp, Human
ggaacctccaggtttgctccacctccaggggccttgccagggtgtcaaacctgtgtctcgggacactgctgttaggtctccagcttccctatcaggcgcctcagcacccagtcctaccagtgctcccgcctcccgtccccagctggctgggcctgcagccccctcctgtgccccgagctggccgggcccgcagcccactccctggtcactggatgttgctgacacttcactcggtcagagccctagcacccaaggggggccagggcctgacgggggtggagcgaggggtgggccgcgtctstgcaggctcagaagcttcctaagaggctggagagtggaaccttcaggcaccacgcactgcctcctccctgcccacggtcctggtttctccagatggggccttggccttggctaggtgttgatcaggagctgggagtgctgcgccccgcccaacttctccaaactccagccagggcacctcagtgaggcctcagccacctgcgccttatttgcttcctccttggaggccctcgtgtctgttcattcatcaaacagcagctggggcccccagcagacccccttccccaactttcccactgga

SEQ ID NO: 110458 - DNA, 601 bp, Human
ttccctatcaggcgcctcagcacccagtcctaccagtgctcccgcctcccgtccccagctggctgggcctgcagccccctcctgtgccccgagctggccgggcccgcagcccactccctggtcactggatgttgctgacacttcactcggtcagagccctagcacccaaggggggccagggcctgacgggggtggagcgaggggtgggccgcgtctgtgcaggctcagaagcttcctaagaggctggagagtggaaccttcaggcaccacgcactgcctcctccctgcccacggtcctggkttctccagatggggccttggccttggctaggtgttgatcaggagctgggagtgctgcgccccgcccaacttctccaaactccagccagggcacctcagtgaggcctcagccacctgcgccttatttgcttcctccttggaggccctcgtgtctgttcattcatcaaacagcagctggggcccccagcagacccccttccccaactttcccactggacactggaaccagtttcacaactggactggacaggacgaccaccttgtgccaggcgccagctatctcccctgaccagtgatgggt

SEQ ID NO: 110459 - DNA, 601 bp, Human
acccagttccaaatcccaaattagtgactctcttctccaatgggggttggattctccagaagcagaggcagacatagaatttgggtgcaaggtatttcggagggaaggtggaagaggtggggttggtgagggagaagcctggagtgtcggtggccggggtgcccccacctggctgaaacgcctggtctttgtgccctgcctggctcagcctccccaggcagactaccccatggcatccctggacaaggctgcccccaagaacgctgcccacagcccagccatgggccttcccttggggctmccgccccggctcacacctgctggccagcgtatttactccttgctggctgcaccctctcagcagtggctgtgtagaccataaccctgggaacacctgcggggagaagcgcccttggcctggcggcttgggggagacacctggggtgtcaggagggaaggaaggcaagcaggggtgaggcactgtgggacttttcctgctttctgggccagtggccacaggccacccagtgacatttctctctcagcgtctgctggggtggactctgcagcggctgcagccagcctggatgggctcctcgca

SEQ ID NO: 110460 - DNA, 601 bp, Human
cccttggggctcccgccccggctcacacctgctggccagcgtatttactccttgctggctgcaccctctcagcagtggctgtgtagaccataaccctgggaacacctgcggggagaagcgcccttggcctggcggcttgggggagacacctggggtgtcaggagggaaggaaggcaagcaggggtgaggcactgtgggacttttcctgctttctgggccagtggccacaggccacccagtgacatttctctctcagcgtctgctggggtggactctgcagcggctgcagccagcctggatsggctcctcgcacagctctgcttgagggtgaaggccatctagaaaccctcagtcccctctcagcctcagagctgatagcgctgcctgaccatcagcaagcttgtaatcagcaccacctccagcatgcctgctcctggatctccgtgaggctcccctgcctgtgtcacccaggggcctctaggggtgctctggagctgggagccactgtccagcacttcctgccctctccggcctctcttggctgtctgccaagcagtcactcagtctcctattgaccactcgttttgccgcaaggctgctg

SEQ ID NO: 110461 - DNA, 601 bp, Human
aggggcctctaggggtgctctggagctgggagccactgtccagcacttcctgccctctccggcctctcttggctgtctgccaagcagtcactcagtctcctattgaccactcgttttgccgcaaggctgctggtttacgtgaaaatagagaaagccaaagagtttcctcacccctgtaagatttactggctcttctggcattgcacctgcctgagttccttggtggggcccctctttgagttcctttgggctgctgtaacaaagcaccatagcctgggcagctcgtaaacagtggaaatgygttgctctttgttctggaggctgcaagtccaagattgaggcactggaagacctggtgcctggtgaggacctgcttcctggtccagagacagcaccttctctctgtgtcctgatgtggtggaagggcaaaggaactccctggggcccgttttatgtgggcactcatcccattcgtgacgcctctgccttcatgacctcatcacctaccagaggtccccaccttttcattcctcaccttggggatgaggacttcagtatgtgaatttcggggacataaatgtgtcatctatagaagggccca

SEQ ID NO: 110462 - DNA, 601 bp, Human
catcacctaccagaggtccccaccttttcattcctcaccttggggatgaggacttcagtatgtgaatttcggggacataaatgtgtcatctatagaagggcccatctcttacacaaatgctgggtccccagtggcctgtgtcctagcaaatgagagccaccctgaaaaataaaatcctgtctccccaacgccagccctggcaaggcacccagaactctccggaatgcttgaaggcagggcctggcctttccatggggtccagggctgtggggtccctggcggtactgtgggcctgcagagyggggcatgtgggctgaagaccgtctccccaccatggtgggaagggacaaagggtggccctggcagatccggacgggcaggactgggtgtgtcccatgagagcacctccttcctggcctttcctgtggactttgtcccacaccacctgcctgggttccttcctttagtcacttccagctccaggcacagcagttggtgactccttggtgggagccgtgtcccacccggtcctgatactgccgtcttctctttcacagtcctccaggcttgggccagccttgggggcagcagagcttctggg

SEQ ID NO: 110463 - DNA, 601 bp, Human
cagacctggactttgggctcgtgctttcttcatggttgcgccttgctcgctgtcccttggagtcttcatttggttttgctttttttgtttgtttgttttcacctaatttttgccagacttaagctagttttgctgccttttgaaactagtggaagaatcattttattcctggggataatttggggccttttgatcccaacgtgaagccctgcacatggctgcttcatcaggggaagggtcttttctgctttggaggaaaggctttggcaggcaggctgacctgggagtctccggagctctyggctctctgtagcatcctggggagctcagaccatggctgcagggctctggccatagcttgcaggccatctggttagtgctgccccccaaacccggccattcctctctagtccccagcaggtatagccagtgtccacatagacagcactgcctcagatctgggctgggaccacaacactcactcagggatcccagggaacatggcaccaggtttagtaggtttagtcgggcatatgcagtgtcccttacccaggtcaaggctcaggctgggcccatcttagctgcctgggacacccagtcc

SEQ ID NO: 110464 - DNA, 601 bp, Human
ttaaagcagggcctaacatacatatgtttgaaatctttctctggctgaagtctcgaggatgaattggaagtagaggaccaactaaaaagttgttgcagacattaaggtggtgtcctgggttaggtgggaggtgatggagaggagaataggctagtgttgacatatacccaggaagcaaaaccattggggcatggtgcttaatgcttgattggattgatcacatagatgactatgaggaggactgacatatttcaatctatgaacgtggtatacccatccatttacttatttttaatttttwaaaaattttttttttttttgagacaggatctcactctgtttgtccaggctgaagtccagtggcaggatttcagctcactgcagcctcaacctcctgggctcaggtgattctcccaccttagcctcccgagtagctgggactacaagcacagatcaccacacctggctaattttttgcatttttgttttttagtagaaacagggtttcgctatgttgcccaggctagtctcaaacgcctggactccaacaatccacccaccttggcctcccggagtgctgggattataggctggggccact

SEQ ID NO: 110465 - DNA, 601 bp, Human
gcagggcctaacatacatatgtttgaaatctttctctggctgaagtctcgaggatgaattggaagtagaggaccaactaaaaagttgttgcagacattaaggtggtgtcctgggttaggtgggaggtgatggagaggagaataggctagtgttgacatatacccaggaagcaaaaccattggggcatggtgcttaatgcttgattggattgatcacatagatgactatgaggaggactgacatatttcaatctatgaacgtggtatacccatccatttacttatttttaatttttaaaaawttttttttttttttgagacaggatctcactctgtttgtccaggctgaagtccagtggcaggatttcagctcactgcagcctcaacctcctgggctcaggtgattctcccaccttagcctcccgagtagctgggactacaagcacagatcaccacacctggctaattttttgcatttttgttttttagtagaaacagggtttcgctatgttgcccaggctagtctcaaacgcctggactccaacaatccacccaccttggcctcccggagtgctgggattataggctggggccactgtgct

SEQ ID NO: 110466 - DNA, 601 bp, Human
aatgcatttattagttcatagtgttttttgcttcttttgttcttttctggtaaatgccttaggattttctttttctcccgactccccgccttcctcctcttctttttcttctgccttaggattttctttttcttctttctcctccttctcttcctcctcctcctcctcctcttctttcttctttcttcttcttcttctcttttttgtttttaaattgagacaggggctcactctgttgcccaggctggagtacagtgatgcaatcttaactcactgtagtctcaaactcctgggctcaagygatcctcccacctcagcttcccaagtagccaggactacaggtgtgcaccatcatgcctggctaatttttatatgttttgtagagattgggtcttgctatgttgctcgggctggtcttgaactcctatcttcaagcgatcttctcacttcagcctccccacatgttgggattacaggcctgagctactgtgccaagctgaattttctacatgcatgattatgtcacatgtgaccataggtaattttacttcttccttttctatctgcttttttcccttgccttatttcctctggctgggac

SEQ ID NO: 110467 - DNA, 601 bp, Human
catcacactaaccttatctcacaaagaccggaaagttgcatttttatcatcacttagttcaaagtattttcttatgtctccttgattacttctttgatccctgagttatttaaatgtgttgcttaattttcaaatatttgggcattctttgtgtgtcttataccttgttgctattgatttctaattaagctctgttgtagttagagaacatattctgtataacttaaatctttttaattttatggaggcttaatttatggcctagcagatggactattttggaaaatgttcaatgtgcacytgaaaagaatatatattctgctgttgttgggcatagtgttctataaacatcagtttggataagatgattggtgttgctcagggctatcatattcttactaatttttggtttacttgttctgtgagttactgagatgagggtgtcataataaccgatcacaatcatgaatttgtctgtttatcctttcagttctatcagcttccttcattttttggattctttgtaattaggtacatacacatttagaattgttagatattcttgatgaattgacccttttttcatatgaaatatcctttt

SEQ ID NO: 110468 - DNA, 601 bp, Human
aaccttatctcacaaagaccggaaagttgcatttttatcatcacttagttcaaagtattttcttatgtctccttgattacttctttgatccctgagttatttaaatgtgttgcttaattttcaaatatttgggcattctttgtgtgtcttataccttgttgctattgatttctaattaagctctgttgtagttagagaacatattctgtataacttaaatctttttaattttatggaggcttaatttatggcctagcagatggactattttggaaaatgttcaatgtgcacctgaaaagawtatatattctgctgttgttgggcatagtgttctataaacatcagtttggataagatgattggtgttgctcagggctatcatattcttactaatttttggtttacttgttctgtgagttactgagatgagggtgtcataataaccgatcacaatcatgaatttgtctgtttatcctttcagttctatcagcttccttcattttttggattctttgtaattaggtacatacacatttagaattgttagatattcttgatgaattgacccttttttcatatgaaatatccttttttttttttt

SEQ ID NO: 110469 - DNA, 601 bp, Human
tgtgcacctgaaaagaatatatattctgctgttgttgggcatagtgttctataaacatcagtttggataagatgattggtgttgctcagggctatcatattcttactaatttttggtttacttgttctgtgagttactgagatgagggtgtcataataaccgatcacaatcatgaatttgtctgtttatcctttcagttctatcagcttccttcattttttggattctttgtaattaggtacatacacatttagaattgttagatattcttgatgaattgacccttttttcatatgaaatrtcctttttttttttttgagatggagtctcgctctgtcaaccaggctagagtgcagtggcgcaatctcagctcactgcaacctccgcctcctgggttcaagtgattctcctgcctcagcctcctgagtagctgggattacaggtgcccaccactgcgcctggctaatttttgtatttttagtagagacggggtttcaccatcttggccaggctggtctcaagctcctgaccttgtggtctgcccacctcagcctcccaaagtgctgggattacaggcgtgagccaacacgctggtccgtga

SEQ ID NO: 110470 - DNA, 601 bp, Human
tttgtatttttagtagagacggggtttcaccatcttggccaggctggtctcaagctcctgaccttgtggtctgcccacctcagcctcccaaagtgctgggattacaggcgtgagccaacacgctggtccgtgaaatgtccctttttttattttgcaatattccctatactaaagtctactttgatgttaatatttttattcctgctttcttataattaatgcttgcattttataaatttttccattcttttacattgttttcattcttttacttttaacttttgtttatatttaaagtatrtatcatatcaggcagacagcatattgtcatttcttgctttcttttcccctaagacgaagagtctcctgtcactcagcctggaatacagtggtaccatcagggctcactgcagcctcaaactcctagattcaagcaatcctcccatctcagcctcccaagtagctaggactacaggcatgtggcaccacacgtggctaagtttttaacttttttttttctttttttgagacagtcttggtctgtcacccaggctggagtgcagtggcatgatctcggctcactgcaacctccacctccctg

SEQ ID NO: 110471 - DNA, 601 bp, Human
acagtcttggtctgtcacccaggctggagtgcagtggcatgatctcggctcactgcaacctccacctccctggttcaagtgattctcctgcctcagcctcccaagtagctgggactacaggcgcccgccaccacgcccggctaattttttttttttttagtagagatggggcttcactgtgttagccaggatggtcttgatctcctgacctcgtgatctgcctgtctcggccacccaaagtgctggggttacaggcatgagccactgcacccggcctgtctttttgtttttttgagatgargtctcactgtgtcacccaggctagtgtgcagtggcatgaactctgctcactacaacctccacttcccaggttcaagtgattctcatgcctcagcctcctgagtagctgggattacaggtgcgtgccactacgcccagctgtgtttttttgtttgtttgtttttgtttttgttttttttcggtagttttagtagagatggggatttccctatgttggttaggctggtctcgaactcctgaccccaaatgatccacccacctcggcctcacaaagttctggggttacaggcatgagacaccg

SEQ ID NO: 110472 - DNA, 601 bp, Human
agtctcactgtgtcacccaggctagtgtgcagtggcatgaactctgctcactacaacctccacttcccaggttcaagtgattctcatgcctcagcctcctgagtagctgggattacaggtgcgtgccactacgcccagctgtgtttttttgtttgtttgtttttgtttttgttttttttcggtagttttagtagagatggggatttccctatgttggttaggctggtctcgaactcctgaccccaaatgatccacccacctcggcctcacaaagttctggggttacaggcatgagacaccrtgcctggccaatagtctttgtcttttaactggattgtttacctcagtcacatttaatgtaatggttgatatggttgggtttgaacctaccatctgctatttgtttcctattcatctcctctgttctttgtactcattttccctcctctttttctgccttcttttggattagttgactattttgtatttcacttatctcttctagactattatacttccttgttttatcatttcattagctgcaatagggtttatgatatgcatatttaacttatttatgattgattggatgtaggaggaa

SEQ ID NO: 110473 - DNA, 601 bp, Human; identical to SEQ ID NO: 110263

SEQ ID NO: 110474 - DNA, 601 bp, Human; identical to SEQ ID NO: 110264

SEQ ID NO: 110475 - DNA, 601 bp, Human; identical to SEQ ID NO: 110265

SEQ ID NO: 110476 - DNA, 601 bp, Human; identical to SEQ ID NO: 110266

SEQ ID NO: 110477 - DNA, 601 bp, Human; identical to SEQ ID NO: 110267

SEQ ID NO: 110478 - DNA, 601 bp, Human; identical to SEQ ID NO: 110268

SEQ ID NO: 110479 - DNA, 601 bp, Human; identical to SEQ ID NO: 110269

SEQ ID NO: 110480 - DNA, 601 bp, Human; identical to SEQ ID NO: 110270

SEQ ID NO: 110481 - DNA, 601 bp, Human; identical to SEQ ID NO: 110271

SEQ ID NO: 110482 - DNA, 601 bp, Human; identical to SEQ ID NO: 110272

SEQ ID NO: 110483 - DNA, 601 bp, Human; identical to SEQ ID NO: 110273

SEQ ID NO: 110484 - DNA, 601 bp, Human; identical to SEQ ID NO: 110274

SEQ ID NO: 110485 - DNA, 601 bp, Human; identical to SEQ ID NO: 110275

SEQ ID NO: 110486 - DNA, 601 bp, Human; identical to SEQ ID NO: 110276

SEQ ID NO: 110487 - DNA, 601 bp, Human; identical to SEQ ID NO: 110277

SEQ ID NO: 110488 - DNA, 601 bp, Human; identical to SEQ ID NO: 110443

SEQ ID NO: 110489 - DNA, 601 bp, Human; identical to SEQ ID NO: 110444

SEQ ID NO: 110490 - DNA, 601 bp, Human; identical to SEQ ID NO: 110445

SEQ ID NO: 110491 - DNA, 601 bp, Human; identical to SEQ ID NO: 110446

SEQ ID NO: 110492 - DNA, 601 bp, Human; identical to SEQ ID NO: 110447

SEQ ID NO: 110493 - DNA, 601 bp, Human; identical to SEQ ID NO: 110448

SEQ ID NO: 110494 - DNA, 601 bp, Human; identical to SEQ ID NO: 110449

SEQ ID NO: 110495 - DNA, 601 bp, Human; identical to SEQ ID NO: 110450

SEQ ID NO: 110496 - DNA, 601 bp, Human; identical to SEQ ID NO: 110451

SEQ ID NO: 110497 - DNA, 601 bp, Human; identical to SEQ ID NO: 110452

SEQ ID NO: 110498 - DNA, 601 bp, Human; identical to SEQ ID NO: 110453

SEQ ID NO: 110499 - DNA, 601 bp, Human; identical to SEQ ID NO: 110454

SEQ ID NO: 110500 - DNA, 601 bp, Human; identical to SEQ ID NO: 110455

SEQ ID NO: 110501 - DNA, 601 bp, Human; identical to SEQ ID NO: 110456

SEQ ID NO: 110502 - DNA, 601 bp, Human; identical to SEQ ID NO: 110457

SEQ ID NO: 110503 - DNA, 601 bp, Human; identical to SEQ ID NO: 110458

SEQ ID NO: 110504 - DNA, 601 bp, Human; identical to SEQ ID NO: 110459

SEQ ID NO: 110505 - DNA, 601 bp, Human; identical to SEQ ID NO: 110460

SEQ ID NO: 110506 - DNA, 601 bp, Human; identical to SEQ ID NO: 110461

SEQ ID NO: 110507 - DNA, 601 bp, Human; identical to SEQ ID NO: 110462

SEQ ID NO: 110508 - DNA, 601 bp, Human; identical to SEQ ID NO: 110463

SEQ ID NO: 110509 - DNA, 601 bp, Human; identical to SEQ ID NO: 110464

SEQ ID NO: 110510 - DNA, 601 bp, Human; identical to SEQ ID NO: 110465

SEQ ID NO: 110511 - DNA, 601 bp, Human; identical to SEQ ID NO: 110466

SEQ ID NO: 110512 - DNA, 601 bp, Human; identical to SEQ ID NO: 110467

SEQ ID NO: 110513 - DNA, 601 bp, Human; identical to SEQ ID NO: 110468

SEQ ID NO: 110514 - DNA, 601 bp, Human; identical to SEQ ID NO: 110469

SEQ ID NO: 110515 - DNA, 601 bp, Human; identical to SEQ ID NO: 110470

SEQ ID NO: 110516 - DNA, 601 bp, Human; identical to SEQ ID NO: 110471

SEQ ID NO: 110517 - DNA, 601 bp, Human; identical to SEQ ID NO: 110472

SEQ ID NO: 110518 - DNA, 601 bp, Human; identical to SEQ ID NO: 110263

SEQ ID NO: 110519 - DNA, 601 bp, Human; identical to SEQ ID NO: 110264

SEQ ID NO: 110520 - DNA, 601 bp, Human; identical to SEQ ID NO: 110265

SEQ ID NO: 110521 - DNA, 601 bp, Human; identical to SEQ ID NO: 110266

SEQ ID NO: 110522 - DNA, 601 bp, Human; identical to SEQ ID NO: 110267

SEQ ID NO: 110523 - DNA, 601 bp, Human; identical to SEQ ID NO: 110268

SEQ ID NO: 110524 - DNA, 601 bp, Human; identical to SEQ ID NO: 110269

SEQ ID NO: 110525 - DNA, 601 bp, Human; identical to SEQ ID NO: 110270

SEQ ID NO: 110526 - DNA, 601 bp, Human; identical to SEQ ID NO: 110271

SEQ ID NO: 110527 - DNA, 601 bp, Human; identical to SEQ ID NO: 110272

SEQ ID NO: 110528 - DNA, 601 bp, Human; identical to SEQ ID NO: 110273

SEQ ID NO: 110529 - DNA, 601 bp, Human; identical to SEQ ID NO: 110274

SEQ ID NO: 110530 - DNA, 601 bp, Human; identical to SEQ ID NO: 110275

SEQ ID NO: 110531 - DNA, 601 bp, Human; identical to SEQ ID NO: 110276

SEQ ID NO: 110532 - DNA, 601 bp, Human; identical to SEQ ID NO: 110277

SEQ ID NO: 110533 - DNA, 601 bp, Human; identical to SEQ ID NO: 110443

SEQ ID NO: 110534 - DNA, 601 bp, Human; identical to SEQ ID NO: 110444

SEQ ID NO: 110535 - DNA, 601 bp, Human; identical to SEQ ID NO: 110445

SEQ ID NO: 110536 - DNA, 601 bp, Human; identical to SEQ ID NO: 110446

SEQ ID NO: 110537 - DNA, 601 bp, Human; identical to SEQ ID NO: 110447

SEQ ID NO: 110538 - DNA, 601 bp, Human; identical to SEQ ID NO: 110448

SEQ ID NO: 110539 - DNA, 601 bp, Human; identical to SEQ ID NO: 110449

SEQ ID NO: 110540 - DNA, 601 bp, Human; identical to SEQ ID NO: 110450

SEQ ID NO: 110541 - DNA, 601 bp, Human; identical to SEQ ID NO: 110451

SEQ ID NO: 110542 - DNA, 601 bp, Human; identical to SEQ ID NO: 110452

SEQ ID NO: 110543 - DNA, 601 bp, Human; identical to SEQ ID NO: 110453

SEQ ID NO: 110544 - DNA, 601 bp, Human; identical to SEQ ID NO: 110454

SEQ ID NO: 110545 - DNA, 601 bp, Human; identical to SEQ ID NO: 110455

SEQ ID NO: 110546 - DNA, 601 bp, Human; identical to SEQ ID NO: 110456

SEQ ID NO: 110547 - DNA, 601 bp, Human; identical to SEQ ID NO: 110457

SEQ ID NO: 110548 - DNA, 601 bp, Human; identical to SEQ ID NO: 110458

SEQ ID NO: 110549 - DNA, 601 bp, Human; identical to SEQ ID NO: 110459

SEQ ID NO: 110550 - DNA, 601 bp, Human; identical to SEQ ID NO: 110460

SEQ ID NO: 110551 - DNA, 601 bp, Human; identical to SEQ ID NO: 110461

SEQ ID NO: 110552 - DNA, 601 bp, Human; identical to SEQ ID NO: 110462

SEQ ID NO: 110553 - DNA, 601 bp, Human; identical to SEQ ID NO: 110463

SEQ ID NO: 110554 - DNA, 601 bp, Human; identical to SEQ ID NO: 110464

SEQ ID NO: 110555 - DNA, 601 bp, Human; identical to SEQ ID NO: 110465

SEQ ID NO: 110556 - DNA, 601 bp, Human; identical to SEQ ID NO: 110466

SEQ ID NO: 110557 - DNA, 601 bp, Human; identical to SEQ ID NO: 110467

SEQ ID NO: 110558 - DNA, 601 bp, Human; identical to SEQ ID NO: 110468

SEQ ID NO: 110559 - DNA, 601 bp, Human; identical to SEQ ID NO: 110469

SEQ ID NO: 110560 - DNA, 601 bp, Human; identical to SEQ ID NO: 110470

SEQ ID NO: 110561 - DNA, 601 bp, Human; identical to SEQ ID NO: 110471

SEQ ID NO: 110562 - DNA, 601 bp, Human; identical to SEQ ID NO: 110472

SEQ ID NO: 110563 - DNA, 601 bp, Human; identical to SEQ ID NO: 110263

SEQ ID NO: 110564 - DNA, 601 bp, Human; identical to SEQ ID NO: 110264

SEQ ID NO: 110565 - DNA, 601 bp, Human; identical to SEQ ID NO: 110265

SEQ ID NO: 110566 - DNA, 601 bp, Human; identical to SEQ ID NO: 110266

SEQ ID NO: 110567 - DNA, 601 bp, Human; identical to SEQ ID NO: 110267

SEQ ID NO: 110568 - DNA, 601 bp, Human; identical to SEQ ID NO: 110268

SEQ ID NO: 110569 - DNA, 601 bp, Human; identical to SEQ ID NO: 110269

SEQ ID NO: 110570 - DNA, 601 bp, Human; identical to SEQ ID NO: 110270

SEQ ID NO: 110571 - DNA, 601 bp, Human; identical to SEQ ID NO: 110271

SEQ ID NO: 110572 - DNA, 601 bp, Human; identical to SEQ ID NO: 110272

SEQ ID NO: 110573 - DNA, 601 bp, Human; identical to SEQ ID NO: 110273

SEQ ID NO: 110574 - DNA, 601 bp, Human; identical to SEQ ID NO: 110274

SEQ ID NO: 110575 - DNA, 601 bp, Human; identical to SEQ ID NO: 110275

SEQ ID NO: 110576 - DNA, 601 bp, Human; identical to SEQ ID NO: 110276

SEQ ID NO: 110577 - DNA, 601 bp, Human; identical to SEQ ID NO: 110277

SEQ ID NO: 110578 - DNA, 601 bp, Human; identical to SEQ ID NO: 110443

SEQ ID NO: 110579 - DNA, 601 bp, Human; identical to SEQ ID NO: 110444

SEQ ID NO: 110580 - DNA, 601 bp, Human; identical to SEQ ID NO: 110445

SEQ ID NO: 110581 - DNA, 601 bp, Human; identical to SEQ ID NO: 110446

SEQ ID NO: 110582 - DNA, 601 bp, Human; identical to SEQ ID NO: 110447

SEQ ID NO: 110583 - DNA, 601 bp, Human; identical to SEQ ID NO: 110448

SEQ ID NO: 110584 - DNA, 601 bp, Human; identical to SEQ ID NO: 110449

SEQ ID NO: 110585 - DNA, 601 bp, Human; identical to SEQ ID NO: 110450

SEQ ID NO: 110586 - DNA, 601 bp, Human; identical to SEQ ID NO: 110451

SEQ ID NO: 110587 - DNA, 601 bp, Human; identical to SEQ ID NO: 110452

SEQ ID NO: 110588 - DNA, 601 bp, Human; identical to SEQ ID NO: 110453

SEQ ID NO: 110589 - DNA, 601 bp, Human; identical to SEQ ID NO: 110454

SEQ ID NO: 110590 - DNA, 601 bp, Human; identical to SEQ ID NO: 110455

SEQ ID NO: 110591 - DNA, 601 bp, Human; identical to SEQ ID NO: 110456

SEQ ID NO: 110592 - DNA, 601 bp, Human; identical to SEQ ID NO: 110457

SEQ ID NO: 110593 - DNA, 601 bp, Human; identical to SEQ ID NO: 110458

SEQ ID NO: 110594 - DNA, 601 bp, Human; identical to SEQ ID NO: 110459

SEQ ID NO: 110595 - DNA, 601 bp, Human; identical to SEQ ID NO: 110460

SEQ ID NO: 110596 - DNA, 601 bp, Human; identical to SEQ ID NO: 110461

SEQ ID NO: 110597 - DNA, 601 bp, Human; identical to SEQ ID NO: 110462

SEQ ID NO: 110598 - DNA, 601 bp, Human; identical to SEQ ID NO: 110463

SEQ ID NO: 110599 - DNA, 601 bp, Human; identical to SEQ ID NO: 110464

SEQ ID NO: 110600 - DNA, 601 bp, Human; identical to SEQ ID NO: 110465

SEQ ID NO: 110601 - DNA, 601 bp, Human; identical to SEQ ID NO: 110466

SEQ ID NO: 110602 - DNA, 601 bp, Human; identical to SEQ ID NO: 110467

SEQ ID NO: 110603 - DNA, 601 bp, Human; identical to SEQ ID NO: 110468

SEQ ID NO: 110604 - DNA, 601 bp, Human; identical to SEQ ID NO: 110469

SEQ ID NO: 110605 - DNA, 601 bp, Human; identical to SEQ ID NO: 110470

SEQ ID NO: 110606 - DNA, 601 bp, Human; identical to SEQ ID NO: 110471

SEQ ID NO: 110607 - DNA, 601 bp, Human; identical to SEQ ID NO: 110472

SEQ ID NO: 110608 - DNA, 601 bp, Human; identical to SEQ ID NO: 110263

SEQ ID NO: 110609 - DNA, 601 bp, Human; identical to SEQ ID NO: 110264

SEQ ID NO: 110610 - DNA, 601 bp, Human; identical to SEQ ID NO: 110265

SEQ ID NO: 110611 - DNA, 601 bp, Human; identical to SEQ ID NO: 110266

SEQ ID NO: 110612 - DNA, 601 bp, Human; identical to SEQ ID NO: 110267

SEQ ID NO: 110613 - DNA, 601 bp, Human; identical to SEQ ID NO: 110268

SEQ ID NO: 110614 - DNA, 601 bp, Human; identical to SEQ ID NO: 110269

SEQ ID NO: 110615 - DNA, 601 bp, Human; identical to SEQ ID NO: 110270

SEQ ID NO: 110616 - DNA, 601 bp, Human; identical to SEQ ID NO: 110271

SEQ ID NO: 110617 - DNA, 601 bp, Human; identical to SEQ ID NO: 110272

SEQ ID NO: 110618 - DNA, 601 bp, Human; identical to SEQ ID NO: 110273

SEQ ID NO: 110619 - DNA, 601 bp, Human; identical to SEQ ID NO: 110274

SEQ ID NO: 110620 - DNA, 601 bp, Human; identical to SEQ ID NO: 110275

SEQ ID NO: 110621 - DNA, 601 bp, Human; identical to SEQ ID NO: 110276

SEQ ID NO: 110622 - DNA, 601 bp, Human; identical to SEQ ID NO: 110277

SEQ ID NO: 110623 - DNA, 601 bp, Human; identical to SEQ ID NO: 110443

SEQ ID NO: 110624 - DNA, 601 bp, Human; identical to SEQ ID NO: 110444

SEQ ID NO: 110625 - DNA, 601 bp, Human; identical to SEQ ID NO: 110445

SEQ ID NO: 110626 - DNA, 601 bp, Human; identical to SEQ ID NO: 110446

SEQ ID NO: 110627 - DNA, 601 bp, Human; identical to SEQ ID NO: 110447

SEQ ID NO: 110628 - DNA, 601 bp, Human; identical to SEQ ID NO: 110448

SEQ ID NO: 110629 - DNA, 601 bp, Human; identical to SEQ ID NO: 110449

SEQ ID NO: 110630 - DNA, 601 bp, Human; identical to SEQ ID NO: 110450

SEQ ID NO: 110631 - DNA, 601 bp, Human; identical to SEQ ID NO: 110451

SEQ ID NO: 110632 - DNA, 601 bp, Human; identical to SEQ ID NO: 110452

SEQ ID NO: 110633 - DNA, 601 bp, Human; identical to SEQ ID NO: 110453

SEQ ID NO: 110634 - DNA, 601 bp, Human; identical to SEQ ID NO: 110454

SEQ ID NO: 110635 - DNA, 601 bp, Human; identical to SEQ ID NO: 110455

SEQ ID NO: 110636 - DNA, 601 bp, Human; identical to SEQ ID NO: 110456

SEQ ID NO: 110637 - DNA, 601 bp, Human; identical to SEQ ID NO: 110457

SEQ ID NO: 110638 - DNA, 601 bp, Human; identical to SEQ ID NO: 110458

SEQ ID NO: 110639 - DNA, 601 bp, Human; identical to SEQ ID NO: 110459

SEQ ID NO: 110640 - DNA, 601 bp, Human; identical to SEQ ID NO: 110460

SEQ ID NO: 110641 - DNA, 601 bp, Human; identical to SEQ ID NO: 110461

SEQ ID NO: 110642 - DNA, 601 bp, Human; identical to SEQ ID NO: 110462

SEQ ID NO: 110643 - DNA, 601 bp, Human; identical to SEQ ID NO: 110463

SEQ ID NO: 110644 - DNA, 601 bp, Human; identical to SEQ ID NO: 110464

SEQ ID NO: 110645 - DNA, 601 bp, Human; identical to SEQ ID NO: 110465

SEQ ID NO: 110646 - DNA, 601 bp, Human; identical to SEQ ID NO: 110466

SEQ ID NO: 110647 - DNA, 601 bp, Human; identical to SEQ ID NO: 110467

SEQ ID NO: 110648 - DNA, 601 bp, Human; identical to SEQ ID NO: 110468

SEQ ID NO: 110649 - DNA, 601 bp, Human; identical to SEQ ID NO: 110469

SEQ ID NO: 110650 - DNA, 601 bp, Human; identical to SEQ ID NO: 110470

SEQ ID NO: 110651 - DNA, 601 bp, Human; identical to SEQ ID NO: 110471

SEQ ID NO: 110652 - DNA, 601 bp, Human; identical to SEQ ID NO: 110472

SEQ ID NO: 110653 - DNA, 601 bp, Human; identical to SEQ ID NO: 110263

SEQ ID NO: 110654 - DNA, 601 bp, Human; identical to SEQ ID NO: 110264

SEQ ID NO: 110655 - DNA, 601 bp, Human; identical to SEQ ID NO: 110265

SEQ ID NO: 110656 - DNA, 601 bp, Human; identical to SEQ ID NO: 110266

SEQ ID NO: 110657 - DNA, 601 bp, Human; identical to SEQ ID NO: 110267

SEQ ID NO: 110658 - DNA, 601 bp, Human; identical to SEQ ID NO: 110268

SEQ ID NO: 110659 - DNA, 601 bp, Human; identical to SEQ ID NO: 110269

SEQ ID NO: 110660 - DNA, 601 bp, Human; identical to SEQ ID NO: 110270

SEQ ID NO: 110661 - DNA, 601 bp, Human; identical to SEQ ID NO: 110271

SEQ ID NO: 110662 - DNA, 601 bp, Human; identical to SEQ ID NO: 110272

SEQ ID NO: 110663 - DNA, 601 bp, Human; identical to SEQ ID NO: 110273

SEQ ID NO: 110664 - DNA, 601 bp, Human; identical to SEQ ID NO: 110274

SEQ ID NO: 110665 - DNA, 601 bp, Human; identical to SEQ ID NO: 110275

SEQ ID NO: 110666 - DNA, 601 bp, Human; identical to SEQ ID NO: 110276

SEQ ID NO: 110667 - DNA, 601 bp, Human; identical to SEQ ID NO: 110277

SEQ ID NO: 110668 - DNA, 601 bp, Human; identical to SEQ ID NO: 110443

SEQ ID NO: 110669 - DNA, 601 bp, Human; identical to SEQ ID NO: 110444

SEQ ID NO: 110670 - DNA, 601 bp, Human; identical to SEQ ID NO: 110445

SEQ ID NO: 110671 - DNA, 601 bp, Human; identical to SEQ ID NO: 110446

SEQ ID NO: 110672 - DNA, 601 bp, Human; identical to SEQ ID NO: 110447

SEQ ID NO: 110673 - DNA, 601 bp, Human; identical to SEQ ID NO: 110448

SEQ ID NO: 110674 - DNA, 601 bp, Human; identical to SEQ ID NO: 110449

SEQ ID NO: 110675 - DNA, 601 bp, Human; identical to SEQ ID NO: 110450

SEQ ID NO: 110676 - DNA, 601 bp, Human; identical to SEQ ID NO: 110451

SEQ ID NO: 110677 - DNA, 601 bp, Human; identical to SEQ ID NO: 110452

SEQ ID NO: 110678 - DNA, 601 bp, Human; identical to SEQ ID NO: 110453

SEQ ID NO: 110679 - DNA, 601 bp, Human; identical to SEQ ID NO: 110454

SEQ ID NO: 110680 - DNA, 601 bp, Human; identical to SEQ ID NO: 110455

SEQ ID NO: 110681 - DNA, 601 bp, Human; identical to SEQ ID NO: 110456

SEQ ID NO: 110682 - DNA, 601 bp, Human; identical to SEQ ID NO: 110457

SEQ ID NO: 110683 - DNA, 601 bp, Human; identical to SEQ ID NO: 110458

SEQ ID NO: 110684 - DNA, 601 bp, Human; identical to SEQ ID NO: 110459

SEQ ID NO: 110685 - DNA, 601 bp, Human; identical to SEQ ID NO: 110460

SEQ ID NO: 110686 - DNA, 601 bp, Human; identical to SEQ ID NO: 110461

SEQ ID NO: 110687 - DNA, 601 bp, Human; identical to SEQ ID NO: 110462

SEQ ID NO: 110688 - DNA, 601 bp, Human; identical to SEQ ID NO: 110463

SEQ ID NO: 110689 - DNA, 601 bp, Human; identical to SEQ ID NO: 110464

SEQ ID NO: 110690 - DNA, 601 bp, Human; identical to SEQ ID NO: 110465

SEQ ID NO: 110691 - DNA, 601 bp, Human; identical to SEQ ID NO: 110466

SEQ ID NO: 110692 - DNA, 601 bp, Human; identical to SEQ ID NO: 110467

SEQ ID NO: 110693 - DNA, 601 bp, Human; identical to SEQ ID NO: 110468

SEQ ID NO: 110694 - DNA, 601 bp, Human; identical to SEQ ID NO: 110469

SEQ ID NO: 110695 - DNA, 601 bp, Human; identical to SEQ ID NO: 110470

SEQ ID NO: 110696 - DNA, 601 bp, Human; identical to SEQ ID NO: 110471

SEQ ID NO: 110697 - DNA, 601 bp, Human; identical to SEQ ID NO: 110472

SEQ ID NO: 110698 - DNA, 601 bp, Human
gaaagattctagaacctaagtcctttctaggctaggcaattctaggctacacaattcgtagtctctgtaaataccatttgataactgaaataaacctataaagtgggattaaatgttagtccagaagactaagtgatttaaggaaagagggaaaataaccagatagatttctggtggatattcatagacagacataatttcatcatgtattatggccctaagtcatctattttatattaaaacatagatggtaactgtaaagttatcaaatgtaaaaattactgggctagcattgtgtttyaacactgatacaccagttgattacagtgttgacagaaaacgggcagaaacacgtttaaagtacctgcagaatatatatatagaaatcttttttttttaatcagtgttgaccaggttggcctcgaacgtgtagcctcacctccccgagtgccagggcaaccggcctgagccacagcggctccctagaaatcttaagtgcaggaaacaaaactacagtttaaggaaacaggagtcggagaggaggggcatttggcccaaccactggcaaaaggctgttgttgcaacaactgtgagattctgg

SEQ ID NO: 110699 - DNA, 601 bp, Human
cctcgaacgtgtagcctcacctccccgagtgccagggcaaccggcctgagccacagcggctccctagaaatcttaagtgcaggaaacaaaactacagtttaaggaaacaggagtcggagaggaggggcatttggcccaaccactggcaaaaggctgttgttgcaacaactgtgagattctgggaagtggggaaatgagcaggtgctgtgtaaaagtgcacagctgactgccccaggtgagacagatcagtgtcacagagagtaggaggattttgaggtgtgattagtatttttttttttttcttaaagagatggtctcgttctggaacccaggctggagtgcagtcgtggcacgatcataattcactgtagccttgagctcctgggctcaagtgaacctcctgagcagctgggactacagatgcatgccaccgtgcccagctaattattaaattgtatagacaggatctctatatggtacccaagttggtctcaaactcctggcctcaagcagtcctcctgcctcagcctattaaagtgctgggattacaggagtgagctaccacacccaaccagtaggaaatcttaaagccacattgata

SEQ ID NO: 110700 - DNA, 601 bp, Human
gctttcttgcactgaaatagaaactgtagtccccatgtgggtttgggtccctgaattatccccagaagaacttccacagtccggaactgactcccttaaagaaaccaaaaatgtattttctttggtggggattttctttagttggtctttgtctgggattttatatcagtgacagactgtagcgtcacacttttccagaaatacggtttcggagagggtacccctaacgttttatgtgtgtgtgtgttacatttagcaagtttatataacatattttacttttttttttttttttttttttgagacagtttcgctcttgttgcccaggctggagtacaatggagcaatctcggctctctgcaacctctgcctcccgggttcaagcaattctcctgcctcagcctcccaagtagctgggattacaggcatgcaccaccatgccatgcccggctaattttgtatttttagtagagatggggtttctccatgttggtcaggctggtcttgaacacccgacctcaggttatccacctgcctcggcctcccaaagtactgggattacaggcgtgagccactgcgcttggttagaacttatttaact

SEQ ID NO: 110701 - DNA, 601 bp, Human
tgtctgggattttatatcagtgacagactgtagcgtcacacttttccagaaatacggtttcggagagggtacccctaacgttttatgtgtgtgtgtgttacatttagcaagtttatataacatattttacttttttttttttttttttttttgagacagtttcgctcttgttgcccaggctggagtacaatggagcaatctcggctctctgcaacctctgcctcccgggttcaagcaattctcctgcctcagcctcccaagtagctgggattacaggcatgcaccaccatgccatgcccgsctaattttgtatttttagtagagatggggtttctccatgttggtcaggctggtcttgaacacccgacctcaggttatccacctgcctcggcctcccaaagtactgggattacaggcgtgagccactgcgcttggttagaacttatttaactttttaggcacttggtaaacggtagctgttagtccatgtgtacttttttttttggtgggggggggagtcatgctctgtcacccaggctggagtgcagtggcaggatcttggttcactgcaagctccgcctcctgggttcacgccattctc

SEQ ID NO: 110702 - DNA, 601 bp, Human
catatcaaaagcaagctggttgatagcatgtaggtgtgggtagctataaaggatgagcccatagcatgtgtggagctgtgaaggatggcagcatattcgagtgaggtagcattacccctaacttaggcagctatggcctggcagctcgggggtggcatttttgtttgctcagtgttacttttgatgttggatgtttcccagattgagaactttaaattttcctaaatagtccctgtactgtttttggcagtggatctatttttactcacacacatagttttttgccttgtgagtagtgggtggaggcccttaggggtttttgggtaaatgaatagtgtcataggaagataagtgaatgatcagcaggccaggtcatttttgacatttagtaatgttgggggtagtcctggagcagagaaaatgtgtgaagtgagtgccctggggtggggactaggtgtagcccaaggctgtttggtcaggacgtgagtaaaactggctgacagggaagtccaatccttaaaagaaatggagaggagggcctttgtgcatgggaagagcccatcagtttaaggttgtccttcaggaagggtgtaagtaggat

SEQ ID NO: 110703 - DNA, 601 bp, Human
ctagaaagcagagaggctgtgagcaggggtggcgaaacccctggtttgtggcccggtgaagactcagtgcctagtgtggctacactgagggaaggtgccgtgtggcagaaatgactgttgtaatcttggtgttagagcggaaagaggctgaaaactattgtctaggcctgtctgtaaaattctgtcttgttgttgcttcatgttcctgatttgtggagatgcagcaaatgtgatttcattagattttgcagatgatcttaggtagcatggtcggggcctggagagcatccattactctgtrttgccacccggtgtttgcctctcagtacagtttatgactgaacttttcattagttctcctggctcctgtatttcggtatttgaagtgttgggaactggtgctaagtatcatccatcaagattggctatccatctttttgttttaatggactgtctgattttacatgggtctataattttccagtctgggaaaaactcagttttctttagttatctggtcaagtagtaagccatcttcatttcatgtttccttttgttaactgaattataacccaggagtattaaaaaatactgtatttaa

SEQ ID NO: 110704 - DNA, 601 bp, Human
tgtggctacactgagggaaggtgccgtgtggcagaaatgactgttgtaatcttggtgttagagcggaaagaggctgaaaactattgtctaggcctgtctgtaaaattctgtcttgttgttgcttcatgttcctgatttgtggagatgcagcaaatgtgatttcattagattttgcagatgatcttaggtagcatggtcggggcctggagagcatccattactctgtattgccacccggtgtttgcctctcagtacagtttatgactgaacttttcattagttctcctggctcctgtatttyggtatttgaagtgttgggaactggtgctaagtatcatccatcaagattggctatccatctttttgttttaatggactgtctgattttacatgggtctataattttccagtctgggaaaaactcagttttctttagttatctggtcaagtagtaagccatcttcatttcatgtttccttttgttaactgaattataacccaggagtattaaaaaatactgtatttaaatgtatccagttatttcctagttaggctctggctggggtattaggaacaatatttgcttgctgagatatgttag

SEQ ID NO: 110705 - DNA, 601 bp, Human
ggcctggagagcatccattactctgtattgccacccggtgtttgcctctcagtacagtttatgactgaacttttcattagttctcctggctcctgtatttcggtatttgaagtgttgggaactggtgctaagtatcatccatcaagattggctatccatctttttgttttaatggactgtctgattttacatgggtctataattttccagtctgggaaaaactcagttttctttagttatctggtcaagtagtaagccatcttcatttcatgtttccttttgttaactgaattataacccrggagtattaaaaaatactgtatttaaatgtatccagttatttcctagttaggctctggctggggtattaggaacaatatttgcttgctgagatatgttagtcaccctcagctaatgctgatagtgattcattcagactggcaggcaaccagatgatttttacataaacactaatactcccagtaaatgatttttcttgtgaaggtgtcatcataaatactgcccagtagccttttttggcagcttattcctgatggagaaagaatatgcttacagatacacccaaacttcacgttagtag

SEQ ID NO: 110706 - DNA, 601 bp, Human
ctgatggagaaagaatatgcttacagatacacccaaacttcacgttagtaggaagccctgccacaccttttattggtgcacaggaaaaacgaaatcatggaacattggagctgaaggaggccttggagatcatttgggctaatcctgcttattttactttggatgtccaaaaaggttgtgatttgtttaaggtcacatagctagctcagactaaacttcagatgtcttgggtttaataattataccgccttttgtgttatgcaagcattctgtattatacatacatgtatttcagatttgyactcactttaaatgatatactctgggaagttaccttggtgtatctttgccagtttcacagaagcagctttgttagtcacaggaggaagtatattgtgactccttatggatattatttgtattttaatgccaaatggccttagtttaattactacaagatgaaaggagctctccaaattctgttgttgccttatgctttgttttattgaatattgctctagaaacgcaagtcattctagaggattcaagcattctgaaatttatcagaatatttgggatggaattttgattcagaagtgtt

SEQ ID NO: 110707 - DNA, 601 bp, Human
tccagtatgacttcatcttaactaattacatctgcaaagaccctatttccaaataagctcacattcacaggaacctagggtcagaacttcagcgtatcttttggcgggggatacagttcaaccactgcaaagtctaataatgctcttcctactaactgcatagctagttcacttgtagttggcatcatggagaactaagggaagttaaagcttgtgaaatttaactcttccacttaaaataattgatgcttccatccttgatgaccagagtttcctgtgaggtaggtcagagtacaacttsctgctgagtagctgtgcttcctttcactaggagctgggggtactttcatgtcacttatgaattgttcttcattttggtttgggagagggctgggagtatcagttagggttccatgtgtagccacacagggcgaagctctggccactggatctgtgtgatgttccatctgatctgtgaagccccaccatctgttaatgtgtatttgaggagtggttggttctttccagagtataaagctggaagcagagtctggaacacttccagtctgttgtctttgaacatttgacaaagggaccgtac

SEQ ID NO: 110708 - DNA, 601 bp, Human
gtactttcatgtcacttatgaattgttcttcattttggtttgggagagggctgggagtatcagttagggttccatgtgtagccacacagggcgaagctctggccactggatctgtgtgatgttccatctgatctgtgaagccccaccatctgttaatgtgtatttgaggagtggttggttctttccagagtataaagctggaagcagagtctggaacacttccagtctgttgtctttgaacatttgacaaagggaccgtacgatcttactgttcagagtatctttttttttttttttttttcttttgagacggaggcttgctctgtcgctagctaggctggagtgcagtggcacgatctgggctcactgcaacctccgggttcaagagtttctcttgcctcagcctcccaagtagctgggactacaagcgcgtgccaccacgcccagctaatttttgtatttttagtagagatggggtttcaccatgttggccagaatggtctcgatctcttgacctcatgatctgcccgcccttggcctcctgaagtgctgggattacaggcataagccatcgcgcccggcctgttcagagtatcttttg

SEQ ID NO: 110709 - DNA, 601 bp, Human
tacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatattatctctgtttggtcttgatttttcccccctcgaggaactgtttaaccagtcacaaattgtggtttgaatctctcaaacatggaagcatttgtagtacattatccaagttttcctcc

SEQ ID NO: 110710 - DNA, 601 bp, Human
aatgacattttaaatctttgttttcaaagaggtcaaagtttaactggaagaaattgagttttcctaataacatggtggcttatctaaagagagaagaaaaaggggagaggggacaatgacaggatttaaattgccctctctgaaactttttcttaagaataaagacttgcttcttgggccgggaaatcaacaggtttgtagctgaaaaatcaataaccatttgatgccaacagcctggctgtctgacttaacattttgtagagccataagcagggcaaaaagaatatcgttttcagaaggygccttaatcttcagctgctccccaaatgccttttcttttttggtgcccattttatttctggagaactcaaagaaactggagtgttacaaaataattttctaatccaagaagagacttttcagacctgtcctctttgtagcaattaaaacagtatgaacaatttctgttggaatcccagggaactggggctctctgaaactttttcttgttagagaaagtggtaatgaaacatgttttttaacagaaggaaaaaatatgctcaggatcctcgccaaaagttattagacctaatagagtttt

SEQ ID NO: 110711 - DNA, 601 bp, Human
tcttttttggtgcccattttatttctggagaactcaaagaaactggagtgttacaaaataattttctaatccaagaagagacttttcagacctgtcctctttgtagcaattaaaacagtatgaacaatttctgttggaatcccagggaactggggctctctgaaactttttcttgttagagaaagtggtaatgaaacatgttttttaacagaaggaaaaaatatgctcaggatcctcgccaaaagttattagacctaatagagtttttacatgtagacattcttccttttgtaattaaccytccaaagatgcctattaagttgtaagagtagggggaaaagctttgtttgttcttggacaagttaaacaagggatttgctttatctagggagagcgagcggtgaatgtgtcattcgcctaaaactacccgataagcaagaagtgttgataacagcaaagtttagctaatcaaagaaacttgcattagacaaagtaaataaaggcatttgacaaagggatttcagaaattccagtgtcttatttttgtaagcagggcaattagttcttattgtggtcagtttcacaagagtttgaatcccac

SEQ ID NO: 110712 - DNA, 601 bp, Human
cctattaagttgtaagagtagggggaaaagctttgtttgttcttggacaagttaaacaagggatttgctttatctagggagagcgagcggtgaatgtgtcattcgcctaaaactacccgataagcaagaagtgttgataacagcaaagtttagctaatcaaagaaacttgcattagacaaagtaaataaaggcatttgacaaagggatttcagaaattccagtgtcttatttttgtaagcagggcaattagttcttattgtggtcagtttcacaagagtttgaatcccacaccccaacttkaggttaaatgaataaaatgtaaatattgcttgtgcccttgcagagttgctttaccctcataaaccactttatgatggtcagttgttccaacgatttttttttttttttagcataaataaaactaaaacttttttttttttttttttttagagattctaacaaatgtcttgtgccatgcagtgtttggttcagggtggtacagctagttagggctattgaaataaaagtatattagggctacatttgtgtaagtaagaacataaccacaaccttttccattttacttaatggctattttga

SEQ ID NO: 110713 - DNA, 601 bp, Human
tttagctaatcaaagaaacttgcattagacaaagtaaataaaggcatttgacaaagggatttcagaaattccagtgtcttatttttgtaagcagggcaattagttcttattgtggtcagtttcacaagagtttgaatcccacaccccaactttaggttaaatgaataaaatgtaaatattgcttgtgcccttgcagagttgctttaccctcataaaccactttatgatggtcagttgttccaacgatttttttttttttttagcataaataaaactaaaacttttttttttttttttttttagagattctaacaaatgtcttgtgccatgcagtgtttggttcagggtggtacagctagttagggctattgaaataaaagtatattagggctacatttgtgtaagtaagaacataaccacaaccttttccattttacttaatggctattttgacgagaagcagatctgtttttgcttttaacacagaggaaacagtgggcaaagaagaaaaagtactaaattccaaccaaaactattttctgctttgagttttttttatggtgtgtgtgtgtatgcatagtaaataaagtaagacctttga

SEQ ID NO: 110714 - DNA, 601 bp, Human
atagtcaatataagtagagctctcacagcttaattttttcattatgtctgaagatcgccttgtgtttctgggtcattcttatgaacatgaattcctttcgtagcaaactatagatctgtgaatagaaggcattccttgcaaaatggactgggctgtgattctcactctagcacctgtgtgtgcgtggacagggtggggaggagggagtagaattaaattaaattgttatgaacaaatctgtatcagcccttgccagcttcctcttaaaaagttggagctggggtgatggagggagaagagyagagttaactcaggtttcagatttatcagtatcctgcttgtaagtggcttggtctaagtacctcttgttaaataggagatgagataacctgccccatctgtaagatctaataacacaacctcatcagtcaatatgttgctctgaattctcctcttttcattcccagcttccttaccccatcattaaaaagcatgatctctgtcccatcccactccccaaacccctttaaatgaatgaaaaataaagttgcaaaagttctctctacctaggaagcaggagagcctaagtctactggcattt

SEQ ID NO: 110715 - DNA, 601 bp, Human
agactctctgccccctgcgcgataaggcgaggataacaggaactgacgtcagcaaggcgactcaacctggccaagcatttcctctagtcagggctcagggattccaggagtctctaggcttcccccagcagctgaagaactgaaccagctcaggggagggagaaagaagaaagctgatttttacaggggtgatagtgggtgatgatgtccctgatttccaaaagcagatttctttgaagagaacaaagaaaaactgggaggaagaaagtcgtttaataaaagtggattctgagattataaytgtcattttacattgtcatagaatagatatttgtgttccagctgtcaacaattcactgctgatgtctcattagacagtctatccagcaatcaccaaatatcatccactcacaaacctcgccaactctccatatagaacaaaacgtgagggatttcacgttgtcagagttaatccttggtactccttttttttttttttcctttttttttttttgagatggagtctcgccctgttgcccaggctggagtgcagtggtgtgatctcagctcactgcaacctccacctcccagattcaagtga

SEQ ID NO: 110716 - DNA, 601 bp, Human
ttattgaagagaattcttaaaggcaaacataattatttcattatggtcctcagaatgctttcattggctttaatgacaagaagctgtataaaaaggcatatattttaattagtcctttttatatttacatcagataaacaacaaataattgatgaaaaacaagtctttggaatggatgatttcacatagtgcactggttacagtttaatgatgaaacatttctctgttgctttgcattttaattatatatacattatattacagtagtcgtgccatggagctactaaaataccgttgttgmcattttattacaaaaaaaatcacgattaatgcctagaaattgaaagctgaaaaatgtagctagacacatctccaaggaagtaaattaccggttccattaattttactacatttgttagaactcattttgatcacttttatcttttacgcttcatctttttggattaagatcgtcaggggtttcatatgcttttttatggccacatcttctcctgagcacctttctttcgctcttgctgcctgttttgaggatttgcatgtgaaagtgccttgccaaatgtgcactggaaattcagagagc

SEQ ID NO: 110717 - DNA, 601 bp, Human
acattattctgtggatgggctgggctccgctgggcagaccctctgctccgcatgctgtcagctggggctgaatcatccatggctaaattgggctggcaatccaaaaagtctcactctcatggctggtggtggatgttggttgtcggtgagagctctaggggatctgcatgtgacttgtgcatgtcacagcatggcagcagtattccgagagagagtgtttcgagagtgaaccttccaggaaggaggcagcagaggctcccagtcctcttaaaacctagacccagagagtggtatacagtcrctttcactatattctgctggtgaagcagacacagggccagcccagattcaataactacctttcagtttgggagagaaaggcaaagaatgtccaccataacaatcgtagcgtatatgcactataacaagaaagaaagtattgtcttctgaaaatgattaaattaaagaacagttgtggggcttttagttttttggttggttccatgtttaatgaaatgctactctaatgacaacatacatcattttcagttaatcctcacaaccctataagtgagatgtcatcttcattttacagatgagg

SEQ ID NO: 110718 - DNA, 601 bp, Human
ccagtcttttacattgtggaggaaactctgcccaaactatgaggctattttactcttttgcccttttgtttttacatcctgtttgctgttgaagtctacgctggcctagtcactgctgtagctcagggggttcagaccaggattagtctggtatttactgaagagtcacaagaagatgagagatgggaaactgggcttttcatgttactctagtttactggtaacccttatctaaagatgggtgctaagtgtttgtgctagagagtgtctcttcattaagtggagctattttgtcttccaytaccaaaagcaaaaaagtaaaagacaaagaggaagaaagaaaactttctgatagtaaagtcgaattaatgtttatttgctaggtattttaagtatctattgtgtgcagaggatcccaaacctagttaaccattaccatttagtgaaacttacatgaatcatagtgcatctaattggcctctcagataatgctctcatttcagtgacttcaaacatgtcttattttttatttttttgagacagggtctcgctctgttgcccaggctggagtgcagtggtatgatctcagctcactgcagcc

SEQ ID NO: 110719 - DNA, 601 bp, Human
ttgctgttgaagtctacgctggcctagtcactgctgtagctcagggggttcagaccaggattagtctggtatttactgaagagtcacaagaagatgagagatgggaaactgggcttttcatgttactctagtttactggtaacccttatctaaagatgggtgctaagtgtttgtgctagagagtgtctcttcattaagtggagctattttgtcttccactaccaaaagcaaaaaagtaaaagacaaagaggaagaaagaaaactttctgatagtaaagtcgaattaatgtttatttgctasgtattttaagtatctattgtgtgcagaggatcccaaacctagttaaccattaccatttagtgaaacttacatgaatcatagtgcatctaattggcctctcagataatgctctcatttcagtgacttcaaacatgtcttattttttatttttttgagacagggtctcgctctgttgcccaggctggagtgcagtggtatgatctcagctcactgcagcctcaacctgctgggctgaagcaatcctcccgcctcagcctcccatgtagctgagactacaggtgtgtgtcatcacacctggct

SEQ ID NO: 110720 - DNA, 601 bp, Human
agtggactcctaagcacgttctctacgtatgcagtgtgctgatgtcttctggcataattgttaaacgtttgatatggataacacacaggttagtgccctcaaaaaggccaaccagataggcctcacttggctcctgcaaagcaccagtagctgcgctctggaagctcagatctgttttaaagtcctgagcaatttcttgcaccacatattggaagggaagtttgcgaatcagttcactggacttcgtataaagcctaatttcacggagtaccccagtcccaggcctgtaacaatgaggtttctccaccccgccagtagagggcgcactctcgtgaatggcttttgtggccagtttcttcccggatgcttttccacgggttggattttcgagtagtgtgctttgtaggaaccgtggtatggacacctccttactttcccccttctccttcgcccagagctcggcgaactagaggtggcgctggcgtcagagagccccaactgcaaatccaattccccgatattttatgaattttttttaatgcagaaaagttacaacagctttactgcaaacacctggatacctactgccatagctaccatt

SEQ ID NO: 110721 - DNA, 601 bp, Human
gtgaaaacgaaattgagaacatctcaagtgagctaatattttttggttattcaaaacacctctagtaaacttgatgggggctgtcaaaaacttgggaggttcagtttggctgggatggcaaagtaagtaagcccttataagtgcatttgctggcaaactggcctgaaaacatgagagtggaatatttccctgggctactggcacttactttgaggtcacagaaatagattttctgatggtacttcctgttagccaggacattattgctcccccttgtcccccccaccacccctttttttttggcctatccctagaaatggtgtgaagaaagtaaataaaaataaagctaaagcgcgccggtaatctcagctactcaggaggctgaggcaggagaatcgcttaaaacccgggaggcggaggttgcagtgagccaagattgcaccatcgttctctagcctgggcgacagacagacagtccatctaaaatatatataaaaaaaaaaaaatgataaagctaaaggaccggttgcggtggctcatgcctgtaatcccagcactttgggagtctaaggtgggcagatcacctgagctcaggagttca

SEQ ID NO: 110722 - DNA, 601 bp, Human
ccctagaaatggtgtgaagaaagtaaataaaaataaagctaaagcgcgccggtaatctcagctactcaggaggctgaggcaggagaatcgcttaaaacccgggaggcggaggttgcagtgagccaagattgcaccatcgttctctagcctgggcgacagacagacagtccatctaaaatatatataaaaaaaaaaaaatgataaagctaaaggaccggttgcggtggctcatgcctgtaatcccagcactttgggagtctaaggtgggcagatcacctgagctcaggagttcaagaccagsctggccaacatggtgaaaccctatttctactaaaatacaaaaattagctgggcgtggtgatgggtgcctgtaatcccagctactcgggaggctgagacaggagaatcacttgaacccgggaggcagaggttacagtgagccgagatagcaccactgcactccagcctagacaacagagctagactctgtctcaaaaagtaataataataataataaaataaataaatcgctaaaacaactctcaagagaaacttttgaaccacggtttgcttccccacccccatgatttaaagttgcgat

SEQ ID NO: 110723 - DNA, 601 bp, Human
ctactaaaatacaaaaattagctgggcgtggtgatgggtgcctgtaatcccagctactcgggaggctgagacaggagaatcacttgaacccgggaggcagaggttacagtgagccgagatagcaccactgcactccagcctagacaacagagctagactctgtctcaaaaagtaataataataataataaaataaataaatcgctaaaacaactctcaagagaaacttttgaaccacggtttgcttccccacccccatgatttaaagttgcgattgatttttattaaagtaaaacaatcastatcataattaatatttattaagtgcttattatgtgtcaggtgcttaaaatgaaccatgtcatctagtcctcagagcagcctgaagagaaaggccctgttatccccactttgcagacgcagattcctaggcactgagaggttcaaatacctaccttgaatctcccgagtaggagaaagtgagtccaaagttcccaactcagctttgtataatgtagggttccttttctttgccaacgatataaatttctattttgtttgcagggaagagggatggggaagattagaagcctcagaaccca

SEQ ID NO: 110724 - DNA, 601 bp, Human
caaaaagtaataataataataataaaataaataaatcgctaaaacaactctcaagagaaacttttgaaccacggtttgcttccccacccccatgatttaaagttgcgattgatttttattaaagtaaaacaatcactatcataattaatatttattaagtgcttattatgtgtcaggtgcttaaaatgaaccatgtcatctagtcctcagagcagcctgaagagaaaggccctgttatccccactttgcagacgcagattcctaggcactgagaggttcaaatacctaccttgaatctccsgagtaggagaaagtgagtccaaagttcccaactcagctttgtataatgtagggttccttttctttgccaacgatataaatttctattttgtttgcagggaagagggatggggaagattagaagcctcagaacccacagaataataaaagggttaacaagtgaaagctggaaataatacgtttttaacaaaatgggcagttcttctaattgctgtgcccctactgttcaattcctttttatgtcctaattcattaaattatgtacacatcaggcttattatttacagatgtatacacttcc

SEQ ID NO: 110725 - DNA, 601 bp, Human
tcgctaaaacaactctcaagagaaacttttgaaccacggtttgcttccccacccccatgatttaaagttgcgattgatttttattaaagtaaaacaatcactatcataattaatatttattaagtgcttattatgtgtcaggtgcttaaaatgaaccatgtcatctagtcctcagagcagcctgaagagaaaggccctgttatccccactttgcagacgcagattcctaggcactgagaggttcaaatacctaccttgaatctcccgagtaggagaaagtgagtccaaagttcccaactcrgctttgtataatgtagggttccttttctttgccaacgatataaatttctattttgtttgcagggaagagggatggggaagattagaagcctcagaacccacagaataataaaagggttaacaagtgaaagctggaaataatacgtttttaacaaaatgggcagttcttctaattgctgtgcccctactgttcaattcctttttatgtcctaattcattaaattatgtacacatcaggcttattatttacagatgtatacacttccaagtggctcatatgaaacagatgtttcatgaaagg

SEQ ID NO: 110726 - DNA, 601 bp, Human
catgatttaaagttgcgattgatttttattaaagtaaaacaatcactatcataattaatatttattaagtgcttattatgtgtcaggtgcttaaaatgaaccatgtcatctagtcctcagagcagcctgaagagaaaggccctgttatccccactttgcagacgcagattcctaggcactgagaggttcaaatacctaccttgaatctcccgagtaggagaaagtgagtccaaagttcccaactcagctttgtataatgtagggttccttttctttgccaacgatataaatttctattttstttgcagggaagagggatggggaagattagaagcctcagaacccacagaataataaaagggttaacaagtgaaagctggaaataatacgtttttaacaaaatgggcagttcttctaattgctgtgcccctactgttcaattcctttttatgtcctaattcattaaattatgtacacatcaggcttattatttacagatgtatacacttccaagtggctcatatgaaacagatgtttcatgaaaggtaacagagaacaagtgatctaaaccctcctttagtgggtatcaagtgagtattat

SEQ ID NO: 110727 - DNA, 601 bp, Human
cctcctttagtgggtatcaagtgagtattatggcctattacctgcaggtcttttgctattattttgaactgcagtgtccagtacgggcaggaagattcaatgtatctcctgtaggaacaagtaaaaatacaacagcactataagcaaacatctgcatctcaaaataaaagagggtatgtgcaagtgataggcaggtggtattcacatttgggctccggtagatgtgtgagtcagttttacaagcaatttgagaaaaagagacccattgcattacaggaggtgaggtgtattgagcagaccrtctttagagaccagtgttaccatatcagttagctggagaaatgaatgaacacctcttttcttttttctttttttttggagacagaatcttgctctgtcgcccaggctggagtgtggtggtacgatctcaggtcagtgcaacctccgcctcccgggttcaagtgattctcctgtctcagcctcctgagtagctgggattacaagcacacatgaccacacctggctaattttttgtattttagtagagacggaatttcactgtgttgcccaggctgctcttgaactcctgagctcaggcaat

SEQ ID NO: 110728 - DNA, 601 bp, Human
taagtggcagaagagagattcaaattcaggtccacctggcagcaaagcttaccactttcccgtcacctcctccacacaattttatgcaggctcatggcattttctttctttttaggaaccaagaaaacccacacagtgaggattaaatcggtttcaaagttattttgaggctgttcatatggtgcatacctgtaagaaacaaaacagaaaaatttctttgcagcaaaattctgagtaagccaagcattattttattgagaaaaagagggttttggctaaattctagtgtaatcaatcatasttgaacttccttagatcttagacgagtggcaaggtatgtgacaaagcataatttcatcgttgtcttccaagtatttcccttttggttttctgtcagactggtactaatgtggttttcaaatagatatatagtacataagcaacgaatgtgtgtgtggatatctgaaatgaatgtgaatgtgtgtatctgaaatgatatacatgttaatgctcctgttttaatctactctgtgtgcaggaaattcgatcagataaaataatgtcatttattagtgtgatagttccttttgtaaatattatg

SEQ ID NO: 110729 - DNA, 601 bp, Human
aaagtacaaatcttttatattgatgccatatcctggtttcctggttgtaattctagaatttgtcttggcatgttcgcctgaggctagctttggtgatctgacagactataccactgattttttttttttttttttttttttttgccttgcattgttctcagtgttataggccacatagaggaaataaaagaccactgaccatcaattctgagggtgatatttgaatatatatatatatatatagagagagagagagagagagagagagagagagtcaaatacttaattttttactaccagkgggaaaatttttccaaagatgattttttttggggatcgtacataacgtttttccctttctgtttttgtggcatttgtagcattcaaattatgttcatttatggcatttgcaggattcaaattataaaaacagtagaaagaaccaatttatcatttaaaaacatagcccagtcacttcctcttggaaggctcccttgatttctcctgggataaataaggcctatagttcactctgacattatattagtggttcccaaactacttcagtttggattcgcctgggaatactttttattatttt

SEQ ID NO: 110730 - DNA, 601 bp, Human
tgagaatctattgtactcacatgagaaagttcctagaattattggtgaaatcaccaccacctaaataaaaggccagggctctcactattgattacttacaatagaacattttcgttcatggcaactgttcaggaaaagccttctggattcattcatttgttataaatgactcttatccataggaaaagatccaatctttgtaaaatgctttgggatctttaatgtccagtagacttcccgttttttgtgtgctttgccccaagtttcttgggtattaaattatgcacaattttgtttcctktctttgggaaggtgaaatgctggactcccttcagtgcatgtgtttgaagtggcatatttatggaaattactacccacttttgaaattcagggcatagctctgacagctgattccagccctaccagaattctatttacaactttcctagacaggccagattagctgttctacacgaacgagtaggaccttaaaacacaccgctccccaccttccttctgtgaagaactcaatgcgagattgatcatagtggtgatgacatgactctgtcagttgttgaagcacatggatggaagtagaagc

SEQ ID NO: 110731 - DNA, 601 bp, Human
gactgatgagggtcaaaggttctaaggcccttaaattacccccacataataattccttttagataataagaactggctaggccaggtgtgatggctcacgcctgtaatcccagcactttgggaggccaaggtgcgcaatcacttgaggttaggagtttgaggcccgcctgaccaacatggcaaaacctcatctctactaaaaatacaaaaattagccaggcgtgagtggctggtacatctagtcccagctactcaggaggctgagacacgagaatcacttgaaactgggaagcagcggttscagccagccaagatcacaccactgcactccaacctggacaacagcgagactttgtctcaaaaaccaaacaaacaaaaaacaaagaactggttggaagaatcttgaaaagcatcgttctttttctctttagaacatgccgtctggtgtctgtagttttatcttatttttgaatatgactgacagtccactgaatcaacttgcagggaattcaaggttgaaactgggatttgtctgctggctgttttcctcagctctgtggcctttgaattacagtttgattttcagcctgtagggacttgc

SEQ ID NO: 110732 - DNA, 601 bp, Human
ccccaataaaaacaaaacccataccggcacaaacaactttgataagctcagttaagtgatacagagtcatattatggtgtatctttttaacagagctataaacccaataaggtcaggtgagttcggcagccagttgaatttgataatatttttatattgtgggtggattgctcttctccctggtcattgggaaagacttggtctacatttaagcttgctgggaaaatacagtgacaaaattcacagaactgagaaacatgaggaggtaatggtaaaatacaacagccaaagaaaaagaaayataactttaaaaaaattaaatataattttattgtcatttaaaaaaattatcaatacagtatagaatttattgtataaaaatagaaaattaaaacaaccattattctaccctgggagggaacccctgtaaaactcagcttttctgtaagtatatgcatattgttattgtttcagaaaaatggaattttgtgttgtatactggttttaacttaatctttaataatattttatgacccaaatttaagcaactgcatagcttttatggttatacaattaatatagtagtttacggttatgtcat

SEQ ID NO: 110733 - DNA, 601 bp, Human
aaacccaataaggtcaggtgagttcggcagccagttgaatttgataatatttttatattgtgggtggattgctcttctccctggtcattgggaaagacttggtctacatttaagcttgctgggaaaatacagtgacaaaattcacagaactgagaaacatgaggaggtaatggtaaaatacaacagccaaagaaaaagaaatataactttaaaaaaattaaatataattttattgtcatttaaaaaaattatcaatacagtatagaatttattgtataaaaatagaaaattaaaacaaccrttattctaccctgggagggaacccctgtaaaactcagcttttctgtaagtatatgcatattgttattgtttcagaaaaatggaattttgtgttgtatactggttttaacttaatctttaataatattttatgacccaaatttaagcaactgcatagcttttatggttatacaattaatatagtagtttacggttatgtcataatttatttaactgattaaggtgcttacagtttttttcgattataaataacactttaaattatggcctttaagtatatctctgaaaatttccttaggat

SEQ ID NO: 110734 - DNA, 601 bp, Human
aaaatacaacagccaaagaaaaagaaatataactttaaaaaaattaaatataattttattgtcatttaaaaaaattatcaatacagtatagaatttattgtataaaaatagaaaattaaaacaaccattattctaccctgggagggaacccctgtaaaactcagcttttctgtaagtatatgcatattgttattgtttcagaaaaatggaattttgtgttgtatactggttttaacttaatctttaataatattttatgacccaaatttaagcaactgcatagcttttatggttatacaaytaatatagtagtttacggttatgtcataatttatttaactgattaaggtgcttacagtttttttcgattataaataacactttaaattatggcctttaagtatatctctgaaaatttccttaggataaaattttccttaggataaatcagtataagtggaatttttagatcactggctttgtatatttttaaggctttcgaatcagattgccagaataccccgtagaaaagattattgtctagtagtctgtaaaaagtaaatcctttcggaaagtatctattatctcccttgtgatataa

SEQ ID NO: 110735 - DNA, 601 bp, Human
agaagcaacttttcttcttgaattctgcctgtatttaatttgatatttactatgggccctgtgtgtggtatcattttaggataccagcagatgcaccataggccccttgttgaccggtagaaactggcccaaccattggctggaaatcaaagtttactactgtaagctgagaacctctgctctaaagtaggactcccaaacagagcctggtatatcttcaagaagtaatgcctacggtggcttctgcctgtcataaccaggatgacctaattgactattatttggggaagagaactttccrtcctcctagggactgggtgacagtctcagcctctgctgcagccatacgatggtggtcagaatttaacaaatgggtgtggtccatctctgggaatgaatggtcagcggctgctgtattgacacagcattaccatggcagtataaccactagacacactgtagggatgccctgtttagggggtttccaggtgagcgatggcagtttttgtgtaggggacaaagagtacacaaaaggaatgtgcagtgtggttagccaagaatgtttaacagtataaaataataaagcaatattaaaaaaata

SEQ ID NO: 110736 - DNA, 601 bp, Human
actattatttggggaagagaactttccgtcctcctagggactgggtgacagtctcagcctctgctgcagccatacgatggtggtcagaatttaacaaatgggtgtggtccatctctgggaatgaatggtcagcggctgctgtattgacacagcattaccatggcagtataaccactagacacactgtagggatgccctgtttagggggtttccaggtgagcgatggcagtttttgtgtaggggacaaagagtacacaaaaggaatgtgcagtgtggttagccaagaatgtttaacagtatraaataataaagcaatattaaaaaaataataggacaaaataaaataatgtctttggaaaacagtcttattgctcatagctaaaatttaatgcaaaattttggccttaatcatattttacatttcaacttttgtagcttttgaggaatgtgaagtctagagtgagaatgctgggatgtgaattctagctagactacttataagcttggtgcaactctctcttttctcatctggaaaaatgggggtgatattacctacctcatggtattgttgtgaggataaaatgtttttactatgtataaa

SEQ ID NO: 110737 - DNA, 601 bp, Human
tggataggtcttcttgtcttggctgacttggcttgggccaggtggtctaggacggtctcactcacatgtctggggccttggcaggatgaccagatcctctccccctgttgttgctcaccattagcctagcctaggcttcttcacgtggtggatgggttcccatcagtaagagaagacaatcaccatacaatcatagcaagccaacgccacttatccagtgaaccagctcaaacaaacacttctcaccctctgcttgtatcacatttgctaatatccccttggccaaacaaattgcgtgacyaagcttggattctatggatgaagaaataaacttcacctcctaaggggagaagtgacaaagtcaccttgcaaaagggagagcctaccagaacttgcatttggttacataccgtcttctattattccctagtttgatgggcaagtctcttctgacaaccttattcaccaatcattcatccttaagcatatgtttgttgaacacctactaagtttcaggccctatgccgggtgctagagatacaacagtgaacatgacaaagttcctcatggaatttagtgtctcacacaagggacagatgat

SEQ ID NO: 110738 - DNA, 601 bp, Human
aagttatatctaattatacagtaattagtgtagttataaataacgcataataagatataattgtataataatgcaaatagtatattactttcatacattttatctaattatataatgaattgcatctaattacatagggcttgggatgatacattcatgtaaacattcatggaattatatataaacaggacaaggtctttggtgaccaaagtctagctcatttcttagtaatttctgccttctacctcagttaaccttcattgcaaaacgtatgtcctctctgatactatctttaggcaawctcttaagaactagtgcctggaatgatatactgacgtggaagagtactgagggctgttagtgctttaagaaaaatctcagcttagagaatctacctccatatcgaggaacctcaagacagctgaaatgacaatctaccttttcctagtaataattcctacggaaggagaaaacacttttcttcttctaacaaattgagaactgattttggattgaaaaagcagaaaaatctgtctttttttttttttccttctggtgtatggataaacaggaagttgggggcggggggagtgaattctga

SEQ ID NO: 110739 - DNA, 601 bp, Human
ttcctagtaataattcctacggaaggagaaaacacttttcttcttctaacaaattgagaactgattttggattgaaaaagcagaaaaatctgtctttttttttttttccttctggtgtatggataaacaggaagttgggggcggggggagtgaattctgaattagcccgcaactctgcgtgttttttttttttccttgagttggcgtggtaaaaatagtttatttaatttggtggttttaagaggcttataaattttttaatggttaaacgttcaggaatgcttgtgtagatgcttacttygcttgttgtttgaaaatatctagaacactttcatttgctgtttttgttataacaaactaaaggtctgctattattgcaattatcctctttgtttctccaccttttactagaaaagttaagagagctttccatatttccttctcctgggtggatgcctgtaaagaggtgatatgaaatgaaattgtctggaaaggctttccttcttcatcagcccccctctaccttctcattgtcagggcagggctcagagcccttggtcttcccactctctacagttgcctctctccccacccgcgtacc

SEQ ID NO: 110740 - DNA, 601 bp, Human
gctaagtttctaccataggttttttttatttgatcctcatcatatttagagaagtaggtggaatcgattgtttccccctccatttcacagatgaggaaactaagaatttatgagagcagattctaccatctgtggttttgatttataatgtgattctgttactgaaatggttactgtgagaacctccttaaatacatttctgtaaggttccctgaaatttatcaaactatcttttcaaggcctctgattctaaacatccccatattcctagttcattcagctttgacattttgagaaactkggaaagccttacccaatagaggtagacctttatcaggggttagattccagtgtcatcacacaaggcaaagattacacgtagacaaaattaccccagaaaatccctttgaaaagcacactgctggagactgacatatgtctctcattaggacctacaaagccagttcttgccatagctctggaaacagatcactccatggaacaccagatgaaacagttgttttctgttctcttgttgtatcaaatatgtgtccttaagcacaacagtcataccagcacaacgcaatgcttatgtcctgaa

SEQ ID NO: 110741 - DNA, 601 bp, Human
gttgttgttgttattgagtatttttccacttcagaaaggaagattaaatgtgtcatatggataagcaacaccagaagggaaaattttgttctatggaccctagaactcatccctgaaaaaaaaaaaatagagggaaataaaactctgtgtgcatctctgcctgtacaaagctagcattgtctggggtgaaggggaaaagctggggttctggcaggccggccccattagagccttgtttcttgttccatattgaaaagatgacattcctttgctagcagcgtcctgcctggatttctggcascagttctgtggctagcactattgcctggggcatttttgttggggttggttttgttttatttcaaaagcagcaaaatgcaggctttataaatgttcaaggtagaactgtttttataaagcttgtcaccaaacttgtcagtacagtcaaggtggcccgtctgccagggtgtctgcttccttttcactggtgtcaagatgtatgagaaggcatatatatagtgaatttcacttcttaacttgttctcaagtgtttctgaggcagcccttgtgttttcacatgggcttctcctccctctcaggg

SEQ ID NO: 110742 - DNA, 601 bp, Human
caaggtggcccgtctgccagggtgtctgcttccttttcactggtgtcaagatgtatgagaaggcatatatatagtgaatttcacttcttaacttgttctcaagtgtttctgaggcagcccttgtgttttcacatgggcttctcctccctctcagggcttcatgtaatgtttcatttataacagagattggtggatttgcaaagtaaatatttcaataagaaaaaagcaagatcttcggtgaccctctcggttctgcttctatggaggtattttctatgtctggcaggaaaaaaaaaaaaamaaaaaaaacctttatcttggctgcaactctgaactggagcgtgtaaaatgtacttctcaggttctgtgagccttaaaataatgagcagtagaaaactctgaggtaggtcagcgatggggagaataccatagttttataaaggattttcatggttaaacaaatttggagaaactagaatgaccaagcaatgttaattctccactgggcttttgaatctgaaaatagcagcaattctaagtacacaacaccaccattcatacagccctggaaagtcccccacatcaggaaaattatccttat

SEQ ID NO: 110743 - DNA, 601 bp, Human
taggtcagcgatggggagaataccatagttttataaaggattttcatggttaaacaaatttggagaaactagaatgaccaagcaatgttaattctccactgggcttttgaatctgaaaatagcagcaattctaagtacacaacaccaccattcatacagccctggaaagtcccccacatcaggaaaattatccttattagtcaaacccagtagggatcatctgactattcctcagggaaatgagaatttttgtttggatcttacttctctgtattgtactcaaattgtacatgagctatgycacatctggggactttgcgattatggtcatgttttcaataagaaatacttctgaaagctgctgctctaatttatatgtgtcattcctcattaacataaataaattcagaataatagcatgaggtggtggtatttttttttatttttcagtttccagagtcatcctgctctgttaggtgttccttcagctggctgggaccctaagccagtttacagtcccaacacttgctaagatattgtttgatgacatttattctgtttggctctacagtttgtcaatctcatgatttcatcaaaaacg

SEQ ID NO: 110744 - DNA, 601 bp, Human
aattacattacaaatcgtaaatgggtcttactgtcctcactgaatatatttggtttttaaacccaaattcataatgcaggcacttcttttgctatgctcacgtgtatgatgtttgctgttagagagttcacaggattgatatcccagactttggtggtttaagatacctaaaagagtatttttgaattattgagtctacatcaggtattcctttgttatttgattatttttatctgtcttatttcttatgagctctgggcctcagaaagaatatttctgttctccactacgtacactatcrgaaatatgagcattggatgagggatggtaagagtgacctccaaggaactaaatgtttacctgtattatatcggggtggataagctattatccaaataacaaagggggggggatcccctgcaaaaaatcactatagataagttatgttgaagtatattactattaagtaattagtattttagtaacttattttaaataataaagctgacattcctataagaatatataaaacagaatttatataggaaagaaaaaataacagaaaaattttggggcttgatattttgtgacacttacttct

SEQ ID NO: 110745 - DNA, 601 bp, Human
tgtcctcactgaatatatttggtttttaaacccaaattcataatgcaggcacttcttttgctatgctcacgtgtatgatgtttgctgttagagagttcacaggattgatatcccagactttggtggtttaagatacctaaaagagtatttttgaattattgagtctacatcaggtattcctttgttatttgattatttttatctgtcttatttcttatgagctctgggcctcagaaagaatatttctgttctccactacgtacactatcagaaatatgagcattggatgagggatggtaakagtgacctccaaggaactaaatgtttacctgtattatatcggggtggataagctattatccaaataacaaagggggggggatcccctgcaaaaaatcactatagataagttatgttgaagtatattactattaagtaattagtattttagtaacttattttaaataataaagctgacattcctataagaatatataaaacagaatttatataggaaagaaaaaataacagaaaaattttggggcttgatattttgtgacacttacttctttttcttcaagccatctggggagcacagtca

SEQ ID NO: 110746 - DNA, 601 bp, Human
ggattgatatcccagactttggtggtttaagatacctaaaagagtatttttgaattattgagtctacatcaggtattcctttgttatttgattatttttatctgtcttatttcttatgagctctgggcctcagaaagaatatttctgttctccactacgtacactatcagaaatatgagcattggatgagggatggtaagagtgacctccaaggaactaaatgtttacctgtattatatcggggtggataagctattatccaaataacaaagggggggggatcccctgcaaaaaatcactrtagataagttatgttgaagtatattactattaagtaattagtattttagtaacttattttaaataataaagctgacattcctataagaatatataaaacagaatttatataggaaagaaaaaataacagaaaaattttggggcttgatattttgtgacacttacttctttttcttcaagccatctggggagcacagtcaatggatgtgggtaaatgtttgtttctgaatccttgctggaacccaagtcacctctcctctcatggaagtcctctgccatatccacgctgaccaataacatt

SEQ ID NO: 110747 - DNA, 601 bp, Human
tgcaaaaaatcactatagataagttatgttgaagtatattactattaagtaattagtattttagtaacttattttaaataataaagctgacattcctataagaatatataaaacagaatttatataggaaagaaaaaataacagaaaaattttggggcttgatattttgtgacacttacttctttttcttcaagccatctggggagcacagtcaatggatgtgggtaaatgtttgtttctgaatccttgctggaacccaagtcacctctcctctcatggaagtcctctgccatatccacgytgaccaataacattctaaagtaggcttcaagatcagtctccttggctctgcagtgctattactcctgcaggaaatgcatctggcatttgttactctcacagtaacatcctttcttccattcacagttgaggccctaactcttcccattttagttatggtaaggccaggttatgctgcaggaacaaactcaaaattacaatggcttcaaatagtagttgtgtatttgtcactcacaccatgtgtccattttggatagatagttctactccatgttaccttcactcaaggaccaagactgat

SEQ ID NO: 110748 - DNA, 601 bp, Human
tcttatttggctgtgccttctatttttacactccattctctgcagacactttttacaagtttcttaagaatagtttatagggtagatttaggaaaaaaaattgtgtggcaccccaaattgcctccctccaaactgaatatgatcataacgtatctttcattttatctttctacagtctcccctgcctttctgggacctccccaagcagttaaagggcacctgctatccttgtctttatgtgagagacccagtcgtgggcctacaactgtcccattctgtgtaaacaccattttttccacartggcttgttgagtcttccctggagtagaagtgctggcagccatcctgaggttgcaagtttcctgtagtggaactttcattgtggtactgattactatttgaaactctttcatgaatagtttacttagtcactgtttttctctcccactagtgtgtaagtgctatgagaataggaactttgtaagtcttgttcacttctgtattctcagcacccacagcaaatcttggcatgatgtaggcactcaataaacgtttgttgaatgactcaataataaatagtatgtagaagaggtgggagaaa

SEQ ID NO: 110749 - DNA, 601 bp, Human
agagcacatttgtactagatccaagttatcacaggacaatagctatggggcaaatggaggagatgtttaggatactgttggccaagtatgtcctaacagatcagaaaggaagaatgaaaatgtcaataggcatcctttattcatttcatttttagttctaggaaagtaaatgctcatctgagattcagaggtatgcagaggtgcctgccccatctgtcttgctgtatcttcctagctgcctattgccatgctgctcttgggcatggggtaggtgactcaagaacaacattggggctcagtwtgccacctgatgagatggctttttggtgtctgccaagggtgactgtttcctttacacaatggttgaacttatcaattattcaggttacttcttagccccaagttgaactggttttgggtttcaaatattggtctttccctgtttgtcatatacaacagtgaaataacagatgccttctgttcattttgaagtgataaatcctataattactacaagtacttgcatactgcagtttattgaggatgtacatatgcaacatctcctttttataacagctctattatgtaagtaagacagaga

SEQ ID NO: 110750 - DNA, 601 bp, Human
aagtatgtcctaacagatcagaaaggaagaatgaaaatgtcaataggcatcctttattcatttcatttttagttctaggaaagtaaatgctcatctgagattcagaggtatgcagaggtgcctgccccatctgtcttgctgtatcttcctagctgcctattgccatgctgctcttgggcatggggtaggtgactcaagaacaacattggggctcagtatgccacctgatgagatggctttttggtgtctgccaagggtgactgtttcctttacacaatggttgaacttatcaattattcasgttacttcttagccccaagttgaactggttttgggtttcaaatattggtctttccctgtttgtcatatacaacagtgaaataacagatgccttctgttcattttgaagtgataaatcctataattactacaagtacttgcatactgcagtttattgaggatgtacatatgcaacatctcctttttataacagctctattatgtaagtaagacagagagtggaatcccttctcccttagggtttaacttctagaataagcatatgaggtaaatattgtatatggttaaaatgacccttaaa

SEQ ID NO: 110751 - DNA, 601 bp, Human
gccatagtcactttaaaagagcatctgggaaggagctattattgtggccatctttggaaaatccaagctgctgcagactgagtttagttttgaatcacaggctctttcttcagttagatgccagatgaagcaggtggcttgttcttgagagcctgttgtaggaaaaatatgcatctctgtgccctcggaagactagtggctcattctgaaaagcagatgggaactgagacagactgagggagctgtgggttcccaccacccatcttgccctacttcaggggacacactcactcagttaaayggcagatggacatgtggctaccacccacctttaagctgctgtgagtgcgttctggctttcctggtgactgagaaaaatgcagtacccttagtatcgacatgacgtctatggacacagggagaaaaagaagaaatcagaaggcccatgtgacacctggctctgccagctttatggaaacagaccgcaagctgatctctcagggagtggtctcaagttcaggccccctgctttctcctggcttgcatcagatcatatcactattctcatattgattctaggccactgggtgaattttttatt

SEQ ID NO: 110752 - DNA, 601 bp, Human
gttcccaccacccatcttgccctacttcaggggacacactcactcagttaaacggcagatggacatgtggctaccacccacctttaagctgctgtgagtgcgttctggctttcctggtgactgagaaaaatgcagtacccttagtatcgacatgacgtctatggacacagggagaaaaagaagaaatcagaaggcccatgtgacacctggctctgccagctttatggaaacagaccgcaagctgatctctcagggagtggtctcaagttcaggccccctgctttctcctggcttgcatcasatcatatcactattctcatattgattctaggccactgggtgaattttttatttttaccaaatgtgggctctaatgtaagctgctccagtccttgcgttttcagggtgctgcctgccaaaatagttatttattccttttggggagagctattcctgtgcatggtcagggtggtgaactcctgttgactctgaccaaaattctctttggcctccatttggaagtcgtctatgggcctttaattgtaccctctgggaagggagaaagagcacttgaaacaggcatgaattctgtacatatttc

SEQ ID NO: 110753 - DNA, 601 bp, Human
caagttcaggccccctgctttctcctggcttgcatcagatcatatcactattctcatattgattctaggccactgggtgaattttttatttttaccaaatgtgggctctaatgtaagctgctccagtccttgcgttttcagggtgctgcctgccaaaatagttatttattccttttggggagagctattcctgtgcatggtcagggtggtgaactcctgttgactctgaccaaaattctctttggcctccatttggaagtcgtctatgggcctttaattgtaccctctgggaagggagaargagcacttgaaacaggcatgaattctgtacatatttctaaggctgggctgttttaaaaatgttgtctgtctgtctgtcttcttttttttttgcctttgaacttggatgtgaattttcgtgaagtacagtgtgtcaagggaagggcaatgagaaaatatgcaggggtatttacttaaaaactactcagtgaatctgtcatggtgtgttcattggtttcagtatggtaataccatattatgaaatgaaaggtgtcttactctatgttaaatggctgctttgtaaaatctcagccttgttgtg

SEQ ID NO: 110754 - DNA, 601 bp, Human
ctttctcctggcttgcatcagatcatatcactattctcatattgattctaggccactgggtgaattttttatttttaccaaatgtgggctctaatgtaagctgctccagtccttgcgttttcagggtgctgcctgccaaaatagttatttattccttttggggagagctattcctgtgcatggtcagggtggtgaactcctgttgactctgaccaaaattctctttggcctccatttggaagtcgtctatgggcctttaattgtaccctctgggaagggagaaagagcacttgaaacaggmatgaattctgtacatatttctaaggctgggctgttttaaaaatgttgtctgtctgtctgtcttcttttttttttgcctttgaacttggatgtgaattttcgtgaagtacagtgtgtcaagggaagggcaatgagaaaatatgcaggggtatttacttaaaaactactcagtgaatctgtcatggtgtgttcattggtttcagtatggtaataccatattatgaaatgaaaggtgtcttactctatgttaaatggctgctttgtaaaatctcagccttgttgtgcatggtattatgcagtc

SEQ ID NO: 110755 - DNA, 601 bp, Human
gtgaattttttatttttaccaaatgtgggctctaatgtaagctgctccagtccttgcgttttcagggtgctgcctgccaaaatagttatttattccttttggggagagctattcctgtgcatggtcagggtggtgaactcctgttgactctgaccaaaattctctttggcctccatttggaagtcgtctatgggcctttaattgtaccctctgggaagggagaaagagcacttgaaacaggcatgaattctgtacatatttctaaggctgggctgttttaaaaatgttgtctgtctgtctgtcttcttttttttttgcctttgaacttggatgtgaattttcgtgaagtacagtgtgtcaagggaagggcaatgagaaaatatgcaggggtatttacttaaaaactactcagtgaatctgtcatggtgtgttcattggtttcagtatggtaataccatattatgaaatgaaaggtgtcttactctatgttaaatggctgctttgtaaaatctcagccttgttgtgcatggtattatgcagtccatgcctgtctctgaccatgaattttatttttcttttttacatttcaaattagattaaa

SEQ ID NO: 110756 - DNA, 601 bp, Human
ttttttatttttaccaaatgtgggctctaatgtaagctgctccagtccttgcgttttcagggtgctgcctgccaaaatagttatttattccttttggggagagctattcctgtgcatggtcagggtggtgaactcctgttgactctgaccaaaattctctttggcctccatttggaagtcgtctatgggcctttaattgtaccctctgggaagggagaaagagcacttgaaacaggcatgaattctgtacatatttctaaggctgggctgttttaaaaatgttgtctgtctgtctgtcttcttttttttttgcctttgaacttggatgtgaattttcgtgaagtacagtgtgtcaagggaagggcaatgagaaaatatgcaggggtatttacttaaaaactactcagtgaatctgtcatggtgtgttcattggtttcagtatggtaataccatattatgaaatgaaaggtgtcttactctatgttaaatggctgctttgtaaaatctcagccttgttgtgcatggtattatgcagtccatgcctgtctctgaccatgaattttatttttcttttttacatttcaaattagattaaaacccc

SEQ ID NO: 110757 - DNA, 601 bp, Human
gataaaaagatacctgatcattttcttcagaaatcagcccattgagaagttgttatttattttttcttattagagttaatttttattattggatttgagaaaccaggtgctttattgggagggcagggcaggtaagtaaataatgcaggctgatttgttacagtagagggtggtggggagtgtagcaaagatagtagctgtcttctaattctttgctactgcatgcctcaatggagtacaagcttataatgatgagaatcacctggatggcttgtcaaaggatcgattaattgatcctatwcccagagtttcaggttcagggggtctagaaatgtgcatttctaacaagctcccagggaatgctgagtgctagcccaggaaccacattttgagagccactgccctacaggaatgtggaactagcactgccaggtttttcaatatttcaagagaattcctctattacttgaggattatggctttttcaaggtattttttggttctccagacatttcactactaaaaaccactcagatcatacaatgattaggcaagaaatattaggaaagaacattaagtcaatctcttgcatattttaaat

SEQ ID NO: 110758 - DNA, 601 bp, Human
ggttctccagacatttcactactaaaaaccactcagatcatacaatgattaggcaagaaatattaggaaagaacattaagtcaatctcttgcatattttaaatctattctttaagtattggcaatgtatttaaaagtttttaaaagactgtgtcggccaccactgagccaaaataaacatgtctgttagctcaattcagtttggaaattagcagtttgcaacctctgccttaaatgccaggaagaaataatggatgaaaataaaagaattatgttttttgaatttttctgcatttaaaaawttttgaaaaacactggccaaatatttttaaagctagcccagaagctagtccagaaatgtgctttccttttataacctaaaaggcagatccataaactgttagaattaacagattgttccctcggttaagcatgcagagcctgtctgttatggtcactgaatcagcctatcagctggtggcaggcatggtttgtgtgaatgatcctagcaggacagtgcttctgtgcatattgtacatattgtccctgtggtacattgcagatatttttcctcttcacctacatccaacttaccttctttc

SEQ ID NO: 110759 - DNA, 601 bp, Human
caccttttaccacttccatttgctttgtgaacacttctgtctgtctttaaaggcagtaaagactagtaatcataataacagcaaatattttttgactgcttatgctctgccaggtactgttttaggctattaacaaatttaatattcataacaatcccacaaggtagaaaatagtactatccccatttaaaagacaaggtaaggcacagagaggttatgtaacttgtctgagatcacacagctaataacaggcagaggccgaacttgaacctagggtatctggcagcaggacccaagcccmcaaccactagactacctctgcaataagaagcctctgctttcagctcccttttttttcctacagaacctggctggacatgtggggatgcttagcacatagcagcacataatgctatggaaacagtcatttccactttccttctatattcaagtggtatgtctggcttatcaaacatttgtcgcaataaaaatatgactgtatgcaggctgagacaaagattactgctctttgaaatttctggagttgcctgatgacactcatgtaggatttagttgatcaaaagctttacttgatttggcc

SEQ ID NO: 110760 - DNA, 601 bp, Human
ttatttattatttcagtttggttataaatgttaattcaattgcagatggtatgttggcaatttacagagctataaagttatttggaaatcctaatattttctaccaaaatgttccgttagtgaaggatgagctaaattaaaaactcctgctctttagagttaaatacattaattggcaagtaggctgtagggatttccagatctgtgctggctatgttaactccttaaaggagggaaagacatgatttctaatttagagtgggaattttctttatgagaaagggcgaggaggaaagaggtstctttttcctaccacccttgtaacatttcttcaaggctgaggttttcttcatgtcctggttcatagcaaaagagacatgcttgaagccacattttttctgtagtacatcaatagtttctgagaccgtgatgttgataattagggtgtatgtgtacgtgtgtgcatgtgtgagagagtgagaaagagaccgtgttttctccaacctcgctgattactacaaaatatacatatgttttagccaggggttgtcaaattatggcccataggctaaaccgggtctgctgcctgtttttgtatggc

SEQ ID NO: 110761 - DNA, 601 bp, Human
tcttcaacttaataaactacatcagaacaattctatagtcattatctgtatataccctaccatcatctgccacttcacccaaatgaattgctaagttgctgagtttggaagggtcttttaaattcggataatggtgaggtacttttttggctacattctgatatatccagcacatatatgcatttcctgatgatggtcttcacggacaatgggagaagggctaattttgaatttctaataatgaatccttgtatccctctgtataattttatttcaatcaggttccaatcacagattattrattttattatctaagtatattcttcttactctaaatatttttcttagattaggacaaggtttggattaggtcaagtatacctatgatgacctctgatttacattgctttacaacacacctgagacttggagaggagagagaggagggatgctggactagttcccctgctcagtcacacactttctctccttttgtgctgggatggtgatgtgaggtgtctggtgtccctgacgcagtcagctaacagcttccttaagaagcctggccctgtgctaccctcagtggcgtttgacacagtaa

SEQ ID NO: 110762 - DNA, 601 bp, Human
ttcacggacaatgggagaagggctaattttgaatttctaataatgaatccttgtatccctctgtataattttatttcaatcaggttccaatcacagattattgattttattatctaagtatattcttcttactctaaatatttttcttagattaggacaaggtttggattaggtcaagtatacctatgatgacctctgatttacattgctttacaacacacctgagacttggagaggagagagaggagggatgctggactagttcccctgctcagtcacacactttctctccttttgtgcygggatggtgatgtgaggtgtctggtgtccctgacgcagtcagctaacagcttccttaagaagcctggccctgtgctaccctcagtggcgtttgacacagtaatagacacacattacagacgtaaatagcaactccaggttttcgcttccatggaagtgtgttaaagttatgtccactaaatgggttactttggctttaaataatagaccccattgcttctctgttcctcagcgtgcgatgtggtttcacctaccactctctgctttcaacaaagcagataaggtatcaacacaattaaaa

SEQ ID NO: 110763 - DNA, 601 bp, Human
aatctgtaaatgaggacacctaatgcggaatggtcggcatgatactctatccttcccccattaagataacaagatgagaggcaatgattcagatcagtatatttttggagctttgagcggataaaaattaaaaattaaaagagatgatgttctgaaatactttgggtaagcaagctcataaaagccatttggaaacctgaaattacacattaattcagaatctccttctgaggggctcctaaaacacctttctgttttcttggcaggatgaaagcattacttttgtgtcactgcctggtgytttcacagggtctattctaatgctcactaaggcgtcatgctctgttctaatgtgcctcttgtagccatctttggtttgaaccaactaaacttcaggtgatgttgaaaacaaataggaattaatacatgaagctttatatcttccctctatagatatgttaaatctcaagttaccaggataatgtgattcatggcttattttccagcctggagggagtggttggtccaatctggagggatttattcagctgctataactactgttgacagtatggggaattggccccacaattccccaaag

SEQ ID NO: 110764 - DNA, 601 bp, Human
aaatgaggacacctaatgcggaatggtcggcatgatactctatccttcccccattaagataacaagatgagaggcaatgattcagatcagtatatttttggagctttgagcggataaaaattaaaaattaaaagagatgatgttctgaaatactttgggtaagcaagctcataaaagccatttggaaacctgaaattacacattaattcagaatctccttctgaggggctcctaaaacacctttctgttttcttggcaggatgaaagcattacttttgtgtcactgcctggtgttttcacrgggtctattctaatgctcactaaggcgtcatgctctgttctaatgtgcctcttgtagccatctttggtttgaaccaactaaacttcaggtgatgttgaaaacaaataggaattaatacatgaagctttatatcttccctctatagatatgttaaatctcaagttaccaggataatgtgattcatggcttattttccagcctggagggagtggttggtccaatctggagggatttattcagctgctataactactgttgacagtatggggaattggccccacaattccccaaagtctaggg

SEQ ID NO: 110765 - DNA, 601 bp, Human
ctgaggggctcctaaaacacctttctgttttcttggcaggatgaaagcattacttttgtgtcactgcctggtgttttcacagggtctattctaatgctcactaaggcgtcatgctctgttctaatgtgcctcttgtagccatctttggtttgaaccaactaaacttcaggtgatgttgaaaacaaataggaattaatacatgaagctttatatcttccctctatagatatgttaaatctcaagttaccaggataatgtgattcatggcttattttccagcctggagggagtggttggtccratctggagggatttattcagctgctataactactgttgacagtatggggaattggccccacaattccccaaagtctagggactgtgctatcccacagaaacaaaactgctaagctgttaacaagaggtggttcagatctttggtggttaaatgtagtttaatcatgatttacgggggcccggctctttttcctacacctgcctgtgaacatctcctaattattcatttgagaaaactctgaataaaaatatcaatcttgaatatgtgtgtgttccgaggaagaaggccagccatgtccaa

SEQ ID NO: 110766 - DNA, 601 bp, Human
taacaagcccatcctgggcagcagaaagctttgtgggccagatgggaagtagccactgaggagaaaaatgtaattttgatacaggaaatagaagaagaacagtacagcttttcactcaagatatatgtttcttctgtctaaagccagcaattttggaaaatgaagctaagagtttaaaaataagggctctgtcagggaaaataaaacaggtccccctacatccattaggctgcctttaattgaaaactggagaacaatctaactaattggcaggtacctcttttattacggagactgtttytccccttctctccagtgtaatcaaaaggctgctcctctttttatcaactaaagtcaggtatgaaatggaaaagcagagaggtaacacttaaaaaattaattgtgtgtgttctgttaaatgttctcctacaaaacaacttcagaaagtgcacagcttaaggtctttgaaacagcagcagctccaggagtgtattttcatatagcatggtgcttaggtggaagctataatgtgctaattgcagacaagttcatgttgtttaaaagaactttttcttttgcattggggacctatttaatttca

SEQ ID NO: 110767 - DNA, 601 bp, Human
gcagctccaggagtgtattttcatatagcatggtgcttaggtggaagctataatgtgctaattgcagacaagttcatgttgtttaaaagaactttttcttttgcattggggacctatttaatttcaaatcttggcactgtgctgacataatatagctactttaattttaaggatcaagaaagaggagcctgtgggtgaaatttgagcctattttttgctaatttggaataaatcagtaagttaacattgctgcctgaatttatgatattagagttttaccaatgaaaatataacttccttyttcctttccttgcatataaagtattttggtttaaatttacatttctttgctgatcttccttttcttccttttccttctacatggaatatccatatgatattattctttaattataaaagttgcatatactccatcacaaaaaaagattgttacatccctgcctgcaaaggactccggtttcaaagaagaaagagacacaaagatcaattgttgcactgttgtagagagaatgttccaacagcatatgctggtagtgggggcttggcgggagcctgacccctcttgggggctgtattttgg

SEQ ID NO: 110768 - DNA, 601 bp, Human
agaaagaggagcctgtgggtgaaatttgagcctattttttgctaatttggaataaatcagtaagttaacattgctgcctgaatttatgatattagagttttaccaatgaaaatataacttccttcttcctttccttgcatataaagtattttggtttaaatttacatttctttgctgatcttccttttcttccttttccttctacatggaatatccatatgatattattctttaattataaaagttgcatatactccatcacaaaaaaagattgttacatccctgcctgcaaaggactcckgtttcaaagaagaaagagacacaaagatcaattgttgcactgttgtagagagaatgttccaacagcatatgctggtagtgggggcttggcgggagcctgacccctcttgggggctgtattttggagcatgagcagtcctgaaccaaagaacaaggcagggaaaggactttcaagtcctagggcctgtggaaaggcactgagcagagagaaaacactctaggtttggggggcctgggtaagtatgactggacaaaggcatgagcaactttgaggggcaggtgggctttaaaccatttcatt

SEQ ID NO: 110769 - DNA, 601 bp, Human
tggaataaatcagtaagttaacattgctgcctgaatttatgatattagagttttaccaatgaaaatataacttccttcttcctttccttgcatataaagtattttggtttaaatttacatttctttgctgatcttccttttcttccttttccttctacatggaatatccatatgatattattctttaattataaaagttgcatatactccatcacaaaaaaagattgttacatccctgcctgcaaaggactccggtttcaaagaagaaagagacacaaagatcaattgttgcactgttgtrgagagaatgttccaacagcatatgctggtagtgggggcttggcgggagcctgacccctcttgggggctgtattttggagcatgagcagtcctgaaccaaagaacaaggcagggaaaggactttcaagtcctagggcctgtggaaaggcactgagcagagagaaaacactctaggtttggggggcctgggtaagtatgactggacaaaggcatgagcaactttgaggggcaggtgggctttaaaccatttcattgctgatctcagtgtgtagaggtcgatactcttagcattatcaggcgt

SEQ ID NO: 110770 - DNA, 601 bp, Human
ggaataaatcagtaagttaacattgctgcctgaatttatgatattagagttttaccaatgaaaatataacttccttcttcctttccttgcatataaagtattttggtttaaatttacatttctttgctgatcttccttttcttccttttccttctacatggaatatccatatgatattattctttaattataaaagttgcatatactccatcacaaaaaaagattgttacatccctgcctgcaaaggactccggtttcaaagaagaaagagacacaaagatcaattgttgcactgttgtakagagaatgttccaacagcatatgctggtagtgggggcttggcgggagcctgacccctcttgggggctgtattttggagcatgagcagtcctgaaccaaagaacaaggcagggaaaggactttcaagtcctagggcctgtggaaaggcactgagcagagagaaaacactctaggtttggggggcctgggtaagtatgactggacaaaggcatgagcaactttgaggggcaggtgggctttaaaccatttcattgctgatctcagtgtgtagaggtcgatactcttagcattatcaggcgtc

SEQ ID NO: 110771 - DNA, 601 bp, Human
aatcagtaagttaacattgctgcctgaatttatgatattagagttttaccaatgaaaatataacttccttcttcctttccttgcatataaagtattttggtttaaatttacatttctttgctgatcttccttttcttccttttccttctacatggaatatccatatgatattattctttaattataaaagttgcatatactccatcacaaaaaaagattgttacatccctgcctgcaaaggactccggtttcaaagaagaaagagacacaaagatcaattgttgcactgttgtagagagartgttccaacagcatatgctggtagtgggggcttggcgggagcctgacccctcttgggggctgtattttggagcatgagcagtcctgaaccaaagaacaaggcagggaaaggactttcaagtcctagggcctgtggaaaggcactgagcagagagaaaacactctaggtttggggggcctgggtaagtatgactggacaaaggcatgagcaactttgaggggcaggtgggctttaaaccatttcattgctgatctcagtgtgtagaggtcgatactcttagcattatcaggcgtcagcctg

SEQ ID NO: 110772 - DNA, 601 bp, Human
tacatggaatatccatatgatattattctttaattataaaagttgcatatactccatcacaaaaaaagattgttacatccctgcctgcaaaggactccggtttcaaagaagaaagagacacaaagatcaattgttgcactgttgtagagagaatgttccaacagcatatgctggtagtgggggcttggcgggagcctgacccctcttgggggctgtattttggagcatgagcagtcctgaaccaaagaacaaggcagggaaaggactttcaagtcctagggcctgtggaaaggcactgagmagagagaaaacactctaggtttggggggcctgggtaagtatgactggacaaaggcatgagcaactttgaggggcaggtgggctttaaaccatttcattgctgatctcagtgtgtagaggtcgatactcttagcattatcaggcgtcagcctggactcaccacagcttttccatacaaggacagaatccattttgagagctggagcttaagtaatattttctcaataaacttagtgagatttttgcactgtcagagcagtgtctgtggtgaagagaagcagaaggctacatccaataaatc

SEQ ID NO: 110773 - DNA, 601 bp, Human
gcgggagcctgacccctcttgggggctgtattttggagcatgagcagtcctgaaccaaagaacaaggcagggaaaggactttcaagtcctagggcctgtggaaaggcactgagcagagagaaaacactctaggtttggggggcctgggtaagtatgactggacaaaggcatgagcaactttgaggggcaggtgggctttaaaccatttcattgctgatctcagtgtgtagaggtcgatactcttagcattatcaggcgtcagcctggactcaccacagcttttccatacaaggacagaatycattttgagagctggagcttaagtaatattttctcaataaacttagtgagatttttgcactgtcagagcagtgtctgtggtgaagagaagcagaaggctacatccaataaatccctgttatttttcagttgtcagacttgacttaaatgtaaatgcctgactagctttccttctcccattctcatagactctatgagtttttcctttttactccaggttcaggatggaaccatgtataagcgagaaaaattccagtgagaagattccaacatggccctgaaaattaaatagacttggaaa

SEQ ID NO: 110774 - DNA, 601 bp, Human
aagtatgactggacaaaggcatgagcaactttgaggggcaggtgggctttaaaccatttcattgctgatctcagtgtgtagaggtcgatactcttagcattatcaggcgtcagcctggactcaccacagcttttccatacaaggacagaatccattttgagagctggagcttaagtaatattttctcaataaacttagtgagatttttgcactgtcagagcagtgtctgtggtgaagagaagcagaaggctacatccaataaatccctgttatttttcagttgtcagacttgacttaaatrtaaatgcctgactagctttccttctcccattctcatagactctatgagtttttcctttttactccaggttcaggatggaaccatgtataagcgagaaaaattccagtgagaagattccaacatggccctgaaaattaaatagacttggaaaaaatgcaccaagctctagacaagcatttatttttctgtactaatttaggtccttaacattataaagcaatacaagtacatcataattatttgggtctgtgagaggcctttgaattatgcaatatgcagcatcgccatggtgatgtgcct

SEQ ID NO: 110775 - DNA, 601 bp, Human
tcagacttgacttaaatgtaaatgcctgactagctttccttctcccattctcatagactctatgagtttttcctttttactccaggttcaggatggaaccatgtataagcgagaaaaattccagtgagaagattccaacatggccctgaaaattaaatagacttggaaaaaatgcaccaagctctagacaagcatttatttttctgtactaatttaggtccttaacattataaagcaatacaagtacatcataattatttgggtctgtgagaggcctttgaattatgcaatatgcagcatygccatggtgatgtgccttgccgtcaaccagcatgttatggtagagccatgttctggttttgttaatggccaaatgttgcataccaaacttctaaaagagattttaaaattcatgctctttggtaaagggtttcagtatatttgagcatgttttggctctctctccttctgcttacctttttctcccccgcttctcagtacagatgagaaaatttaatttgggtccagatgagatttagtaattaatgtacaaagcagctggggtccgctaactcctgggctgtagctgagcagctatttt

SEQ ID NO: 110776 - DNA, 601 bp, Human
tctcccattctcatagactctatgagtttttcctttttactccaggttcaggatggaaccatgtataagcgagaaaaattccagtgagaagattccaacatggccctgaaaattaaatagacttggaaaaaatgcaccaagctctagacaagcatttatttttctgtactaatttaggtccttaacattataaagcaatacaagtacatcataattatttgggtctgtgagaggcctttgaattatgcaatatgcagcatcgccatggtgatgtgccttgccgtcaaccagcatgttatgrtagagccatgttctggttttgttaatggccaaatgttgcataccaaacttctaaaagagattttaaaattcatgctctttggtaaagggtttcagtatatttgagcatgttttggctctctctccttctgcttacctttttctcccccgcttctcagtacagatgagaaaatttaatttgggtccagatgagatttagtaattaatgtacaaagcagctggggtccgctaactcctgggctgtagctgagcagctattttgttgcatttttttttcaataaaataattgaaaatttaaaa

SEQ ID NO: 110777 - DNA, 601 bp, Human
ggccctgaaaattaaatagacttggaaaaaatgcaccaagctctagacaagcatttatttttctgtactaatttaggtccttaacattataaagcaatacaagtacatcataattatttgggtctgtgagaggcctttgaattatgcaatatgcagcatcgccatggtgatgtgccttgccgtcaaccagcatgttatggtagagccatgttctggttttgttaatggccaaatgttgcataccaaacttctaaaagagattttaaaattcatgctctttggtaaagggtttcagtatatwtgagcatgttttggctctctctccttctgcttacctttttctcccccgcttctcagtacagatgagaaaatttaatttgggtccagatgagatttagtaattaatgtacaaagcagctggggtccgctaactcctgggctgtagctgagcagctattttgttgcatttttttttcaataaaataattgaaaatttaaaaacttaaaattcattggcttcttgccgtgttatacttagagtaatcctgataatagatcggtaactatggatttcaccaaggaagggcacaaaataactgac

SEQ ID NO: 110778 - DNA, 601 bp, Human
attaatgtacaaagcagctggggtccgctaactcctgggctgtagctgagcagctattttgttgcatttttttttcaataaaataattgaaaatttaaaaacttaaaattcattggcttcttgccgtgttatacttagagtaatcctgataatagatcggtaactatggatttcaccaaggaagggcacaaaataactgacctaagtaatttagaaaacagatgtctttagttggttcaaattctcagaaccagatttaaagaaagcatgtggagaagagcgaaatcttgcattttagagrcttcgtttccccttgtcatacagtttttcttcctaccacatcttaattcaaactcttgagaagagacaaagtagtccgcaagatatcatatttatgatatttagcctactgcacagaaattctttgggtaactactcaacctcatactcttcaccttctttttaagtcacctttatttcagtggcttccaagtagtggtcagagacacctaggggatttataatgaactttaagatatcctcttgaaaccgtgcgtagatatgtgtgctgtttcgaaggaaattttatctagtttcaaag

SEQ ID NO: 110779 - DNA, 601 bp, Human
tggttcaaattctcagaaccagatttaaagaaagcatgtggagaagagcgaaatcttgcattttagaggcttcgtttccccttgtcatacagtttttcttcctaccacatcttaattcaaactcttgagaagagacaaagtagtccgcaagatatcatatttatgatatttagcctactgcacagaaattctttgggtaactactcaacctcatactcttcaccttctttttaagtcacctttatttcagtggcttccaagtagtggtcagagacacctaggggatttataatgaactttwagatatcctcttgaaaccgtgcgtagatatgtgtgctgtttcgaaggaaattttatctagtttcaaagaagttctttgtgttcttttggcttctcccactccccctgcacccccacccccaagtcccttttacactacaaaaataaagcccagtagtaaaacataaaacccctcctgtaaggtttttctttctagcttttactcaggtcgtggaatttctcagaggcatcccaaggggatcctgtgggagaatgagtgtgattacagtgaactacttaattctgtctgatctacagtctt

SEQ ID NO: 110780 - DNA, 601 bp, Human
tagactaacagatcttatagaagccatggctacacctttactaagtccccagcactgggaccatgtcctgatggggatttattaccttttttttttttttttaaacaaaaataaacaactctcagcttttgcccttgagacaactcagctttcttgtttggagtatggatttgtggtctttttcttttttgtgtcctggagtttggccccatctaacttgacttgttcaatgttcttttcattacatttatgcccaccctccctgcctagaaggaaactcactgtcatcaaaataataggktgtttttctactttctccctccctctcacccattgtctttcagtggggtgaaaaggtcttcacttttctctttctccccccaaattttgctatgaataacttctcagacgttgtcacgcatagacttccactctctccagagggtgttttttgtttgtttaaggcaacgtgtttcctggtttaaaaaccatgtttcccagagtagctgtgatgggattattccacactcacctcctactggcagcatttactactggctggaaatgagcattattggcagctctctgctggcctggggtc

SEQ ID NO: 110781 - DNA, 601 bp, Human
caaaactcaagtttgaccaacagaattcgtgattagccagcagaagctatgatgtataacaaaagacatagtcaacgtgcacaagtcacagccaacagaggccctgactgagctgattccaactcagatcagtgggtctgctactaacagctgagaaatctgattgtttaattgcgtaaatacaaatgatatcaccctcaaggaatacatttaagaaactaaggtataatccaagacggttactatggctctggttatagctaggacttcatcaacaattacaattacaattgactaacarttgttagtcaacaattattatttgaatatcttctgtgtgttgggttctgtcccagccctgagctattcagctggtgtgtcccagtacaatttattaggtgttgaaaaattgaaacattttcctgccagtttttgcctgaccgttgccttgggtcttcccttcctccatccaactgtactgtcttagttccaggggtgtcatatttggcactgcctggaggccaccttgagtccaccaacttgtcagctcaggttcctaggaaccagcctttatacctatcctactcccctgtcagggagg

SEQ ID NO: 110782 - DNA, 601 bp, Human
cttaatggataaatgcacagtgcctattgggctccctgaggctggggccaccagccacaggttggcattcccccatgtcacctatgtaacctctaaagcagacagtgctattgttttagactttaagtatcatccttgaataggtataacatggaaggaaaagcaaaataccatgattgcctaggagaggaagcatccatgtatgcttagatcagtcagagaaggcttcctggccaagtgacctcatagaattttcctgggtttactgagaaaaggaagttcccagaaaatgaaagagtamcattacggtgtcagcagttccagagttggtagcagaaaaccaggtgttgtttttttgtttgtttgtttgctttttgagacggagtttcactcttgttacccaagctggagtgcagtggcacaatctcagctcactgcaacctctgcctcccgggttcaagcgattctcctgcctcagcctcccgagtagctggaattacaggcatgcgccaccatgcctggctaattttgtatttttagtagagacgggctttctccacgttggtcaggctggtctcgaactcccgaccctcaggtgatc

SEQ ID NO: 110783 - DNA, 601 bp, Human
taaagcagacagtgctattgttttagactttaagtatcatccttgaataggtataacatggaaggaaaagcaaaataccatgattgcctaggagaggaagcatccatgtatgcttagatcagtcagagaaggcttcctggccaagtgacctcatagaattttcctgggtttactgagaaaaggaagttcccagaaaatgaaagagtaccattacggtgtcagcagttccagagttggtagcagaaaaccaggtgttgtttttttgtttgtttgtttgctttttgagacggagtttcactcytgttacccaagctggagtgcagtggcacaatctcagctcactgcaacctctgcctcccgggttcaagcgattctcctgcctcagcctcccgagtagctggaattacaggcatgcgccaccatgcctggctaattttgtatttttagtagagacgggctttctccacgttggtcaggctggtctcgaactcccgaccctcaggtgatccgcccaccttggcctcccaaagtgctgggattacaggggtgagccaccgcgcctggccgaaaaccaggtcttaagacttctagccacaatctc

SEQ ID NO: 110784 - DNA, 601 bp, Human
ttagactttaagtatcatccttgaataggtataacatggaaggaaaagcaaaataccatgattgcctaggagaggaagcatccatgtatgcttagatcagtcagagaaggcttcctggccaagtgacctcatagaattttcctgggtttactgagaaaaggaagttcccagaaaatgaaagagtaccattacggtgtcagcagttccagagttggtagcagaaaaccaggtgttgtttttttgtttgtttgtttgctttttgagacggagtttcactcttgttacccaagctggagtgcartggcacaatctcagctcactgcaacctctgcctcccgggttcaagcgattctcctgcctcagcctcccgagtagctggaattacaggcatgcgccaccatgcctggctaattttgtatttttagtagagacgggctttctccacgttggtcaggctggtctcgaactcccgaccctcaggtgatccgcccaccttggcctcccaaagtgctgggattacaggggtgagccaccgcgcctggccgaaaaccaggtcttaagacttctagccacaatctcttgggatagtattgaaacattc

SEQ ID NO: 110785 - DNA, 601 bp, Human
tcagctcactgcaacctctgcctcccgggttcaagcgattctcctgcctcagcctcccgagtagctggaattacaggcatgcgccaccatgcctggctaattttgtatttttagtagagacgggctttctccacgttggtcaggctggtctcgaactcccgaccctcaggtgatccgcccaccttggcctcccaaagtgctgggattacaggggtgagccaccgcgcctggccgaaaaccaggtcttaagacttctagccacaatctcttgggatagtattgaaacattccaacttcagtscagcacagatacctgcctgaggccctcacagaggtgttacgatgactcagttctaagatgaatataaaagccctcatgatggtgtcctttaagccacaggctggtttccagaagttgctattcttgcccatgcagatagacagtctctctttccttagtctgcaaataccacctcttctttcgccaaaataccacctcttctttcgccaatttctttgcccgcagaaactccccaagtctcactctctaggtacccaactcatcacttcctggtgtgatgacacacttggaatcccagaa

SEQ ID NO: 110786 - DNA, 601 bp, Human
ggctggtctcgaactcccgaccctcaggtgatccgcccaccttggcctcccaaagtgctgggattacaggggtgagccaccgcgcctggccgaaaaccaggtcttaagacttctagccacaatctcttgggatagtattgaaacattccaacttcagtccagcacagatacctgcctgaggccctcacagaggtgttacgatgactcagttctaagatgaatataaaagccctcatgatggtgtcctttaagccacaggctggtttccagaagttgctattcttgcccatgcagatagacrgtctctctttccttagtctgcaaataccacctcttctttcgccaaaataccacctcttctttcgccaatttctttgcccgcagaaactccccaagtctcactctctaggtacccaactcatcacttcctggtgtgatgacacacttggaatcccagaaatttgtggctggagaggaccttccaagtaaactgcccaatccctcattcaggggaagagagagcttagtcccagatggttgtgacttgctcaagtcctctcagtgaccatgaggagcttgcagcccaggcgttcaactccta

SEQ ID NO: 110787 - DNA, 601 bp, Human
caaaaatctgatttggaaaaccaagaagtcctatttagtttctgccatcattgttactgaatcacactgactgggcaattagtgacataaagttctttaattctctggtcttctttcatttgagcatcgtgagattgttcttctctcctttctggtcactgactaagtgtttgctgaactaaaaatttggtttttaataaaataaatggagggggtcacctttgtccatacctcattttcttcccacgtatataaaagaccatgttttccattgtgttaatgtttctcggcagaagagcgttggaggtttctgtaaactgagtttctacatctggcagcagaaagtggcccacagttatattttttgtagggaaagatatgttttcagatgaccactctgcacagattctgggaggatttcacagtatttgtaacctgttattttagattctaagcacatttgtagttccagtggcacaaaaataaactgtgttttcttggaaaatgtgtgtgtctgggatatgtgacaggacttgcaaccttaaacaagatttccaggcacttatagttgaaccatgccagtaaaaatatgcttatttag

SEQ ID NO: 110788 - DNA, 601 bp, Human
cataaagttctttaattctctggtcttctttcatttgagcatcgtgagattgttcttctctcctttctggtcactgactaagtgtttgctgaactaaaaatttggtttttaataaaataaatggagggggtcacctttgtccatacctcattttcttcccacgtatataaaagaccatgttttccattgtgttaatgtttctcggcagaagagcgatggaggtttctgtaaactgagtttctacatctggcagcagaaagtggcccacagttatattttttgtagggaaagatatgttttyagatgaccactctgcacagattctgggaggatttcacagtatttgtaacctgttattttagattctaagcacatttgtagttccagtggcacaaaaataaactgtgttttcttggaaaatgtgtgtgtctgggatatgtgacaggacttgcaaccttaaacaagatttccaggcacttatagttgaaccatgccagtaaaaatatgcttatttagacattaaaatcctagggtgcccacgtaagtatcctaagcaatgtgtgttacatgagcattctttgctaatgtgctttagctttga

SEQ ID NO: 110789 - DNA, 601 bp, Human
ccagaaaatcaggataaattgcttcttttgtcaaaatgtgattttcaaaaagttaaaaagcaaaaaactctttcaagtgtttgtttagtaaacacatgccaaaaatttatttaactcattgatgaagggaatagtaggatgacaaagctggtttaaaggaggatatgagaaagatattcaggtagatagaaaacgagagagaaaggagggaaggaaaagagaataccggaataagattgcaaagctagatacaaaatggttcatttcctacagggcaataaaacaataatatttggggttrttgttcatctggtcagaaatgttttgcacctacactagacaaaaattatgtgtaatttaccaattttctacagtctgtatagaatctgggtccaatcaatagtaaaaagtaagtcaaacaaagttatatttcctgtgagtgttagatgacacttcgatgggcttgtcagtcagtgctgtagtacattactacccggtaacgctttctgcaatgatgaaaatattttgtatatgtggtgtttaatatggtagctatgggccagatgtggctcttcagcatttgaaatgtagctaatgtaac

SEQ ID NO: 110790 - DNA, 601 bp, Human
tatttaactcattgatgaagggaatagtaggatgacaaagctggtttaaaggaggatatgagaaagatattcaggtagatagaaaacgagagagaaaggagggaaggaaaagagaataccggaataagattgcaaagctagatacaaaatggttcatttcctacagggcaataaaacaataatatttggggttattgttcatctggtcagaaatgttttgcacctacactagacaaaaattatgtgtaatttaccaattttctacagtctgtatagaatctgggtccaatcaatagtaaawagtaagtcaaacaaagttatatttcctgtgagtgttagatgacacttcgatgggcttgtcagtcagtgctgtagtacattactacccggtaacgctttctgcaatgatgaaaatattttgtatatgtggtgtttaatatggtagctatgggccagatgtggctcttcagcatttgaaatgtagctaatgtaactaaagaactgaattcttaattttatttacttttcattaattttgatttaagtagcctcatgtgactaatagctaccatgttggacgacatagctctaacatgccatt

SEQ ID NO: 110791 - DNA, 601 bp, Human
agaaaggagggaaggaaaagagaataccggaataagattgcaaagctagatacaaaatggttcatttcctacagggcaataaaacaataatatttggggttattgttcatctggtcagaaatgttttgcacctacactagacaaaaattatgtgtaatttaccaattttctacagtctgtatagaatctgggtccaatcaatagtaaaaagtaagtcaaacaaagttatatttcctgtgagtgttagatgacacttcgatgggcttgtcagtcagtgctgtagtacattactacccggtarcgctttctgcaatgatgaaaatattttgtatatgtggtgtttaatatggtagctatgggccagatgtggctcttcagcatttgaaatgtagctaatgtaactaaagaactgaattcttaattttatttacttttcattaattttgatttaagtagcctcatgtgactaatagctaccatgttggacgacatagctctaacatgccattaaatgggcagacactcatttttatttcttgtttccaattttggataatttttttaaattgtattttaaatgttgtgagaggagctatgtaaa

SEQ ID NO: 110792 - DNA, 601 bp, Human
gtaatttcttttattgggtaaaaatcctcatatattggttttcttggtagtgcgctcatctgaaattgttctcgtcagcaagggagccagttatgaagctaagcctgtttggagggaacccaactctggtgttttccaagtaaatcagcttggaattaactttcctttagcaagataataatggtcatgtctagttttgattaaaaggggcttttgggtttgcaacaaaggaagaaactattgatatctcacgaggattttaaggtttatgtaagttaacttttctgctgccatcacttcrttactcaaaaagagcaattaatgcattgataaggttggctttgatttctgatgaagctcatttgctttactgagttttttcatcttcttgcttgcttgcagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatgtaagtggagtctcaaaaaactttttccctgttttccttatctctgtgatttgctca

SEQ ID NO: 110793 - DNA, 601 bp, Human
ctcaccttccacagtcatgtggaattcacacacgacactaacgaaatcttgccaagggtaggtgtgaatagagatgacatgaaaatggggattgatatggagattttgagatgaaacttgagtgacagttggtggaaaggcaggagttaggcgtcgtggatgtcagatttgtattccaaagcagtggctaactcactgtggatcccagagccattagcagtaactcaagcatattacacagtcacacggtgactccatttcccctatcttgacaatgggtataaggatcttcgcctgtatyggtgaggataagataaaatgataggcatgaatgttaacagtagtcataatttgcccttttttaggagggaaggattgtataacttgtggaagaaacatttcaaaatctgggacactggcatttttccaaacttgatttcgtttttcttctccaagccatcttttccaaacaataatgcactttattagtgcaaaagatattttaaaaatacattaaaaattggctactggtccataaatatctgatgatggggatttgaaatataccggctttagtataaaaagagtatgtgtacactgc

SEQ ID NO: 110794 - DNA, 601 bp, Human
gagatgaaacttgagtgacagttggtggaaaggcaggagttaggcgtcgtggatgtcagatttgtattccaaagcagtggctaactcactgtggatcccagagccattagcagtaactcaagcatattacacagtcacacggtgactccatttcccctatcttgacaatgggtataaggatcttcgcctgtatcggtgaggataagataaaatgataggcatgaatgttaacagtagtcataatttgcccttttttaggagggaaggattgtataacttgtggaagaaacatttcaaaatytgggacactggcatttttccaaacttgatttcgtttttcttctccaagccatcttttccaaacaataatgcactttattagtgcaaaagatattttaaaaatacattaaaaattggctactggtccataaatatctgatgatggggatttgaaatataccggctttagtataaaaagagtatgtgtacactgcaacaaatttcgctctttctctatttgatgtgtacaaatgtagggaataagaaagtattaggtggatggcttggctcaagcaggcatagggaggtcatggggctatgt

SEQ ID NO: 110795 - DNA, 601 bp, Human
taactcactgtggatcccagagccattagcagtaactcaagcatattacacagtcacacggtgactccatttcccctatcttgacaatgggtataaggatcttcgcctgtatcggtgaggataagataaaatgataggcatgaatgttaacagtagtcataatttgcccttttttaggagggaaggattgtataacttgtggaagaaacatttcaaaatctgggacactggcatttttccaaacttgatttcgtttttcttctccaagccatcttttccaaacaataatgcactttattartgcaaaagatattttaaaaatacattaaaaattggctactggtccataaatatctgatgatggggatttgaaatataccggctttagtataaaaagagtatgtgtacactgcaacaaatttcgctctttctctatttgatgtgtacaaatgtagggaataagaaagtattaggtggatggcttggctcaagcaggcatagggaggtcatggggctatgtgcccagtgatgctcttgtggggctgctgctctttctgtcactccatcatggggggattttggtgatggcgtgctgtgcaca

SEQ ID NO: 110796 - DNA, 601 bp, Human
ggagaatttcagttcaggctgaaattataaatgagtaagccagatgtggactcagggaaaatcagtacttttgcattattttgtgtgggctggagacccatttcctgcttacattacttaaaacccatatcctgctgctctgtaaaaactggcagcttggttggcaattaaaaaaaataatgtttacacccacaggaaaactccagcatcagccctcaaggagcttatcaccttaattagatttaaaaatatagaaatgggaagaaaatgggatcattatgtccaagtacacaaaaataaatgtatttttgttagaaggaaattgaagggaaagaaataaacacttggaatgtagagattgagagtctaattggatatttttaaagttgaaacagaaggaagcaggcaaatatgagaatcagtaaccaattataccacagtatacgcaactgaaatgaaaccaagaataatagatactcatagaatgttagaagtgaaaagggatcttagagattgattttcactcacctctctcatttgacgtacaagtacactaggactcagaaagatgacacggttctcccagcagtcccaactggct

SEQ ID NO: 110797 - DNA, 601 bp, Human
aagacaggaggcaaaaatgacctcatgtccaccatgatttgtcaggtcccacagtgctgttcccaaggcactcttctttatgctgtgggagaaaaaaagaaggataaaactgagaaaatttaagaatcattatagtaatagctaactggacagggtattttctatgtgccaagtattacattaaccactttttttttttttttttttgtgtcacccaggctggagtgcagtggcgtgatctcagctccctgcaacctccacctcctgggttcaagcgatactcctgcctaagcctcccaartagctggcattataggcgcctgccaccacgcccggctaatttttgtatctttagtagagatggcgtttcatcaagttggccaggctattcatcatgttggccaggctggtcttgaactcctgacctcaggtgacccacccacttcagcctcccagagtgctgggattacaggcgtgagccaccgcgcctggcctgcattaaccacttttaatgctttatcccattgatcttcataacaaccctatgagatagattagttacaattcctccttcccaggtcccaccatttttttggcagat

SEQ ID NO: 110798 - DNA, 601 bp, Human
tctatgtgccaagtattacattaaccactttttttttttttttttttgtgtcacccaggctggagtgcagtggcgtgatctcagctccctgcaacctccacctcctgggttcaagcgatactcctgcctaagcctcccaagtagctggcattataggcgcctgccaccacgcccggctaatttttgtatctttagtagagatggcgtttcatcaagttggccaggctattcatcatgttggccaggctggtcttgaactcctgacctcaggtgacccacccacttcagcctcccagagtgytgggattacaggcgtgagccaccgcgcctggcctgcattaaccacttttaatgctttatcccattgatcttcataacaaccctatgagatagattagttacaattcctccttcccaggtcccaccatttttttggcagatgtggaagctgagacacagagacattaatttactcaaggtaacacagttagtaaggggcagtgctgagatttggaaccaggcagtttgatgagaaagtctatattcaaactgaaatatatactgcgtgccataggaagcagcgtttaaaactccgagttcc

SEQ ID NO: 110799 - DNA, 601 bp, Human
gaaccaggcagtttgatgagaaagtctatattcaaactgaaatatatactgcgtgccataggaagcagcgtttaaaactccgagttcctttttccactctattttattgccagtggttaataaaacaataaccatgctccttgctctatattagagatgtatcccctagaaaatcatgtgcaaatttaatttttatagatcaaatttgattttacatgtgtaaggggatttacaagtaaaagaaatcctttaacgtggcctatcagaacagtatgcttatttcttcattttttttttttttctgttttgtaaatgctgctgggtataccttgtattttccaagggcttataggactagggaagcctttttgcagagaaacagctgtctgtcaaagcatagaataatggcaagtgaaaaaaaaactcgatttttagcagcattctaaagaggtggtacaatagtttatgaagaattggagaaggaggcaaaggaagcaaactgactcgaatgatgaacttctgctggtggcgtgggaggtttgtaatgatgtcagaagaggaaagcatgtggcaaagccctgaaataaaaacaattaatgaa

SEQ ID NO: 110800 - DNA, 601 bp, Human
atgtctgctttaagtggctcatccggtggccaaggatgccacttagggctgctctgtgatcccatcccatgcttctcccctaccagtagacacacccagcttccagccacactacaccatgctgacttatgagccgtatgtctccatttttctgaggatttacctccttctccatcagttgaaccccaggagcctgatgaaatgtcatttcctctttgaagcctcccctaagcctcattccacactctaggcagaattattcattcttccctccccaaccctgttttctcacagtgcttcrcacaaagctccatgaaccgcaaacttattatattatacagatagtatgattcttcacacaccagtgagtctccctggctggattataaactcttaaaaggcatgcatcatgtctttctcaccttgtagcccctgaatatagcatgaagctttgctcggtgaagttagattgatcaaggggttaaatgtgaccagttttaaaggcaaacccatcttctccctggctttactttctgaaaagttgtcagaggcaaaacaattctaggtgtgtattcaaatcgcagtcattcgtttatctgct

SEQ ID NO: 110801 - DNA, 601 bp, Human
atttacctccttctccatcagttgaaccccaggagcctgatgaaatgtcatttcctctttgaagcctcccctaagcctcattccacactctaggcagaattattcattcttccctccccaaccctgttttctcacagtgcttcgcacaaagctccatgaaccgcaaacttattatattatacagatagtatgattcttcacacaccagtgagtctccctggctggattataaactcttaaaaggcatgcatcatgtctttctcaccttgtagcccctgaatatagcatgaagctttgctcrgtgaagttagattgatcaaggggttaaatgtgaccagttttaaaggcaaacccatcttctccctggctttactttctgaaaagttgtcagaggcaaaacaattctaggtgtgtattcaaatcgcagtcattcgtttatctgctaggggcccagaacaagttactcaacttcttggaggctgtgttttctacctggatgagagaaacattggtattgactaacagcccaggcgtgacatgagaattgatgcttttaatcctgtttagacagcagtgtttccataagctgcttcctcttccc

SEQ ID NO: 110802 - DNA, 601 bp, Human
atagcatgaagctttgctcggtgaagttagattgatcaaggggttaaatgtgaccagttttaaaggcaaacccatcttctccctggctttactttctgaaaagttgtcagaggcaaaacaattctaggtgtgtattcaaatcgcagtcattcgtttatctgctaggggcccagaacaagttactcaacttcttggaggctgtgttttctacctggatgagagaaacattggtattgactaacagcccaggcgtgacatgagaattgatgcttttaatcctgtttagacagcagtgtttccrtaagctgcttcctcttcccagttccctcccccagaagacattagatcttctagggcttttgccagtgaaaaaggctgagctgagcaggtgtcttggggagttgtgcatgacagaagcccagttaagagggagaagcaaagatggacatgtattggggtttggaccttacttttgccaaaccttagctatcaaagaagggggtccagggataggggagacactggggtcaggaggtcagaaggaaaatggaagacaagaagtaggccagaattatgactcgggtgctgtgaggaagggaga

SEQ ID NO: 110803 - DNA, 601 bp, Human
gagctgagcaggtgtcttggggagttgtgcatgacagaagcccagttaagagggagaagcaaagatggacatgtattggggtttggaccttacttttgccaaaccttagctatcaaagaagggggtccagggataggggagacactggggtcaggaggtcagaaggaaaatggaagacaagaagtaggccagaattatgactcgggtgctgtgaggaagggagagtagtataccctggatgcccctgaggttaggctaggttcccatgggtcattggcctcctccaagactgggtgccccyaccctgtgtctgtaacagaaacaccatggaaggtactgttgctgccaccccctcattccagctcctttctttctgaaaaccactggccgtgaattcacacagggagcctctttgtattgctctttgaggttatgtttatgtgcccatgcccttgagtgatgggcaaaacatgtctttgattttgtttgagaatgctttttaatgtttatttcacagcatttttttcctatgacagtttcataagtgtatttgtagaatagagcaattgaataatctctgaatttaaaagtccctaagcac

SEQ ID NO: 110804 - DNA, 601 bp, Human
ccttaattaatatttcttgaatctctgctaatctgtctttttaacagatggcaacaatccctaggtaggactgaaatgtatttatttcagatgtctgcaaattttcttaaaaggccaggcagtaaatattttagcatctgcagtccatttggtgtttttttgcaactactcaactctactattgcagcttcagagcttcacaattgagcatggctttgttccaataaaactttacaaacacagtcacttgacctgaaaaccctgtttattttttgttttttgttttggtttgtttttttttgagatggcgtcttgctctgttgcccaggctggagtgcagtggcacgatctcggctcactgcaagctccgcctcctgggttcacgccattctcctgcctcagcctcccaagtagctgggactacaggcgcccgccaccacgctcggctaattttttgtatttttagtagggacaggtttcaccgtgttagccaggatggtctcaatctcctgacctcgtgatctgcccacctcagcctcccaaagtgctgggattacaagtgtgagccacagtgcccagccaaccctgtttattttttacc

SEQ ID NO: 110805 - DNA, 601 bp, Human
atacaaacatttcctctaaattttatttaagaaaaaaaatcaattgagacagaaatcgttaagtgtgtagcagcctgtgaatatgtgcaaaattgtgaaggcagtacttcaaaggactgaagtttgagaaacactggttttatatgttcttgtatcttaggaatagaagcagagtctgcagctgtggcctgagccctctcagagtctctgtagtgcctcagttgctggtcagatcccactgacatgcccctgccttactgcctgccgctaacccttcctcacatgctgaactctgtgcacmacttgaggatgggaaggggggtcttgcttttttgcatcctcaaggtttagacctttcctgataaaacaaggggtcaatgaatgggtggatctgtcacagtggattttaagcatccgggggaactgatggagggatgcagtatgctgcttaaagcctggacttaagggggagtcagattcataccccagcccaccacttacttagctctgtgtgatcttgggcaggtcacttaacatctgtgtacaccaagttgcttgtctgtaacatgaagagagtaatagtacctacttcatgtggcta

SEQ ID NO: 110806 - DNA, 601 bp, Human
aattttatttaagaaaaaaaatcaattgagacagaaatcgttaagtgtgtagcagcctgtgaatatgtgcaaaattgtgaaggcagtacttcaaaggactgaagtttgagaaacactggttttatatgttcttgtatcttaggaatagaagcagagtctgcagctgtggcctgagccctctcagagtctctgtagtgcctcagttgctggtcagatcccactgacatgcccctgccttactgcctgccgctaacccttcctcacatgctgaactctgtgcaccacttgaggatgggaaggrgggtcttgcttttttgcatcctcaaggtttagacctttcctgataaaacaaggggtcaatgaatgggtggatctgtcacagtggattttaagcatccgggggaactgatggagggatgcagtatgctgcttaaagcctggacttaagggggagtcagattcataccccagcccaccacttacttagctctgtgtgatcttgggcaggtcacttaacatctgtgtacaccaagttgcttgtctgtaacatgaagagagtaatagtacctacttcatgtggctattgtgagaaggaaatgaa

SEQ ID NO: 110807 - DNA, 601 bp, Human
cttgcttttttgcatcctcaaggtttagacctttcctgataaaacaaggggtcaatgaatgggtggatctgtcacagtggattttaagcatccgggggaactgatggagggatgcagtatgctgcttaaagcctggacttaagggggagtcagattcataccccagcccaccacttacttagctctgtgtgatcttgggcaggtcacttaacatctgtgtacaccaagttgcttgtctgtaacatgaagagagtaatagtacctacttcatgtggctattgtgagaaggaaatgaattaawacatggcaggggctaaaaacagtacttagctaagcgttagctcctgttactgttccggtatctgttatgatactgagccatcctggtctctaaagattggtgtattcattcatcagcggtccttagtgattgtacaggacagctaatgctccttccgacccagtggtccctttactcaaaacaagaagtacatgtccttgggactcaaatctacccccacaaagcaaggtgatgggtagatggggccagaagcagtttcagctctgagccaggtgatctgatgttggaattcatggcact

SEQ ID NO: 110808 - DNA, 601 bp, Human
tgcttttttgcatcctcaaggtttagacctttcctgataaaacaaggggtcaatgaatgggtggatctgtcacagtggattttaagcatccgggggaactgatggagggatgcagtatgctgcttaaagcctggacttaagggggagtcagattcataccccagcccaccacttacttagctctgtgtgatcttgggcaggtcacttaacatctgtgtacaccaagttgcttgtctgtaacatgaagagagtaatagtacctacttcatgtggctattgtgagaaggaaatgaattaatayatggcaggggctaaaaacagtacttagctaagcgttagctcctgttactgttccggtatctgttatgatactgagccatcctggtctctaaagattggtgtattcattcatcagcggtccttagtgattgtacaggacagctaatgctccttccgacccagtggtccctttactcaaaacaagaagtacatgtccttgggactcaaatctacccccacaaagcaaggtgatgggtagatggggccagaagcagtttcagctctgagccaggtgatctgatgttggaattcatggcacttc

SEQ ID NO: 110809 - DNA, 601 bp, Human
aaaacaaggggtcaatgaatgggtggatctgtcacagtggattttaagcatccgggggaactgatggagggatgcagtatgctgcttaaagcctggacttaagggggagtcagattcataccccagcccaccacttacttagctctgtgtgatcttgggcaggtcacttaacatctgtgtacaccaagttgcttgtctgtaacatgaagagagtaatagtacctacttcatgtggctattgtgagaaggaaatgaattaatacatggcaggggctaaaaacagtacttagctaagcgttarctcctgttactgttccggtatctgttatgatactgagccatcctggtctctaaagattggtgtattcattcatcagcggtccttagtgattgtacaggacagctaatgctccttccgacccagtggtccctttactcaaaacaagaagtacatgtccttgggactcaaatctacccccacaaagcaaggtgatgggtagatggggccagaagcagtttcagctctgagccaggtgatctgatgttggaattcatggcacttcatcgcttacacaatcaactccaaatgtccaaatgtgtt

SEQ ID NO: 110810 - DNA, 601 bp, Human
gcttacaaaagtaatgtgaaaaaaatgacaactcaacagtaaaaagataaatagctcaattttaaaatgggcaatggatttgagtagacattccaccaaagaaaatatacaaataactaataaatacatgaaaagatgttcaacatctttagtcatcatggaaatgcaggtcaaaaccatgatgagatgctgcttcacacccattaagagggctgtaataagaaagacgagcaataacaaatgttaggaagatgtacagaaatttggacactcgcacactgctagtgggatcataaatggwacattgccactatgggaaacagtttggcagttcctcaagaacttaaacagagagttattatgggacccattcattttactcctaagtatatactcaagagaaataaaaacatgtatctacacagaaagttgacagaaatgctcatagaagcattattcataatagcaaaaagctgaaacacccaaatatgcattaattgatgaatagacaagtaaaatatgatatatccttacaacagaatatttttcatccataaaaaggaatgaaatattgatatatggtacgacatggatgaccttt

SEQ ID NO: 110811 - DNA, 601 bp, Human
acgacatggatgacctttgaaaatattacgctaagtgaaagaagccagacacaaaaggccccatattctatgagatcatccatacaaaatgtccagaaagggcaaatccatagaaacacaaagtaacttcagagttgctagaagttgtcaagcagtggtgaatggggagggctgctaatggaaatattctggacttagatggtggtgactgtttcacaatttgtgaaatttgtgaatatattaaaaaccactgaataacacattttaaaagggcaaatttatagcatttgaattgtatctyaattttaaaaaaccgatgattttaaaatgttaggttaattgatgtaagggaaaatataaaagtaaaccttggagtcagattcgtatactaagttgtgtatgtgctagatgagggctcttatttggtaaaaattgtttctggtagtcagagctaaaaggggacaagttcagtgacaagactctcggtgtccacaagaggaaaatagccttgttgttcagaagaatcacagattttctagatactgatgtttgagatgaatgtttcccacaggtctttataaagtgagtactgggagacgtc

SEQ ID NO: 110812 - DNA, 601 bp, Human
tcttaattttaaaaaaccgatgattttaaaatgttaggttaattgatgtaagggaaaatataaaagtaaaccttggagtcagattcgtatactaagttgtgtatgtgctagatgagggctcttatttggtaaaaattgtttctggtagtcagagctaaaaggggacaagttcagtgacaagactctcggtgtccacaagaggaaaatagccttgttgttcagaagaatcacagattttctagatactgatgtttgagatgaatgtttcccacaggtctttataaagtgagtactgggagaygtcatttaggatgtccttgacatttttcgttgctcttcctcaggacatccctccaggtagttagttattcaatctcatctgttttccaaattgaaataaaaaggcatgcaaaagcaaggcaatccttatgaccttagacccaaaagaaataacgatgggcatgaaattgagagagtacaataaagatggcttcctcaaaacaagagttgactctcctcttcattccatttcaaattctatactttaaaatagttctccttcaaataatgcatttatgggtattgtctatttctgtttgat

SEQ ID NO: 110813 - DNA, 601 bp, Human
ccgatgattttaaaatgttaggttaattgatgtaagggaaaatataaaagtaaaccttggagtcagattcgtatactaagttgtgtatgtgctagatgagggctcttatttggtaaaaattgtttctggtagtcagagctaaaaggggacaagttcagtgacaagactctcggtgtccacaagaggaaaatagccttgttgttcagaagaatcacagattttctagatactgatgtttgagatgaatgtttcccacaggtctttataaagtgagtactgggagacgtcatttaggatgtcmttgacatttttcgttgctcttcctcaggacatccctccaggtagttagttattcaatctcatctgttttccaaattgaaataaaaaggcatgcaaaagcaaggcaatccttatgaccttagacccaaaagaaataacgatgggcatgaaattgagagagtacaataaagatggcttcctcaaaacaagagttgactctcctcttcattccatttcaaattctatactttaaaatagttctccttcaaataatgcatttatgggtattgtctatttctgtttgatttgcccttttaaagta

SEQ ID NO: 110814 - DNA, 601 bp, Human
agatgagggctcttatttggtaaaaattgtttctggtagtcagagctaaaaggggacaagttcagtgacaagactctcggtgtccacaagaggaaaatagccttgttgttcagaagaatcacagattttctagatactgatgtttgagatgaatgtttcccacaggtctttataaagtgagtactgggagacgtcatttaggatgtccttgacatttttcgttgctcttcctcaggacatccctccaggtagttagttattcaatctcatctgttttccaaattgaaataaaaaggcatgsaaaagcaaggcaatccttatgaccttagacccaaaagaaataacgatgggcatgaaattgagagagtacaataaagatggcttcctcaaaacaagagttgactctcctcttcattccatttcaaattctatactttaaaatagttctccttcaaataatgcatttatgggtattgtctatttctgtttgatttgcccttttaaagtagaaatcaactttttattttagaacatttttctctttattaaggtataacttacatatcttaatggcacagacttttaagtgtactgtttagta

SEQ ID NO: 110815 - DNA, 601 bp, Human
ttttagtgcacatttgtttgtgtgattaaaaaaaagaaaagctacttttaaaaagcgaattaactcagattattctgagataaaacttcagttttcctgattttctaacactaagtaatgttgggcattgacaatgctttagatagaaatggttgagaaaaattgaggccaatactgtttttgcatttacttctttgtttcccccaagaggatcaaatccattcctaaacatttagaaatcttgatatctgaagataacatccatattcacctcagtgtaaaagaccataatcaggggtcrgcctatgagccaaatctggcctgctgcctgtttttatcaataaaattttactggaacagccacatgcattcacttatgtattgtctgctgctgcctccttgctaaacaacagagttgagtagttgtcacagaggccatactgcccacaaaacctaaaatatctactatctggccctttaaggaaaaagttttgccaacccttgccatattcactcttaaaattttctattctaattcaaacactggttataagagtttagttccacgccaaatatatgtgcaatttgtaactgcagcctt

SEQ ID NO: 110816 - DNA, 601 bp, Human
ttttctttatttagcagtaaggtttctttattatcccctgaaaatagaagttgcccagggaaaggtggcaggttacatcacttcatggtgcctgagaggaagtaaagtgttgcctgcttgtttgagagcaaatttggaggtgggaggtaaagagaaggaagacatgagggcagtttgcaggaggagcaaagacagagaacactggaaaggcttggcccagactcaattaaggcacagaatttcattctggaagcacagccccgggtaagggggaggtctgcgggtcctcttagagccgtcrggcatctccattcctgtcttgccctcttcaaccacacctgaggtatattttgaaactgtatgttatggccctaggtgcttggcttaaggttctgtccgcagagaaggagacccaggctggttggtctccagtagacactgggtgagggacaaatggacacctgattagaatataatttaaatgttctccagtttgatggtgctgtctagaaagttctgttggtcacaagggctcgtatttgacacaaagaaatgtttgatttggtgacaactatgtgtttattgtaatcccactatgcgt

SEQ ID NO: 110817 - DNA, 601 bp, Human
tcaaaagttttccctttacccttctcttcccccctcccttcctccctccctgcctccctccttcctccctccctccttccttccttctttcttcctcttcctatcctcttctttctgtccctttttcctcccatgtttttatttttcttttttatcattattttttttcatgagatacagtctcgctttgtcacccaggctggagtgcagaggcacaatcttggttcactgcaacctctgcctcctgggttcaagtgagtctcctgcctcagcctcctgagtagctgagattacaggtgckcaccatcacacccagctaatttttgtatatttatagagacagggtttcatcatgttggcccgactggtctcaaactcctgacctcaggtgatccacccccctcagcctcccaaagtgctgggattataggcttgagccaccacgtccagccctttgtatatttttaaaaggtcttcttttctagctcttggaaataaaatcagaaattatactttatgtggaaaatttcagtgtacctcataacattataaagtgttctgacaaagctcttcaaaagtccatatgttcatggtgttaaat

SEQ ID NO: 110818 - DNA, 601 bp, Human
tgtggagaatagattgggcaaggggctgggaatggaagtggggtggttagttaagttgtccaggcaaagcataatgatggcttggactaatggagttaaaagagaaatgaaaaattaagttaaatttaaaaataaagagaagtgaatggattttgataaataaattagagatagaaccaacattaaatagcacataaaaggtacatggagaatgttagatggactggatggacggatggatggctggatggatggatgagtgggtgaatgaatggctggttactagttctctggcttccartgcaattctggcaggccactctcaaactttaaagagaacagggtgatatctaagctggtacttagcggtgttccccttcttcaggtagatctttagtttcccatgattccttactcatgattttaataatggagttctgctggtgaaggtatcatattatttgccaatgaatgttcttgccagaaaaccttactgataattaagcatgcaactggaagcagggtgtgtgtgggaggtggggatgaggggcaggtgtatgtttatgtgtttgtgtgtaattactactttattcagtgtcag

SEQ ID NO: 110819 - DNA, 601 bp, Human
cttactgataattaagcatgcaactggaagcagggtgtgtgtgggaggtggggatgaggggcaggtgtatgtttatgtgtttgtgtgtaattactactttattcagtgtcagcagtgggaaagattgagttacttagagcagtgcttctcaaatggactatgtacaccagtcatctggggatcttgataaaatgcacattctgaattggcaggtctggaaggggacctgacattctggattccaacagtctcctacatcgtgctgatccttctggtcctcaggtccttctttgagcagcaygggcttagagcagtgatcagcaagtggctagatggcaaatatttgcagctctgcaggcaacagctccagaaatgccctgtgagctgccttctcatgtaaacccagcagtgggcctttgtctgtgactcgatttcctccttagggagacctagctggcgaggcctgcaactgagaaacaccaaaaatggtagtgaaagagcattgtatttttcaactaaaccaatttcctttaggatagaggtcaaaaaagctgtgctttgaaattagtcagctgtgggttcaattccatctccaaattgt

SEQ ID NO: 110820 - DNA, 601 bp, Human
agatggcaaatatttgcagctctgcaggcaacagctccagaaatgccctgtgagctgccttctcatgtaaacccagcagtgggcctttgtctgtgactcgatttcctccttagggagacctagctggcgaggcctgcaactgagaaacaccaaaaatggtagtgaaagagcattgtatttttcaactaaaccaatttcctttaggatagaggtcaaaaaagctgtgctttgaaattagtcagctgtgggttcaattccatctccaaattgtctgtgaactggagtttccttaagtacaaartggggctgagctgaccttggtagtgtgttatgttcatacatgcttgtacatgaagcatttagtcccaaaccatccaagcacagggtaaatgaaacaaaggacaactagtatacccttatgttttaaggtaaaaagggttttttgaggttttcgagggtagatagatgctcttggcattcctctaacaaacctaaatgtgattatttctcctgagtgactaaaactgtaaaactaactgtgattatctttgcttctatggatttaagagaaaacaaaacaactcactctgtaaacctccaa

SEQ ID NO: 110821 - DNA, 601 bp, Human
tgaccttggtagtgtgttatgttcatacatgcttgtacatgaagcatttagtcccaaaccatccaagcacagggtaaatgaaacaaaggacaactagtatacccttatgttttaaggtaaaaagggttttttgaggttttcgagggtagatagatgctcttggcattcctctaacaaacctaaatgtgattatttctcctgagtgactaaaactgtaaaactaactgtgattatctttgcttctatggatttaagagaaaacaaaacaactcactctgtaaacctccaaagaaaagccctycccttcgccccccacagattttcttgctgtttgtttctttacctcagtgtctcctactcaaagcataatgagtgctgtttttgctccagcaacaaggccctgcacaaagccaggcgggaggcctgtggatgaggtgctctgcaagctgagccagaagccttaggaaaatgcttgccaaacactgatgtttgactaattggtaatgtctgcggagttggcaccaggagaaaagaaagtaaagaggctggtggatgttgaggaaggaagacagacagacttgaagccaagcctcgagtgttt

SEQ ID NO: 110822 - DNA, 601 bp, Human
aactgtaaaactaactgtgattatctttgcttctatggatttaagagaaaacaaaacaactcactctgtaaacctccaaagaaaagccctccccttcgccccccacagattttcttgctgtttgtttctttacctcagtgtctcctactcaaagcataatgagtgctgtttttgctccagcaacaaggccctgcacaaagccaggcgggaggcctgtggatgaggtgctctgcaagctgagccagaagccttaggaaaatgcttgccaaacactgatgtttgactaattggtaatgtctgyggagttggcaccaggagaaaagaaagtaaagaggctggtggatgttgaggaaggaagacagacagacttgaagccaagcctcgagtgtttggagaaagagcctgcccaccatggagttcaaggaagcttgtcaaactgttttgaaatggtcggttaaacccctgaaggacagtgtgcccagatggccagcatttgatttagctgttcaggacagcaagagactgagacaggaagatgagcaaagtctcagatgtgccctcctgagtccagacagcttggtgtaaaattgtcctgtgaaac

SEQ ID NO: 110823 - DNA, 601 bp, Human
aaagccaggcgggaggcctgtggatgaggtgctctgcaagctgagccagaagccttaggaaaatgcttgccaaacactgatgtttgactaattggtaatgtctgcggagttggcaccaggagaaaagaaagtaaagaggctggtggatgttgaggaaggaagacagacagacttgaagccaagcctcgagtgtttggagaaagagcctgcccaccatggagttcaaggaagcttgtcaaactgttttgaaatggtcggttaaacccctgaaggacagtgtgcccagatggccagcatttgmtttagctgttcaggacagcaagagactgagacaggaagatgagcaaagtctcagatgtgccctcctgagtccagacagcttggtgtaaaattgtcctgtgaaaccctgttataacattttagtggcaccaaaaaagggtgctgggacaggggaaattccagcatgggccccatgctgtgtttggaaccagccatcctctgattgttgaactgaggtaactcacccagatgtttccctctttcaggcttagtgtcctctggaggaggagtagaaggaagggaggactcccctcctgccatg

SEQ ID NO: 110824 - DNA, 601 bp, Human
tctgtccagaggactactccacacagagtagtctgatgtgtccactttcagaagcagcaacttttaaaacgcagccaaacatgaagactcgcctccctaggaacccttctctggatccgttctcatctttgcaagttagcattgattgggcctcacctccttcagccatgctactctcttaggttatctcttggtcagagtggtctttctgaagctaaatcaataaataataatcaatgtgtggctctctcctgctcaaaattgttcaattgttcaattttgagcaggagagagctcaaaygtgacaatgagatgaggagtaattagaatattacagctggttggaggataagtggatacaacagttttgaaaaacaatttagcattagttagtaaagtgaaagaggcatatacctagtgacccagaaaaaaatatagctattgcctaggtatgtgtatgtgtacatgtgatgtgtgtatatatacacatctagtatatacatatacatcctagaaaaatgtgtacaagaatgttcctagcaacactattcaaatcagcaatagaatgcataaattcaaacaatgaaatactatacaacaa

SEQ ID NO: 110825 - DNA, 601 bp, Human
caatgaaattgtatagtagaaaaacatggatgaggcttaggattcatcctaacatagggtcagcaacagaagcatctgtctctgacaactaaaaacacatatgttttatataaatctcaaaacatgcaaaacaaccttttccttaatggatagaaatgtgataaaattcagaaggaaactgaggaaatgatgaaatggacgatggagttacttctgaaggaggaggaaatgggaaaggaaacttcaaaggaaaacatgatatgctttgtcttaaaagtatgtgagggaacttcgggggtgwtggaactattccatatcttgatcatagtggttttcccatgactgtatacatttgttaaaactcatagaactgtatgccaaaaagggtgaattttgtaggaggtaaagtatagctcagttgaaaatacccatgttaaagaaaagtatatggcggacacacagataatatttattatatatttttatataccttatgtataacttatattcttttacagctacgcaaggtactcaaaaaagtgatttttaaaacccctcagtggctcgctattttctcgggttagggtcagattgtttatgt

SEQ ID NO: 110826 - DNA, 601 bp, Human
cttatatcccctgggtctggcacatcataggagttcagaaggacttgtgaagttttgttgagatatgcaggaatcccctttgattccgtagggggaaaaacaatgggaagaaatgggtaagaggtggagagtctacatggtgataattacttcagacttggccagttctacaggccaagggtttgatatcctattactgtggtaacaaattaccgcacatttagcggcttgaactaacacaagtttactatcttgtagttctggaggtctgacgtccacaatgggtctcactgaactaagrtcaagaatttggcagcgctgcattcctttttggaggctctaggggagaaaccactttcttgtcatttccagctcctagaagctgcctgcattctttgacttgtggccacttccatcttcaaagccagccatggccagagtctttctcacattacattgctctgattgtaactcttcaggcttcctcttccactttaaaggagtcttgtaattacagcaggcccacctggattttccaggataatcttattttaggatcagctgattagtaatctcaattccatctgcaacttaaatttcc

SEQ ID NO: 110827 - DNA, 601 bp, Human
aataaatctttaaatcctggttttctcacttgtgatggtgagactcattcctgttgaaactttcagtgctcttagggggcttctcagagttcttcctcagaagcagcaataagtccttgctcatgtctagcaatttaagaaatgcttttactatgtgccagttgaagaaatgcctgactttatttggctcaatgcagctccaacttcctagagaattaaaggttcagtttattcttttataatcaatcatcagaaaatgagattattaacagtatagactttggaatcagtccatgttagytgaaaacccagcttcaccatttgttgacctaagactttgagcaaataaccaagagcatttgtaaaatgtgagtaatcatagtacctaccttaacagtagagaagtttggatgggtacctatgtaccgtgcttgggtactttgtacctggtatatagtaagtactacattcaataaatattaattattattactattattaatgggtcctcagttaccttactgagtctgagaagtactcagggtttttatactttttttccttaatagcataagtagagaaaggtcactgctcacaagcc

SEQ ID NO: 110828 - DNA, 601 bp, Human
gtgccagttgaagaaatgcctgactttatttggctcaatgcagctccaacttcctagagaattaaaggttcagtttattcttttataatcaatcatcagaaaatgagattattaacagtatagactttggaatcagtccatgttagttgaaaacccagcttcaccatttgttgacctaagactttgagcaaataaccaagagcatttgtaaaatgtgagtaatcatagtacctaccttaacagtagagaagtttggatgggtacctatgtaccgtgcttgggtactttgtacctggtatayagtaagtactacattcaataaatattaattattattactattattaatgggtcctcagttaccttactgagtctgagaagtactcagggtttttatactttttttccttaatagcataagtagagaaaggtcactgctcacaagccctgtgggaatgtcatgtgtgcttctcccgctcttcctgcttttccttcttccgtcaagtatctgggtgtaacaggttcccttatcagtggctttcctgggccccccggcacagtgtttgctgaacatacctgtttggatacacttttgtgacac

SEQ ID NO: 110829 - DNA, 601 bp, Human
tcactgggagcagaaatggtgaaaagtttgtggggtaagtggcagagggttcttcatgggagttttatgaaagtcactgtgacataggatttttagaagccctaggaaaagaaagttggggagttttccagtgaaatttggattgagaaagaaaagaaacccacattgtgctaaacaagatggtggatccagttcagagaaattgagtaacagacgaaattcccagaatcatgagaaaaactagtcaaagacttcccctggggagcacccggatcaaaaagctgactccggggcctctctmtacaggttgctgaggaggggcctgctgcagtaggaggctggaaggggtggtttggaactgagtcaagaaaagaccccaaacccacagggacagaggaagttgaaagaggggtttggcttagtggaagggaagggaggttggtcaagagaggcctgctgacaggaaagcggctgacaacaagaagcatctggaaagggccatttgatgctttaagctcatgccaagctaattgagtaatgtgagcttatgttcttgtaaattacttcaactgtatatagttcttcccctgagactgtctta

SEQ ID NO: 110830 - DNA, 601 bp, Human
aatttctaaattgtctacagtgagcccatgttgttttttaaatgatacttttgtaaaatttcaaaacaaagaagcttttccctggtactaataaggttctcatgctatatggagactatgggaaattagttacccaagacctagtttagcagctatcttcaccaaaaaccaattactacctggaaggttacttcagttagttcatctcatgccctgtgttgcttgtcagacactgatgtttagctgaacacaccaaaaaatcctcctcctcttccttctcctggtagattgtagaactgcycatctggaatttgggaaacaggcagacttgtctggctcatttgacatggtcattcccccgccccctcctcaaaatgccacttcagtaatctacacattacaggcaatatctccaaggggctgctaccttccctgagcactttcaacggcctttctttttgccttccctctttctggagtgtgtagatttttgtcctaaactgaagtcagtttttcaagcagttgctatgacagaatctacagttgtcgtagttgcactaagttcacttgagctattggtttcaagaaataggatgtaaga

SEQ ID NO: 110831 - DNA, 601 bp, Human
ttcaaaacaaagaagcttttccctggtactaataaggttctcatgctatatggagactatgggaaattagttacccaagacctagtttagcagctatcttcaccaaaaaccaattactacctggaaggttacttcagttagttcatctcatgccctgtgttgcttgtcagacactgatgtttagctgaacacaccaaaaaatcctcctcctcttccttctcctggtagattgtagaactgctcatctggaatttgggaaacaggcagacttgtctggctcatttgacatggtcattcccccgccccctcctcaaaatgccacttcagtaatctacacattacaggcaatatctccaaggggctgctaccttccctgagcactttcaacggcctttctttttgccttccctctttctggagtgtgtagatttttgtcctaaactgaagtcagtttttcaagcagttgctatgacagaatctacagttgtcgtagttgcactaagttcacttgagctattggtttcaagaaataggatgtaagaaatcagggattttattctgttgtctgtacattttgttgttgttgttgttgttgttgttt

SEQ ID NO: 110832 - DNA, 601 bp, Human
acaaagaagcttttccctggtactaataaggttctcatgctatatggagactatgggaaattagttacccaagacctagtttagcagctatcttcaccaaaaaccaattactacctggaaggttacttcagttagttcatctcatgccctgtgttgcttgtcagacactgatgtttagctgaacacaccaaaaaatcctcctcctcttccttctcctggtagattgtagaactgctcatctggaatttgggaaacaggcagacttgtctggctcatttgacatggtcattcccccgccccctcctcaaaatgccacttcagtaatctacacattacaggcaatatctccaaggggctgctaccttccctgagcactttcaacggcctttctttttgccttccctctttctggagtgtgtagatttttgtcctaaactgaagtcagtttttcaagcagttgctatgacagaatctacagttgtcgtagttgcactaagttcacttgagctattggtttcaagaaataggatgtaagaaatcagggattttattctgttgtctgtacattttgttgttgttgttgttgttgttgtttttcttg

SEQ ID NO: 110833 - DNA, 601 bp, Human
atgctatatggagactatgggaaattagttacccaagacctagtttagcagctatcttcaccaaaaaccaattactacctggaaggttacttcagttagttcatctcatgccctgtgttgcttgtcagacactgatgtttagctgaacacaccaaaaaatcctcctcctcttccttctcctggtagattgtagaactgctcatctggaatttgggaaacaggcagacttgtctggctcatttgacatggtcattcccccgccccctcctcaaaatgccacttcagtaatctacacattacrggcaatatctccaaggggctgctaccttccctgagcactttcaacggcctttctttttgccttccctctttctggagtgtgtagatttttgtcctaaactgaagtcagtttttcaagcagttgctatgacagaatctacagttgtcgtagttgcactaagttcacttgagctattggtttcaagaaataggatgtaagaaatcagggattttattctgttgtctgtacattttgttgttgttgttgttgttgttgtttttcttgagacggagtctcgttctgtcgcccaggctggagggc

SEQ ID NO: 110834 - DNA, 601 bp, Human
atatggagactatgggaaattagttacccaagacctagtttagcagctatcttcaccaaaaaccaattactacctggaaggttacttcagttagttcatctcatgccctgtgttgcttgtcagacactgatgtttagctgaacacaccaaaaaatcctcctcctcttccttctcctggtagattgtagaactgctcatctggaatttgggaaacaggcagacttgtctggctcatttgacatggtcattcccccgccccctcctcaaaatgccacttcagtaatctacacattacaggcawtatctccaaggggctgctaccttccctgagcactttcaacggcctttctttttgccttccctctttctggagtgtgtagatttttgtcctaaactgaagtcagtttttcaagcagttgctatgacagaatctacagttgtcgtagttgcactaagttcacttgagctattggtttcaagaaataggatgtaagaaatcagggattttattctgttgtctgtacattttgttgttgttgttgttgttgttgtttttcttgagacggagtctcgttctgtcgcccaggctggagggcagtgg

SEQ ID NO: 110835 - DNA, 601 bp, Human
cagctatcttcaccaaaaaccaattactacctggaaggttacttcagttagttcatctcatgccctgtgttgcttgtcagacactgatgtttagctgaacacaccaaaaaatcctcctcctcttccttctcctggtagattgtagaactgctcatctggaatttgggaaacaggcagacttgtctggctcatttgacatggtcattcccccgccccctcctcaaaatgccacttcagtaatctacacattacaggcaatatctccaaggggctgctaccttccctgagcactttcaacggmctttctttttgccttccctctttctggagtgtgtagatttttgtcctaaactgaagtcagtttttcaagcagttgctatgacagaatctacagttgtcgtagttgcactaagttcacttgagctattggtttcaagaaataggatgtaagaaatcagggattttattctgttgtctgtacattttgttgttgttgttgttgttgttgtttttcttgagacggagtctcgttctgtcgcccaggctggagggcagtggcatgatctcagctcacagcaacctctgccgtccaggttcaggt

SEQ ID NO: 110836 - DNA, 601 bp, Human
ctggtaaatgctcaataattgccatcttcccccttccactactgttcccaggaacataccaaaatttcataaaatgaatagtcccatgtgccaatttaatgggccaagctgaattattgggcggtcattgcttttctgccaacctagtgaaccccctgcagaaagcaggatgagttcagtgggttaccctttgatgtcataagtcatccttctcaccctgtgtaagctgaatatactcaaaaggaaaaagatcaatgaacccccaagttggcagtgtcttggtaacctgtgttggagtttwataattgtttatggatggatgtatggatgagtagatggatggacgaatggacatagagaaggcagagagggaagaaaggaggatagacggtgggtggatggaaaaaagggtaaattaagacaaagtcattgtatccttttttttctctgaagagatatgggggaaataatgattttacataagtcattgtagtcttttttctcaggtgaaatacaaacccaatataaaaacccctcatttctgttggaagtaagtaaagagacacattgtgatcttagtagcatattttatctgtttgag

SEQ ID NO: 110837 - DNA, 601 bp, Human
acatttctcacttctctaataatcagaataatctaattttcaatgtcatttaatgtactctattcaaggttataatagatcatatttctaataaaacacagcaattatgtaatgaataatacaggaggaccagcattcagattcccttgattttaaggcagtgccaagggaaggtcttagacaaacccatttctttaaatgtgatgcacattccaagtctttgcctgcattatagaggatgtttttttcctgctgatgatctgaatggaactttgccagaaaacttgacctcccccgacaaaaaaaaaaaaaaaaaaaaccttttgagaggcagcaagttttgaatccttttttaatatgtgttatcagtgcacctgaagaaaagtgacaggttgctaagttatttattgagtttctctagtaattgctgctttcttcccattttttatatacattcccaggagaaatactatattttagttctaaaaattttttccaatatccattatagcagcagctgacattatagatgttttagggtgagccacaaggtatctagtttggaggaagcttggctctatattttgagcccaatacctga

SEQ ID NO: 110838 - DNA, 601 bp, Human
gtacatggtagcaaaaacagtctgtgtgattaaaaatggcagttcctggagctgaccaaccattgtgcaatttcctgaatttggtcaaaagattatagggtaagtgggcaaacaggctgggcaagggaaagtcagcctggtgaaattaatgagaaaaatattattttagagtccagtgttcctttccagcttaagatctagacaaccttaaatgcatgcacagttaaaccatatgttctcaggataatgaaaatggctggggttgggggagggcggccaattcttgctgactgtgctttggttgttaattggaagggacttggtaaggggcggggggaacattctcgtgccagtggcttgttagggcaacttgacctctctgcctgcattccagatatttccaagatagctggccctgctttgcatatatctagatcaagtgggcaccccaaatctcttagtctggtttcctctctcaagttcttagaaggtcagttctcactcttcacctttctgcctactaaaatctacctggaggagataatactgcacccgtctaaaatgaaccaagggtatgataaaggtaatgaaagaaagaatt

SEQ ID NO: 110839 - DNA, 601 bp, Human
cgaagggctggggttgatgacagcagtgatgttgcctgttcatggcaaactgtccttacagctgagggagatgcaagagaagtctgggtcacacaccacagccctaatttgagaaactggtctgtgacagttggcaattatgagtttgaatttccataatggattggaatttctctcatctttgcatttcaaagccaagggcaaggaatagttattattttctcatagtaattcttgtaaacaattcctgatgtgcaaggtaggtcaacaaattacatggaaccattcttgcataaggcaktttctcacaatgacgtgctgtttgggtgtctttagagtaaacttgaaagaagttctccttctttgtgttttgcttccacatggcattgcattcacacacacacacacacacacacacacacacacacacacacacaattgccatgaaagtagagacttctgctttgagttcctctataggttatgtctacatcagcatctgttgcacagtagtagctcaataactattagtggaatgaataactgagtctatttcacattaagtcaatttctagaagtcaagagctagaagaaacaaaac

SEQ ID NO: 110840 - DNA, 601 bp, Human
cacccccaagtctggcttccatccttattgctctgctacaaatgttctctcgaaagtcacaactttctccattgccaaaaccaatgaactttgctccttcttcattctttctgactggcggctacttgaacacttggccaggctgctgctgcttcaaattcttttctccattggtttctgcggttttttattccaatttctcccacagttcatctgctttcatccccgtatccttttccctttcccatcaactactagcaattcccaaggattagttcctggcccttttttttttttttttatctttcctctctctcaccttagattgttcatcctcgcttacgacttcaacagtcatctctaaggtttgactcctaaataatctaactttggaggtgctctcttgccaaatccacaatgccattgctctgacagcctctggattcctaattcatgccccctcaaaccaaattcatcatattcctgccagaaactggcttccctactccccaccagctaccctacatttcttctctgttttgataccatcagtagcccaatacggggttaaaaccttattgttacctctaagtcgtcttct

SEQ ID NO: 110841 - DNA, 601 bp, Human
ccattttcattctgttgccaagtctagcatatttttccttgcggtgattcactatatctccccacttctctttgtcctcattatttctccccatcaatccctgtctccacatttttcttcagtgacaccagccactccactccccttcaaacatgatgtagtcattcttggaagtattttctcatatctcccccatccagaatgttttttcctccccttttggcctcctgaatgagaccccatcctttaaaggccaccgcaaacctaaattccatcatgtagccacgtttttccaaccctyaggcctttgcgcacattggtcccttcatccagaatgtctcctagcctctctaagccccattcatttaagaaatatatgttgaacattccttatggagaagatactggactgtgcactgaggatttctgagtgaataagacctagcatattcttataagggtattcagctcaagattcctctcttctgagatgttttttccctatggccccacaggctaaactatcagcttcctcatctgtgagtctcagtaccatcttacaacctgtcccttaggttttgaattcatattgcttgagtct

SEQ ID NO: 110842 - DNA, 601 bp, Human
ccccatccagaatgttttttcctccccttttggcctcctgaatgagaccccatcctttaaaggccaccgcaaacctaaattccatcatgtagccacgtttttccaaccctcaggcctttgcgcacattggtcccttcatccagaatgtctcctagcctctctaagccccattcatttaagaaatatatgttgaacattccttatggagaagatactggactgtgcactgaggatttctgagtgaataagacctagcatattcttataagggtattcagctcaagattcctctcttctgagrtgttttttccctatggccccacaggctaaactatcagcttcctcatctgtgagtctcagtaccatcttacaacctgtcccttaggttttgaattcatattgcttgagtctaagaatgaatatctcccttctgacatctagctcagtgcatgatagttatttctttagatgactgtgtcttttactagaatgtgaatctcttgaaatgataccttcttactcttgtgtctttaacatgcataatggcaaacaaagtgtaagtgctcaataactatttgagcagaagaagaaataaatagat

SEQ ID NO: 110843 - DNA, 601 bp, Human
ccatccagaatgttttttcctccccttttggcctcctgaatgagaccccatcctttaaaggccaccgcaaacctaaattccatcatgtagccacgtttttccaaccctcaggcctttgcgcacattggtcccttcatccagaatgtctcctagcctctctaagccccattcatttaagaaatatatgttgaacattccttatggagaagatactggactgtgcactgaggatttctgagtgaataagacctagcatattcttataagggtattcagctcaagattcctctcttctgagatkttttttccctatggccccacaggctaaactatcagcttcctcatctgtgagtctcagtaccatcttacaacctgtcccttaggttttgaattcatattgcttgagtctaagaatgaatatctcccttctgacatctagctcagtgcatgatagttatttctttagatgactgtgtcttttactagaatgtgaatctcttgaaatgataccttcttactcttgtgtctttaacatgcataatggcaaacaaagtgtaagtgctcaataactatttgagcagaagaagaaataaatagatgg

SEQ ID NO: 110844 - DNA, 601 bp, Human
tatttgactctgtttctttagtggctacaggactcaataaatgtttggtgaataaacaaattggtatagggctcccactatttttgttcatgttacattgtgttgcaatcatgtatatatctaaatatatatgagatcctgtgtgcaatgaacaaaaactgatgtcctcatttttcagataaggaaactgaggctcagagacattaagagactatcctgagcttacatagttagtacaataaatgacgagctaaaatgcaggcctttgaaattttatcccagggtccttccatttgtccawtgtttctttcatattatttaagacctatggggaacagtgccataatttctgtgtgttgtaacagatgtgggtgggatctttgagtggtaggaatgaccaattgttttctttcttgcctcaaatgctgaatagagggaaccatgtattcaaatatcctgtagcataaaaggcatttgggcacgtgttactgttgcataaaaacactctttacacagactgtattacacagattattgctgtgtaacaaactacccccaagctcagtggcttaaaactataagcttttgttactgttcacag

SEQ ID NO: 110845 - DNA, 601 bp, Human
tctttagtggctacaggactcaataaatgtttggtgaataaacaaattggtatagggctcccactatttttgttcatgttacattgtgttgcaatcatgtatatatctaaatatatatgagatcctgtgtgcaatgaacaaaaactgatgtcctcatttttcagataaggaaactgaggctcagagacattaagagactatcctgagcttacatagttagtacaataaatgacgagctaaaatgcaggcctttgaaattttatcccagggtccttccatttgtccattgtttctttcataytatttaagacctatggggaacagtgccataatttctgtgtgttgtaacagatgtgggtgggatctttgagtggtaggaatgaccaattgttttctttcttgcctcaaatgctgaatagagggaaccatgtattcaaatatcctgtagcataaaaggcatttgggcacgtgttactgttgcataaaaacactctttacacagactgtattacacagattattgctgtgtaacaaactacccccaagctcagtggcttaaaactataagcttttgttactgttcacagcaccatggatcagt

SEQ ID NO: 110846 - DNA, 601 bp, Human
tgttcatgttacattgtgttgcaatcatgtatatatctaaatatatatgagatcctgtgtgcaatgaacaaaaactgatgtcctcatttttcagataaggaaactgaggctcagagacattaagagactatcctgagcttacatagttagtacaataaatgacgagctaaaatgcaggcctttgaaattttatcccagggtccttccatttgtccattgtttctttcatattatttaagacctatggggaacagtgccataatttctgtgtgttgtaacagatgtgggtgggatctttgastggtaggaatgaccaattgttttctttcttgcctcaaatgctgaatagagggaaccatgtattcaaatatcctgtagcataaaaggcatttgggcacgtgttactgttgcataaaaacactctttacacagactgtattacacagattattgctgtgtaacaaactacccccaagctcagtggcttaaaactataagcttttgttactgttcacagcaccatggatcagtcgggttgtacttctgggttcactgggctctctactgggtaggcaactctgctgatcttacctgtgctctt

SEQ ID NO: 110847 - DNA, 601 bp, Human
ttgaaaggcagtctatgcctattccatgaaagaaatataaaggagtgtgcttgtatccctgctcaacttttttaccctgctcaacttttttaccctagatatatgggacccctatttgaagactattgattcctgaaccttagactgtcagccttttttcaaaaaagttaaaagacccactcacagtgtttcagatacacgagggcagcttgggcttcagcagaagtgaacttgagtttggcacagcgaagaatttcctgcctatgaaaattgattatggaagagatactaagcctttttyttttttctagatcagaggttttttaaaaacaaggtgaattgatcatacagtaagtgtgtgagtttattcctggttaaaaagcagagggccagccacagtgtctttaatttcctttttttaacattcagttttatgccataaataaaaggcttcatctcagctcttattcatattgggtagctctgtcacaaacacgaagccacagacacgtgtgcctctttggacaggatttaggcaaagtaatcattgagaatagcccattgctgccagaggaaatgtacaaagaagcaccgccgggta

SEQ ID NO: 110848 - DNA, 601 bp, Human
ggcagtctatgcctattccatgaaagaaatataaaggagtgtgcttgtatccctgctcaacttttttaccctgctcaacttttttaccctagatatatgggacccctatttgaagactattgattcctgaaccttagactgtcagccttttttcaaaaaagttaaaagacccactcacagtgtttcagatacacgagggcagcttgggcttcagcagaagtgaacttgagtttggcacagcgaagaatttcctgcctatgaaaattgattatggaagagatactaagccttttttttttttctagatcagaggttttttaaaaacaaggtgaattgatcatacagtaagtgtgtgagtttattcctggttaaaaagcagagggccagccacagtgtctttaatttcctttttttaacattcagttttatgccataaataaaaggcttcatctcagctcttattcatattgggtagctctgtcacaaacacgaagccacagacacgtgtgcctctttggacaggatttaggcaaagtaatcattgagaatagcccattgctgccagaggaaatgtacaaagaagcaccgccgggtatgaagg

SEQ ID NO: 110849 - DNA, 601 bp, Human
cctattccatgaaagaaatataaaggagtgtgcttgtatccctgctcaacttttttaccctgctcaacttttttaccctagatatatgggacccctatttgaagactattgattcctgaaccttagactgtcagccttttttcaaaaaagttaaaagacccactcacagtgtttcagatacacgagggcagcttgggcttcagcagaagtgaacttgagtttggcacagcgaagaatttcctgcctatgaaaattgattatggaagagatactaagccttttttttttttctagatcagargttttttaaaaacaaggtgaattgatcatacagtaagtgtgtgagtttattcctggttaaaaagcagagggccagccacagtgtctttaatttcctttttttaacattcagttttatgccataaataaaaggcttcatctcagctcttattcatattgggtagctctgtcacaaacacgaagccacagacacgtgtgcctctttggacaggatttaggcaaagtaatcattgagaatagcccattgctgccagaggaaatgtacaaagaagcaccgccgggtatgaaggaaagcatctca

SEQ ID NO: 110850 - DNA, 601 bp, Human
tgcatatcaaaaagtaaccagtgagggaaatatgattaaatttgttttgaaagtttcattagcataacataccactttaaccacaaagaagtatttgacgtctgtatattctgatatttcagagattttctataacttctttgaataattttaagaagctgagctaagctggaagatcatattaaactctcagaatgctgtgtccagactaatttcccccaagacttcaatattctgtaaaaattctaagcatgctccttgctcaattgctggcacaatggacaccaggtcatctcttagrcttcgaggttgtaggggcctcctgtcaccttttgaagtacttgcacatatgctacatgttgcagactcagagcagtcctcttaggattccattttgacctccattttacaaaccctgaaatcaaagtccctggaaatggaataacttgattcattcaacacatactcttcggcaccctaccctcagcctggtccaaaaggcacatgtctcatgagtggcaagaaaacttagctgcagcctcattcactgaccttttttctctgtatatttgttccaatttcaactggaattcacatggca

SEQ ID NO: 110851 - DNA, 601 bp, Human
tccttggtgtttaggtcatccatttcccccacggaagggccttacattcttcctgcataactaacccacataggcctttacagtagtctacctccttcccaccaagcccaccatctgtgtgtctccatgcaggtgctactgccatctcgggggaggctctgaaaggagctgtctcctctggagttgaccccaggtggtaagtggtggagctagcactagttccagatctcctgacttcccctgcagtacttgtatcgcccttgcctcccactgctggcctccaggggaacgagtccctgcmctgccccaggagccactgaccacgaggcctcaaagggaccaatagtcccaagaacttggacaaagctaccatccctaggcccccgtggcttcttgtgcactgtgtcacctccatgattctggtggttcttggcagcccttctcaaacactgcgtctgcgttcttctagagtttaaaaccattgagggaagcagctgctgaagccacgtgtttagaaaatttgtccgtcaacttatgaagctgtatgtaattggggcatcatcaccagaggggttgtccctgcattttgtgggtgtggaag

SEQ ID NO: 110852 - DNA, 601 bp, Human
taggttgctcacctacaatgctatggtaaacatactttaaaaacaaaatccaaatattgtagcacttgctggcttggtgaatggtgttctagaaaaatgatagcatgggaggtcctgaagatcaaaagacaaaatagtgataccagaaagaaaaaaaaaaaacagtgagcggcggggctttggagcagttcttggtgagcatggggtgtagtgcgctaggatgttggtggtatctgtaacacaataatggtgaccaggagcaggcccagaggggcgcccatggaatctggggccagcacamacctaggtggcttctcagatgaaaatgagactacacagttgggtggcaccagcttctgaagggctggcacccaccttaaacagacaagtctcctggctgagctcagagactttggctcacctggaagcagaggtagaaccttgagcagtacttttcaaaactcagcgtgcatctgaagcacctggtgaactcgttacagtgcaggttctggtgcagcaggcatggcctaggggcatttctaacaagctgccaggctgcttatgctgctggtctgcagaccagactctgaagagcaaatga

SEQ ID NO: 110853 - DNA, 601 bp, Human
actggacactgtaagggagctttcattttcacctgggagagaaagtggaatgtgaccccatgtatccagaacagaggcctggaaccacacgaatgtacttcaagtcctactcagccaccatcagccccatgacggtgaacaaattacctaacgtctctcagcctcagttttcccatctctaaatgggaataatgtgaaatagttgggaggatgaaatgagacaatttatgaaaagctgctgtgatggaacccaaaaatatctacccagcagtggagtggcagaaacatcatccagacacgyaccttctactggatactaactgaccctccagagacctggcccccatgctgggtgcatctgacaatacagaaaagtaacatgatgaataaccaatacctgaaagtatgccatttatttcttttagaaatacttactaattgccaaccattcagtggcatttcaggccctgtattgagctgtgtatcaaggtgagggcgtcttgacctaagaaatgagggaactcaggctggcacagtgggaaggggcgaaaagagaagatgagagaaaacaggtgctgtgcaatggtggactgtgttgagt

SEQ ID NO: 110854 - DNA, 601 bp, Human
aggctggcacagtgggaaggggcgaaaagagaagatgagagaaaacaggtgctgtgcaatggtggactgtgttgagttgagagcaagtgggaagtgagaatgggaaaagcctggcggagtcttgagtgccacttgaggagtctgtaaataatgaacagtaattgatggttgtggtcaaaaatctttattattatcattgtaatcattattacatctcatatttattgagcatttactatgtactagggaccatgctaagtactataagtatactaattcttttattccttatgaggactcygtgatttgggtttcgttgccctcatattacagatgcaaaagccaggtacagaaaggctcgataactttccccttgtctcttagtcaacaagtggtcagaggtgagacttgaacctaaacagtctgactccagggcagctcttttaaccactatactatacacagaatcccttgagagggttgccaaaaagggagaatggaagctggggccattggcggcatctagctaggaggagagagctgtgacccaggaataaatcaatcttgtagctccaagaaagtcagaggaaaagagatgaga

SEQ ID NO: 110855 - DNA, 601 bp, Human
ggcacagtgggaaggggcgaaaagagaagatgagagaaaacaggtgctgtgcaatggtggactgtgttgagttgagagcaagtgggaagtgagaatgggaaaagcctggcggagtcttgagtgccacttgaggagtctgtaaataatgaacagtaattgatggttgtggtcaaaaatctttattattatcattgtaatcattattacatctcatatttattgagcatttactatgtactagggaccatgctaagtactataagtatactaattcttttattccttatgaggactctgtgawttgggtttcgttgccctcatattacagatgcaaaagccaggtacagaaaggctcgataactttccccttgtctcttagtcaacaagtggtcagaggtgagacttgaacctaaacagtctgactccagggcagctcttttaaccactatactatacacagaatcccttgagagggttgccaaaaagggagaatggaagctggggccattggcggcatctagctaggaggagagagctgtgacccaggaataaatcaatcttgtagctccaagaaagtcagaggaaaagagatgagagtggg

SEQ ID NO: 110856 - DNA, 601 bp, Human
agagcaagtgggaagtgagaatgggaaaagcctggcggagtcttgagtgccacttgaggagtctgtaaataatgaacagtaattgatggttgtggtcaaaaatctttattattatcattgtaatcattattacatctcatatttattgagcatttactatgtactagggaccatgctaagtactataagtatactaattcttttattccttatgaggactctgtgatttgggtttcgttgccctcatattacagatgcaaaagccaggtacagaaaggctcgataactttccccttgtctyttagtcaacaagtggtcagaggtgagacttgaacctaaacagtctgactccagggcagctcttttaaccactatactatacacagaatcccttgagagggttgccaaaaagggagaatggaagctggggccattggcggcatctagctaggaggagagagctgtgacccaggaataaatcaatcttgtagctccaagaaagtcagaggaaaagagatgagagtggggaggtcttcctgaaagaggagacttttgatccaggtcatgaggtgagcgactttatatggcaatacctagggcc

SEQ ID NO: 110857 - DNA, 601 bp, Human
accctcctaaacacattgtggagacttcttgtacctcccagtcaggcagaaaaacagaaacacgattttatctctagagcgtggcccttcactactgggcatccttccggaggcctgctgcccaccgcggggtggagggcgctctgagccagtctcgcagctgaccgtgctcttcatttgtactatctctccccagatctagctgtgtttttattgtgagccacttaaaatcctttctggaagtcggtggtataaataaataacagcagccataacacattctctgcaagctcttagttcsgagttgagcatttttaaaaagagctttttttagacaggcagttgcttccacggcaggaaacttcctgtcatcttcaccagagtggcatccctgtcagatgcctttggaattagtgggcagagaggaataagaaaggcagccaactgcgcatctacagatctttgaaagagtagttcctttttcttccctaattagggtggatttgggacaaatggttgggtccccggagaccgcaggaatggctggaagaggcagaaacatatccccaccacccccacctcaggccagggcagggcactc

SEQ ID NO: 110858 - DNA, 601 bp, Human
agagctagtatccctgggaaggtttctacccaatgaccctccgccgccataaaaggagagagggtggattccctgtggaaaggtggaaagcaggagagaagctatttatagatgagctttccaaaatagaatcaggactgaaccagaggtaacatcctcgctctgaggacgtgttctccgcttccttagggtgaaccctagtgagtatcatttgggctttagggcctcataaattcaagctcaactcttatccctgctacttaggagtcatgtgactttggaaagttacatcatcatttgyacctcagctccttcatctgtataatgggagttttaaaaacatccacctcctgcctggagggttccatgagaaaaatatatggagcgccttgcacagtttccggcacagaggagtcgtgccgaatgtgcagctctcctcctctccaccccatcataaatgtcttgtcattttttcgagccacatgcccaggttctgtaaactagcgtgggtgtgacagtgggacagatttccaggtggtgtagcccccacccccagctcgtgctgtctgctccgggccgcctctgctcccggcctcccact

SEQ ID NO: 110859 - DNA, 601 bp, Human
gcacacataagtcctgatcttttgaagaaaaatgttctgtaggcactgtgctaagtacccacattcttcctcagtgatggaataagggaaagacgttcccagcaaaagcaatagcatgaacacggcacagggtttcacagggatggggctgggtgggagggaggcagagctaagtttgaggaggtaggtcagggctagcttcctaggggctttgggtgctgggataaggtgtgtgaacattagccctagggagccaagggaagtttctagtcatgagaaaaagcagttcgaagaaggtggygcctagctgctgtgtctggctggaaggcttcggcagggacacagggcagggcttttgatctttctcagatatgccctgcagctccagaaggcattcgtggccccttccagcagctgggaccactccagaattctagcatttcttggacatcctctagggccttggactatacccaccaccccacccctgcactcgaccaaggccccagatctctgaaccccaggagtgaaggggctgcagatggatagatggtcctttccaaggtcatgtcccagctcaggaatcttagacgatggtggt

SEQ ID NO: 110860 - DNA, 601 bp, Human
tccacgcttcgctggtgctccccacagccgccttcattaccaacccaagcaggccagggctctccatttgccgcagctggaagataatatataagccatttgaagcctcatgcctatgaatccagcagccagtataataaaacaccaggttattttgtgttttattaactgcctcttcccttcagtttgcataatagtgagttagatttacatgccgttaagacggctgtgcattatttttaatagaaggtacgacaggctcctctctctcagccctggcgcgtgataaagttacctcatscaatgttgatgaaggtttcgttcacacttgctgggtcggggcaatgtctttttttccagatggatactctattgtaaaatgatttccctccataagcttgactctccgtccctctcttccgtgtcatcttcctacgaaccggataaactgcctattaaatttaattacggcccaaatggccacacatcttgatctcatgttccctcaagtgtactgtataccaccaaggtccttgaggaaggaataaaataaatctggaggatgcatgtctactctccacaaggaacgtcgtggaaggca

SEQ ID NO: 110861 - DNA, 601 bp, Human
tgccgttaagacggctgtgcattatttttaatagaaggtacgacaggctcctctctctcagccctggcgcgtgataaagttacctcatgcaatgttgatgaaggtttcgttcacacttgctgggtcggggcaatgtctttttttccagatggatactctattgtaaaatgatttccctccataagcttgactctccgtccctctcttccgtgtcatcttcctacgaaccggataaactgcctattaaatttaattacggcccaaatggccacacatcttgatctcatgttccctcaagtgyactgtataccaccaaggtccttgaggaaggaataaaataaatctggaggatgcatgtctactctccacaaggaacgtcgtggaaggcaaagttgaccaccttcgtttttacagtgtctgtggcacctcgtgcaaactcttctttctggctttccatgcagacgttcaaagcaagagctagttttattcacttcctgtagactgattttaactgaggtggggaactaaagatatcagtttgagaaacacagtacctctcctgagctgtttacatttgtcagagaaccaaacgtcagccttt

SEQ ID NO: 110862 - DNA, 601 bp, Human
aggtttcgttcacacttgctgggtcggggcaatgtctttttttccagatggatactctattgtaaaatgatttccctccataagcttgactctccgtccctctcttccgtgtcatcttcctacgaaccggataaactgcctattaaatttaattacggcccaaatggccacacatcttgatctcatgttccctcaagtgtactgtataccaccaaggtccttgaggaaggaataaaataaatctggaggatgcatgtctactctccacaaggaacgtcgtggaaggcaaagttgaccaccwtcgtttttacagtgtctgtggcacctcgtgcaaactcttctttctggctttccatgcagacgttcaaagcaagagctagttttattcacttcctgtagactgattttaactgaggtggggaactaaagatatcagtttgagaaacacagtacctctcctgagctgtttacatttgtcagagaaccaaacgtcagccttttgttggatagtaaattacaaatatctcatcattttatctgtaaatatcttaatatgtattctaaatgaaagaagctcctgcaaacgaaagtaaagcatcag

SEQ ID NO: 110863 - DNA, 601 bp, Human
ccaaacgtcagccttttgttggatagtaaattacaaatatctcatcattttatctgtaaatatcttaatatgtattctaaatgaaagaagctcctgcaaacgaaagtaaagcatcagtgccattattaccatcctaaaataaaatgatctctaacacctaatagctcatatttctggttttctcatatatatcaccacctctttacagtttattttttgaattaaaatttagataaggtttacaccatgcaattggttgtcagttttctcagtatcttaagtcaggtttattgcagtatawtttacataatgtaatttttatcttttttaaaggtatagtttgatgagtgtgataaaagtatacagtcacataacctgactccagtcaagatgtagaatatttccattgctccagagagtttccttgtgcacctgtggtcagtccccacctgccttcccgctcctggaaaaccactgaactgttctcaatcactatagttttgccttttccagaacgtcatataaatggaatcgttttgagtatgggcgttttatgtctgccttctttggtttagcatgcttccaaggtttatccatgttg

SEQ ID NO: 110864 - DNA, 601 bp, Human
tgatctctaacacctaatagctcatatttctggttttctcatatatatcaccacctctttacagtttattttttgaattaaaatttagataaggtttacaccatgcaattggttgtcagttttctcagtatcttaagtcaggtttattgcagtatattttacataatgtaatttttatcttttttaaaggtatagtttgatgagtgtgataaaagtatacagtcacataacctgactccagtcaagatgtagaatatttccattgctccagagagtttccttgtgcacctgtggtcagtcsccacctgccttcccgctcctggaaaaccactgaactgttctcaatcactatagttttgccttttccagaacgtcatataaatggaatcgttttgagtatgggcgttttatgtctgccttctttggtttagcatgcttccaaggtttatccatgttgtagcatgtattacagtttccttccttattaacgctacctagcattttcattgcaaagttgtaatcacaatttatttatccacccatcagttaatgagcatttgggttgagttgctttcaatctatagatttctctctccacttg

SEQ ID NO: 110865 - DNA, 601 bp, Human
tttcatgggtggtggtgtgtttttccatcaggacatcagcatgacaggtggcgtgtttttaagagattaacaagtactgatggtcaatgcttagagccattcattcatcagagttagaaaatggtgactcctcattcctttcttgtttgttagctggataactgcatacagagatacttcctctcctctgttacttgattatccagtggtacaggcataagattttaagtgttttaaaaggatgaatccgaccggacacagtggctcacgcctgtaatcccagcactttgggaggccgagrcgggtgaatcatgaggtcaggagatcgagaccatcctggctaacacggtgaaaccctggctctgctaaaaatacaaaaggttagctgggcatggtggcacacgcctgtaatcccagctacttgggaagctgaggcaggagaatcgtttgaacccgggaggtggaggttgcagtgagctgagatcgtgctactgcactccagcctgggtgacagagcgagactccgtctcacacacacaaaaaaaggatgaatccaggctaaaaaaaatgtagctgtcccaccaacaacctgcctgctcaa

SEQ ID NO: 110866 - DNA, 601 bp, Human
ccaagatattagcagagactggagttaccaccacagtgtctgagtggtctgtgaggtgactcacagcaaatcaagtccacagcaagcaatgctgtgtcattctgacagccctgcatcacgcagccacccagcagggcctggagccttcccaggcctcaggctctgaccttgaccttctgcttgtttcttaatccttcttttgtctagttgccagatgatgacagtttgtgatactcagccccaacatatggagtgagaggtatgctttgagatcctccgggaaagtgtcttatttctgcayagccacacacttagtgatcagggtgcagtctccacaagatttaaatccccttcctcaatttagaaatccccttcctgcctccagcacctctcttcccacatctcagcttacactgaatcctgcagcactcttccagccccatggatccaagcattagccattagccccttggtagagtcagtagaacagaaaccaatttttgtgaccttggtgaagttatttaacttctctaagcctctgtttacctatgtacaaaatagaaatgcaaatcaacaaggcattaaataaggtaattactta

SEQ ID NO: 110867 - DNA, 601 bp, Human
attccattgatctgaagttcaagaacttgcaaaactaacttgtaggaatataggtcaaataatggttacttctgaggaagaggtttgattaggagaagtcaaaggagccggtaggtgctggaaatattcatatcttgatctaggtagtagttgcacagatacatggttagggagaatgccttaagctgtactcgagatttgtgtgcagctccaggcatgtgtgctatattcattatctattgcagtgtaacaaaataccacaaaacttagcagcttaaaacataagcattattatctcccrtagtcacagtgggtcaggaatctggtactgacttcattgggtggttctggctcggtatctgtcatgaaatagcaatcaagaccccggccagagctgcagtcatctaaagaattccagaggctggaagctctccgcctccacaatcgctcatcacatttgtctaggaatttagtgctggttattgatgggaggactcagtttcttcctctgtggacctgtccgtggggctggttaactgtcctcttgaaatgtcagctagcttccccagagcaagagattcaagagacagcaagcaagaag

SEQ ID NO: 110868 - DNA, 601 bp, Human; identical to SEQ ID NO: 20558

SEQ ID NO: 110869 - DNA, 601 bp, Human; identical to SEQ ID NO: 20559

SEQ ID NO: 110870 - DNA, 601 bp, Human; identical to SEQ ID NO: 20560

SEQ ID NO: 110871 - DNA, 601 bp, Human; identical to SEQ ID NO: 110710

SEQ ID NO: 110872 - DNA, 601 bp, Human; identical to SEQ ID NO: 110711

SEQ ID NO: 110873 - DNA, 601 bp, Human; identical to SEQ ID NO: 110712

SEQ ID NO: 110874 - DNA, 601 bp, Human; identical to SEQ ID NO: 110713

SEQ ID NO: 110875 - DNA, 601 bp, Human; identical to SEQ ID NO: 110714

SEQ ID NO: 110876 - DNA, 601 bp, Human; identical to SEQ ID NO: 110715

SEQ ID NO: 110877 - DNA, 601 bp, Human; identical to SEQ ID NO: 110716

SEQ ID NO: 110878 - DNA, 601 bp, Human; identical to SEQ ID NO: 110717

SEQ ID NO: 110879 - DNA, 601 bp, Human; identical to SEQ ID NO: 110718

SEQ ID NO: 110880 - DNA, 601 bp, Human; identical to SEQ ID NO: 110719

SEQ ID NO: 110881 - DNA, 601 bp, Human; identical to SEQ ID NO: 110720

SEQ ID NO: 110882 - DNA, 601 bp, Human; identical to SEQ ID NO: 110721

SEQ ID NO: 110883 - DNA, 601 bp, Human; identical to SEQ ID NO: 110722

SEQ ID NO: 110884 - DNA, 601 bp, Human; identical to SEQ ID NO: 110723

SEQ ID NO: 110885 - DNA, 601 bp, Human; identical to SEQ ID NO: 110724

SEQ ID NO: 110886 - DNA, 601 bp, Human; identical to SEQ ID NO: 110725

SEQ ID NO: 110887 - DNA, 601 bp, Human; identical to SEQ ID NO: 110726

SEQ ID NO: 110888 - DNA, 601 bp, Human; identical to SEQ ID NO: 110727

SEQ ID NO: 110889 - DNA, 601 bp, Human; identical to SEQ ID NO: 110728

SEQ ID NO: 110890 - DNA, 601 bp, Human; identical to SEQ ID NO: 110729

SEQ ID NO: 110891 - DNA, 601 bp, Human; identical to SEQ ID NO: 110730

SEQ ID NO: 110892 - DNA, 601 bp, Human; identical to SEQ ID NO: 110731

SEQ ID NO: 110893 - DNA, 601 bp, Human; identical to SEQ ID NO: 110732

SEQ ID NO: 110894 - DNA, 601 bp, Human; identical to SEQ ID NO: 110733

SEQ ID NO: 110895 - DNA, 601 bp, Human; identical to SEQ ID NO: 110734

SEQ ID NO: 110896 - DNA, 601 bp, Human; identical to SEQ ID NO: 110735

SEQ ID NO: 110897 - DNA, 601 bp, Human; identical to SEQ ID NO: 110736

SEQ ID NO: 110898 - DNA, 601 bp, Human; identical to SEQ ID NO: 110737

SEQ ID NO: 110899 - DNA, 601 bp, Human; identical to SEQ ID NO: 110738

SEQ ID NO: 110900 - DNA, 601 bp, Human; identical to SEQ ID NO: 110739

SEQ ID NO: 110901 - DNA, 601 bp, Human; identical to SEQ ID NO: 110740

SEQ ID NO: 110902 - DNA, 601 bp, Human; identical to SEQ ID NO: 110741

SEQ ID NO: 110903 - DNA, 601 bp, Human; identical to SEQ ID NO: 110742

SEQ ID NO: 110904 - DNA, 601 bp, Human; identical to SEQ ID NO: 110743

SEQ ID NO: 110905 - DNA, 601 bp, Human; identical to SEQ ID NO: 110744

SEQ ID NO: 110906 - DNA, 601 bp, Human; identical to SEQ ID NO: 110745

SEQ ID NO: 110907 - DNA, 601 bp, Human; identical to SEQ ID NO: 110746

SEQ ID NO: 110908 - DNA, 601 bp, Human; identical to SEQ ID NO: 110747

SEQ ID NO: 110909 - DNA, 601 bp, Human; identical to SEQ ID NO: 110748

SEQ ID NO: 110910 - DNA, 601 bp, Human; identical to SEQ ID NO: 110749

SEQ ID NO: 110911 - DNA, 601 bp, Human; identical to SEQ ID NO: 110750

SEQ ID NO: 110912 - DNA, 601 bp, Human; identical to SEQ ID NO: 110751

SEQ ID NO: 110913 - DNA, 601 bp, Human; identical to SEQ ID NO: 110752

SEQ ID NO: 110914 - DNA, 601 bp, Human; identical to SEQ ID NO: 110753

SEQ ID NO: 110915 - DNA, 601 bp, Human; identical to SEQ ID NO: 110754

SEQ ID NO: 110916 - DNA, 601 bp, Human; identical to SEQ ID NO: 110755

SEQ ID NO: 110917 - DNA, 601 bp, Human; identical to SEQ ID NO: 110756

SEQ ID NO: 110918 - DNA, 601 bp, Human; identical to SEQ ID NO: 110757

SEQ ID NO: 110919 - DNA, 601 bp, Human; identical to SEQ ID NO: 110758

SEQ ID NO: 110920 - DNA, 601 bp, Human; identical to SEQ ID NO: 110759

SEQ ID NO: 110921 - DNA, 601 bp, Human; identical to SEQ ID NO: 110760

SEQ ID NO: 110922 - DNA, 601 bp, Human; identical to SEQ ID NO: 110761

SEQ ID NO: 110923 - DNA, 601 bp, Human; identical to SEQ ID NO: 110762

SEQ ID NO: 110924 - DNA, 601 bp, Human; identical to SEQ ID NO: 110763

SEQ ID NO: 110925 - DNA, 601 bp, Human; identical to SEQ ID NO: 110764

SEQ ID NO: 110926 - DNA, 601 bp, Human; identical to SEQ ID NO: 110765

SEQ ID NO: 110927 - DNA, 601 bp, Human; identical to SEQ ID NO: 110766

SEQ ID NO: 110928 - DNA, 601 bp, Human; identical to SEQ ID NO: 110767

SEQ ID NO: 110929 - DNA, 601 bp, Human; identical to SEQ ID NO: 110768

SEQ ID NO: 110930 - DNA, 601 bp, Human; identical to SEQ ID NO: 110769

SEQ ID NO: 110931 - DNA, 601 bp, Human; identical to SEQ ID NO: 110770

SEQ ID NO: 110932 - DNA, 601 bp, Human; identical to SEQ ID NO: 110771

SEQ ID NO: 110933 - DNA, 601 bp, Human; identical to SEQ ID NO: 110772

SEQ ID NO: 110934 - DNA, 601 bp, Human; identical to SEQ ID NO: 110773

SEQ ID NO: 110935 - DNA, 601 bp, Human; identical to SEQ ID NO: 110774

SEQ ID NO: 110936 - DNA, 601 bp, Human; identical to SEQ ID NO: 110775

SEQ ID NO: 110937 - DNA, 601 bp, Human; identical to SEQ ID NO: 110776

SEQ ID NO: 110938 - DNA, 601 bp, Human; identical to SEQ ID NO: 110777

SEQ ID NO: 110939 - DNA, 601 bp, Human; identical to SEQ ID NO: 110778

SEQ ID NO: 110940 - DNA, 601 bp, Human; identical to SEQ ID NO: 110779

SEQ ID NO: 110941 - DNA, 601 bp, Human; identical to SEQ ID NO: 110780

SEQ ID NO: 110942 - DNA, 601 bp, Human; identical to SEQ ID NO: 110781

SEQ ID NO: 110943 - DNA, 601 bp, Human; identical to SEQ ID NO: 110782

SEQ ID NO: 110944 - DNA, 601 bp, Human; identical to SEQ ID NO: 110783

SEQ ID NO: 110945 - DNA, 601 bp, Human; identical to SEQ ID NO: 110784

SEQ ID NO: 110946 - DNA, 601 bp, Human; identical to SEQ ID NO: 110785

SEQ ID NO: 110947 - DNA, 601 bp, Human; identical to SEQ ID NO: 110786

SEQ ID NO: 110948 - DNA, 601 bp, Human; identical to SEQ ID NO: 110787

SEQ ID NO: 110949 - DNA, 601 bp, Human; identical to SEQ ID NO: 110788

SEQ ID NO: 110950 - DNA, 601 bp, Human; identical to SEQ ID NO: 110789

SEQ ID NO: 110951 - DNA, 601 bp, Human; identical to SEQ ID NO: 110790

SEQ ID NO: 110952 - DNA, 601 bp, Human; identical to SEQ ID NO: 110791

SEQ ID NO: 110953 - DNA, 601 bp, Human; identical to SEQ ID NO: 110792

SEQ ID NO: 110954 - DNA, 601 bp, Human; identical to SEQ ID NO: 110793

SEQ ID NO: 110955 - DNA, 601 bp, Human; identical to SEQ ID NO: 110794

SEQ ID NO: 110956 - DNA, 601 bp, Human; identical to SEQ ID NO: 110795

SEQ ID NO: 110957 - DNA, 601 bp, Human; identical to SEQ ID NO: 110796

SEQ ID NO: 110958 - DNA, 601 bp, Human; identical to SEQ ID NO: 110797

SEQ ID NO: 110959 - DNA, 601 bp, Human; identical to SEQ ID NO: 110798

SEQ ID NO: 110960 - DNA, 601 bp, Human; identical to SEQ ID NO: 110799

SEQ ID NO: 110961 - DNA, 601 bp, Human; identical to SEQ ID NO: 110800

SEQ ID NO: 110962 - DNA, 601 bp, Human; identical to SEQ ID NO: 110801

SEQ ID NO: 110963 - DNA, 601 bp, Human; identical to SEQ ID NO: 110802

SEQ ID NO: 110964 - DNA, 601 bp, Human; identical to SEQ ID NO: 110803

SEQ ID NO: 110965 - DNA, 601 bp, Human; identical to SEQ ID NO: 110804

SEQ ID NO: 110966 - DNA, 601 bp, Human; identical to SEQ ID NO: 110805

SEQ ID NO: 110967 - DNA, 601 bp, Human; identical to SEQ ID NO: 110806

SEQ ID NO: 110968 - DNA, 601 bp, Human; identical to SEQ ID NO: 110807

SEQ ID NO: 110969 - DNA, 601 bp, Human; identical to SEQ ID NO: 110808

SEQ ID NO: 110970 - DNA, 601 bp, Human; identical to SEQ ID NO: 110809

SEQ ID NO: 110971 - DNA, 601 bp, Human; identical to SEQ ID NO: 110810

SEQ ID NO: 110972 - DNA, 601 bp, Human; identical to SEQ ID NO: 110811

SEQ ID NO: 110973 - DNA, 601 bp, Human; identical to SEQ ID NO: 110812

SEQ ID NO: 110974 - DNA, 601 bp, Human; identical to SEQ ID NO: 110813

SEQ ID NO: 110975 - DNA, 601 bp, Human; identical to SEQ ID NO: 110814

SEQ ID NO: 110976 - DNA, 601 bp, Human; identical to SEQ ID NO: 110815

SEQ ID NO: 110977 - DNA, 601 bp, Human; identical to SEQ ID NO: 110816

SEQ ID NO: 110978 - DNA, 601 bp, Human; identical to SEQ ID NO: 110817

SEQ ID NO: 110979 - DNA, 601 bp, Human; identical to SEQ ID NO: 110818

SEQ ID NO: 110980 - DNA, 601 bp, Human; identical to SEQ ID NO: 110819

SEQ ID NO: 110981 - DNA, 601 bp, Human; identical to SEQ ID NO: 110820

SEQ ID NO: 110982 - DNA, 601 bp, Human; identical to SEQ ID NO: 110821

SEQ ID NO: 110983 - DNA, 601 bp, Human; identical to SEQ ID NO: 110822

SEQ ID NO: 110984 - DNA, 601 bp, Human; identical to SEQ ID NO: 110823

SEQ ID NO: 110985 - DNA, 601 bp, Human; identical to SEQ ID NO: 110824

SEQ ID NO: 110986 - DNA, 601 bp, Human; identical to SEQ ID NO: 110825

SEQ ID NO: 110987 - DNA, 601 bp, Human; identical to SEQ ID NO: 110826

SEQ ID NO: 110988 - DNA, 601 bp, Human; identical to SEQ ID NO: 110827

SEQ ID NO: 110989 - DNA, 601 bp, Human; identical to SEQ ID NO: 110828

SEQ ID NO: 110990 - DNA, 601 bp, Human; identical to SEQ ID NO: 110829

SEQ ID NO: 110991 - DNA, 601 bp, Human; identical to SEQ ID NO: 110830

SEQ ID NO: 110992 - DNA, 601 bp, Human; identical to SEQ ID NO: 110831

SEQ ID NO: 110993 - DNA, 601 bp, Human; identical to SEQ ID NO: 110832

SEQ ID NO: 110994 - DNA, 601 bp, Human; identical to SEQ ID NO: 110833

SEQ ID NO: 110995 - DNA, 601 bp, Human; identical to SEQ ID NO: 110834

SEQ ID NO: 110996 - DNA, 601 bp, Human; identical to SEQ ID NO: 110835

SEQ ID NO: 110997 - DNA, 601 bp, Human; identical to SEQ ID NO: 110836

SEQ ID NO: 110998 - DNA, 601 bp, Human; identical to SEQ ID NO: 110837

SEQ ID NO: 110999 - DNA, 601 bp, Human; identical to SEQ ID NO: 110838

SEQ ID NO: 111000 - DNA, 601 bp, Human; identical to SEQ ID NO: 110839

SEQ ID NO: 111001 - DNA, 601 bp, Human; identical to SEQ ID NO: 110840

SEQ ID NO: 111002 - DNA, 601 bp, Human; identical to SEQ ID NO: 110841

SEQ ID NO: 111003 - DNA, 601 bp, Human; identical to SEQ ID NO: 110842

SEQ ID NO: 111004 - DNA, 601 bp, Human; identical to SEQ ID NO: 110843

SEQ ID NO: 111005 - DNA, 601 bp, Human; identical to SEQ ID NO: 110844

SEQ ID NO: 111006 - DNA, 601 bp, Human; identical to SEQ ID NO: 110845

SEQ ID NO: 111007 - DNA, 601 bp, Human; identical to SEQ ID NO: 110846

SEQ ID NO: 111008 - DNA, 601 bp, Human; identical to SEQ ID NO: 110847

SEQ ID NO: 111009 - DNA, 601 bp, Human; identical to SEQ ID NO: 110848

SEQ ID NO: 111010 - DNA, 601 bp, Human; identical to SEQ ID NO: 110849

SEQ ID NO: 111011 - DNA, 601 bp, Human; identical to SEQ ID NO: 110850

SEQ ID NO: 111012 - DNA, 601 bp, Human; identical to SEQ ID NO: 110851

SEQ ID NO: 111013 - DNA, 601 bp, Human; identical to SEQ ID NO: 110852

SEQ ID NO: 111014 - DNA, 601 bp, Human; identical to SEQ ID NO: 110853

SEQ ID NO: 111015 - DNA, 601 bp, Human; identical to SEQ ID NO: 110854

SEQ ID NO: 111016 - DNA, 601 bp, Human; identical to SEQ ID NO: 110855

SEQ ID NO: 111017 - DNA, 601 bp, Human; identical to SEQ ID NO: 110856

SEQ ID NO: 111018 - DNA, 601 bp, Human; identical to SEQ ID NO: 110857

SEQ ID NO: 111019 - DNA, 601 bp, Human; identical to SEQ ID NO: 110858

SEQ ID NO: 111020 - DNA, 601 bp, Human; identical to SEQ ID NO: 110859

SEQ ID NO: 111021 - DNA, 601 bp, Human; identical to SEQ ID NO: 110860

SEQ ID NO: 111022 - DNA, 601 bp, Human; identical to SEQ ID NO: 110861

SEQ ID NO: 111023 - DNA, 601 bp, Human; identical to SEQ ID NO: 110862

SEQ ID NO: 111024 - DNA, 601 bp, Human; identical to SEQ ID NO: 110863

SEQ ID NO: 111025 - DNA, 601 bp, Human; identical to SEQ ID NO: 110864

SEQ ID NO: 111026 - DNA, 601 bp, Human; identical to SEQ ID NO: 110865

SEQ ID NO: 111027 - DNA, 601 bp, Human; identical to SEQ ID NO: 110866

SEQ ID NO: 111028 - DNA, 601 bp, Human; identical to SEQ ID NO: 110867

SEQ ID NO: 111029 - DNA, 601 bp, Human; identical to SEQ ID NO: 20558

SEQ ID NO: 111030 - DNA, 601 bp, Human; identical to SEQ ID NO: 20559

SEQ ID NO: 111031 - DNA, 601 bp, Human; identical to SEQ ID NO: 20560

SEQ ID NO: 111032 - DNA, 601 bp, Human; identical to SEQ ID NO: 110710

SEQ ID NO: 111033 - DNA, 601 bp, Human; identical to SEQ ID NO: 110711

SEQ ID NO: 111034 - DNA, 601 bp, Human; identical to SEQ ID NO: 110712

SEQ ID NO: 111035 - DNA, 601 bp, Human; identical to SEQ ID NO: 110713

SEQ ID NO: 111036 - DNA, 601 bp, Human; identical to SEQ ID NO: 110714

SEQ ID NO: 111037 - DNA, 601 bp, Human; identical to SEQ ID NO: 110715

SEQ ID NO: 111038 - DNA, 601 bp, Human; identical to SEQ ID NO: 110716

SEQ ID NO: 111039 - DNA, 601 bp, Human; identical to SEQ ID NO: 110717

SEQ ID NO: 111040 - DNA, 601 bp, Human; identical to SEQ ID NO: 110718

SEQ ID NO: 111041 - DNA, 601 bp, Human; identical to SEQ ID NO: 110719

SEQ ID NO: 111042 - DNA, 601 bp, Human; identical to SEQ ID NO: 110720

SEQ ID NO: 111043 - DNA, 601 bp, Human; identical to SEQ ID NO: 110721

SEQ ID NO: 111044 - DNA, 601 bp, Human; identical to SEQ ID NO: 110722

SEQ ID NO: 111045 - DNA, 601 bp, Human; identical to SEQ ID NO: 110723

SEQ ID NO: 111046 - DNA, 601 bp, Human; identical to SEQ ID NO: 110724

SEQ ID NO: 111047 - DNA, 601 bp, Human; identical to SEQ ID NO: 110725

SEQ ID NO: 111048 - DNA, 601 bp, Human; identical to SEQ ID NO: 110726

SEQ ID NO: 111049 - DNA, 601 bp, Human; identical to SEQ ID NO: 110727

SEQ ID NO: 111050 - DNA, 601 bp, Human; identical to SEQ ID NO: 110728

SEQ ID NO: 111051 - DNA, 601 bp, Human; identical to SEQ ID NO: 110729

SEQ ID NO: 111052 - DNA, 601 bp, Human; identical to SEQ ID NO: 110730

SEQ ID NO: 111053 - DNA, 601 bp, Human; identical to SEQ ID NO: 110731

SEQ ID NO: 111054 - DNA, 601 bp, Human; identical to SEQ ID NO: 110732

SEQ ID NO: 111055 - DNA, 601 bp, Human; identical to SEQ ID NO: 110733

SEQ ID NO: 111056 - DNA, 601 bp, Human; identical to SEQ ID NO: 110734

SEQ ID NO: 111057 - DNA, 601 bp, Human; identical to SEQ ID NO: 110735

SEQ ID NO: 111058 - DNA, 601 bp, Human; identical to SEQ ID NO: 110736

SEQ ID NO: 111059 - DNA, 601 bp, Human; identical to SEQ ID NO: 110737

SEQ ID NO: 111060 - DNA, 601 bp, Human; identical to SEQ ID NO: 110738

SEQ ID NO: 111061 - DNA, 601 bp, Human; identical to SEQ ID NO: 110739

SEQ ID NO: 111062 - DNA, 601 bp, Human; identical to SEQ ID NO: 110740

SEQ ID NO: 111063 - DNA, 601 bp, Human; identical to SEQ ID NO: 110741

SEQ ID NO: 111064 - DNA, 601 bp, Human; identical to SEQ ID NO: 110742

SEQ ID NO: 111065 - DNA, 601 bp, Human; identical to SEQ ID NO: 110743

SEQ ID NO: 111066 - DNA, 601 bp, Human; identical to SEQ ID NO: 110744

SEQ ID NO: 111067 - DNA, 601 bp, Human; identical to SEQ ID NO: 110745

SEQ ID NO: 111068 - DNA, 601 bp, Human; identical to SEQ ID NO: 110746

SEQ ID NO: 111069 - DNA, 601 bp, Human; identical to SEQ ID NO: 110747

SEQ ID NO: 111070 - DNA, 601 bp, Human; identical to SEQ ID NO: 110748

SEQ ID NO: 111071 - DNA, 601 bp, Human; identical to SEQ ID NO: 110749

SEQ ID NO: 111072 - DNA, 601 bp, Human; identical to SEQ ID NO: 110750

SEQ ID NO: 111073 - DNA, 601 bp, Human; identical to SEQ ID NO: 110751

SEQ ID NO: 111074 - DNA, 601 bp, Human; identical to SEQ ID NO: 110752

SEQ ID NO: 111075 - DNA, 601 bp, Human; identical to SEQ ID NO: 110753

SEQ ID NO: 111076 - DNA, 601 bp, Human; identical to SEQ ID NO: 110754

SEQ ID NO: 111077 - DNA, 601 bp, Human; identical to SEQ ID NO: 110755

SEQ ID NO: 111078 - DNA, 601 bp, Human; identical to SEQ ID NO: 110756

SEQ ID NO: 111079 - DNA, 601 bp, Human; identical to SEQ ID NO: 110757

SEQ ID NO: 111080 - DNA, 601 bp, Human; identical to SEQ ID NO: 110758

SEQ ID NO: 111081 - DNA, 601 bp, Human; identical to SEQ ID NO: 110759

SEQ ID NO: 111082 - DNA, 601 bp, Human; identical to SEQ ID NO: 110760

SEQ ID NO: 111083 - DNA, 601 bp, Human; identical to SEQ ID NO: 110761

SEQ ID NO: 111084 - DNA, 601 bp, Human; identical to SEQ ID NO: 110762

SEQ ID NO: 111085 - DNA, 601 bp, Human; identical to SEQ ID NO: 110763

SEQ ID NO: 111086 - DNA, 601 bp, Human; identical to SEQ ID NO: 110764

SEQ ID NO: 111087 - DNA, 601 bp, Human; identical to SEQ ID NO: 110765

SEQ ID NO: 111088 - DNA, 601 bp, Human; identical to SEQ ID NO: 110766

SEQ ID NO: 111089 - DNA, 601 bp, Human; identical to SEQ ID NO: 110767

SEQ ID NO: 111090 - DNA, 601 bp, Human; identical to SEQ ID NO: 110768

SEQ ID NO: 111091 - DNA, 601 bp, Human; identical to SEQ ID NO: 110769

SEQ ID NO: 111092 - DNA, 601 bp, Human; identical to SEQ ID NO: 110770

SEQ ID NO: 111093 - DNA, 601 bp, Human; identical to SEQ ID NO: 110771

SEQ ID NO: 111094 - DNA, 601 bp, Human; identical to SEQ ID NO: 110772

SEQ ID NO: 111095 - DNA, 601 bp, Human; identical to SEQ ID NO: 110773

SEQ ID NO: 111096 - DNA, 601 bp, Human; identical to SEQ ID NO: 110774

SEQ ID NO: 111097 - DNA, 601 bp, Human; identical to SEQ ID NO: 110775

SEQ ID NO: 111098 - DNA, 601 bp, Human; identical to SEQ ID NO: 110776

SEQ ID NO: 111099 - DNA, 601 bp, Human; identical to SEQ ID NO: 110777

SEQ ID NO: 111100 - DNA, 601 bp, Human; identical to SEQ ID NO: 110778

SEQ ID NO: 111101 - DNA, 601 bp, Human; identical to SEQ ID NO: 110779

SEQ ID NO: 111102 - DNA, 601 bp, Human; identical to SEQ ID NO: 110780

SEQ ID NO: 111103 - DNA, 601 bp, Human; identical to SEQ ID NO: 110781

SEQ ID NO: 111104 - DNA, 601 bp, Human; identical to SEQ ID NO: 110782

SEQ ID NO: 111105 - DNA, 601 bp, Human; identical to SEQ ID NO: 110783

SEQ ID NO: 111106 - DNA, 601 bp, Human; identical to SEQ ID NO: 110784

SEQ ID NO: 111107 - DNA, 601 bp, Human; identical to SEQ ID NO: 110785

SEQ ID NO: 111108 - DNA, 601 bp, Human; identical to SEQ ID NO: 110786

SEQ ID NO: 111109 - DNA, 601 bp, Human; identical to SEQ ID NO: 110787

SEQ ID NO: 111110 - DNA, 601 bp, Human; identical to SEQ ID NO: 110788

SEQ ID NO: 111111 - DNA, 601 bp, Human; identical to SEQ ID NO: 110789

SEQ ID NO: 111112 - DNA, 601 bp, Human; identical to SEQ ID NO: 110790

SEQ ID NO: 111113 - DNA, 601 bp, Human; identical to SEQ ID NO: 110791

SEQ ID NO: 111114 - DNA, 601 bp, Human; identical to SEQ ID NO: 110792

SEQ ID NO: 111115 - DNA, 601 bp, Human; identical to SEQ ID NO: 110793

SEQ ID NO: 111116 - DNA, 601 bp, Human; identical to SEQ ID NO: 110794

SEQ ID NO: 111117 - DNA, 601 bp, Human; identical to SEQ ID NO: 110795

SEQ ID NO: 111118 - DNA, 601 bp, Human; identical to SEQ ID NO: 110796

SEQ ID NO: 111119 - DNA, 601 bp, Human; identical to SEQ ID NO: 110797

SEQ ID NO: 111120 - DNA, 601 bp, Human; identical to SEQ ID NO: 110798

SEQ ID NO: 111121 - DNA, 601 bp, Human; identical to SEQ ID NO: 110799

SEQ ID NO: 111122 - DNA, 601 bp, Human; identical to SEQ ID NO: 110800

SEQ ID NO: 111123 - DNA, 601 bp, Human; identical to SEQ ID NO: 110801

SEQ ID NO: 111124 - DNA, 601 bp, Human; identical to SEQ ID NO: 110802

SEQ ID NO: 111125 - DNA, 601 bp, Human; identical to SEQ ID NO: 110803

SEQ ID NO: 111126 - DNA, 601 bp, Human; identical to SEQ ID NO: 110804

SEQ ID NO: 111127 - DNA, 601 bp, Human; identical to SEQ ID NO: 110805

SEQ ID NO: 111128 - DNA, 601 bp, Human; identical to SEQ ID NO: 110806

SEQ ID NO: 111129 - DNA, 601 bp, Human; identical to SEQ ID NO: 110807

SEQ ID NO: 111130 - DNA, 601 bp, Human; identical to SEQ ID NO: 110808

SEQ ID NO: 111131 - DNA, 601 bp, Human; identical to SEQ ID NO: 110809

SEQ ID NO: 111132 - DNA, 601 bp, Human; identical to SEQ ID NO: 110810

SEQ ID NO: 111133 - DNA, 601 bp, Human; identical to SEQ ID NO: 110811

SEQ ID NO: 111134 - DNA, 601 bp, Human; identical to SEQ ID NO: 110812

SEQ ID NO: 111135 - DNA, 601 bp, Human; identical to SEQ ID NO: 110813

SEQ ID NO: 111136 - DNA, 601 bp, Human; identical to SEQ ID NO: 110814

SEQ ID NO: 111137 - DNA, 601 bp, Human; identical to SEQ ID NO: 110815

SEQ ID NO: 111138 - DNA, 601 bp, Human; identical to SEQ ID NO: 110816

SEQ ID NO: 111139 - DNA, 601 bp, Human; identical to SEQ ID NO: 110817

SEQ ID NO: 111140 - DNA, 601 bp, Human; identical to SEQ ID NO: 110818

SEQ ID NO: 111141 - DNA, 601 bp, Human; identical to SEQ ID NO: 110819

SEQ ID NO: 111142 - DNA, 601 bp, Human; identical to SEQ ID NO: 110820

SEQ ID NO: 111143 - DNA, 601 bp, Human; identical to SEQ ID NO: 110821

SEQ ID NO: 111144 - DNA, 601 bp, Human; identical to SEQ ID NO: 110822

SEQ ID NO: 111145 - DNA, 601 bp, Human; identical to SEQ ID NO: 110823

SEQ ID NO: 111146 - DNA, 601 bp, Human; identical to SEQ ID NO: 110824

SEQ ID NO: 111147 - DNA, 601 bp, Human; identical to SEQ ID NO: 110825

SEQ ID NO: 111148 - DNA, 601 bp, Human; identical to SEQ ID NO: 110826

SEQ ID NO: 111149 - DNA, 601 bp, Human; identical to SEQ ID NO: 110827

SEQ ID NO: 111150 - DNA, 601 bp, Human; identical to SEQ ID NO: 110828

SEQ ID NO: 111151 - DNA, 601 bp, Human; identical to SEQ ID NO: 110829

SEQ ID NO: 111152 - DNA, 601 bp, Human; identical to SEQ ID NO: 110830

SEQ ID NO: 111153 - DNA, 601 bp, Human; identical to SEQ ID NO: 110831

SEQ ID NO: 111154 - DNA, 601 bp, Human; identical to SEQ ID NO: 110832

SEQ ID NO: 111155 - DNA, 601 bp, Human; identical to SEQ ID NO: 110833

SEQ ID NO: 111156 - DNA, 601 bp, Human; identical to SEQ ID NO: 110834

SEQ ID NO: 111157 - DNA, 601 bp, Human; identical to SEQ ID NO: 110835

SEQ ID NO: 111158 - DNA, 601 bp, Human; identical to SEQ ID NO: 110836

SEQ ID NO: 111159 - DNA, 601 bp, Human; identical to SEQ ID NO: 110837

SEQ ID NO: 111160 - DNA, 601 bp, Human; identical to SEQ ID NO: 110838

SEQ ID NO: 111161 - DNA, 601 bp, Human; identical to SEQ ID NO: 110839

SEQ ID NO: 111162 - DNA, 601 bp, Human; identical to SEQ ID NO: 110840

SEQ ID NO: 111163 - DNA, 601 bp, Human; identical to SEQ ID NO: 110841

SEQ ID NO: 111164 - DNA, 601 bp, Human; identical to SEQ ID NO: 110842

SEQ ID NO: 111165 - DNA, 601 bp, Human; identical to SEQ ID NO: 110843

SEQ ID NO: 111166 - DNA, 601 bp, Human; identical to SEQ ID NO: 110844

SEQ ID NO: 111167 - DNA, 601 bp, Human; identical to SEQ ID NO: 110845

SEQ ID NO: 111168 - DNA, 601 bp, Human; identical to SEQ ID NO: 110846

SEQ ID NO: 111169 - DNA, 601 bp, Human; identical to SEQ ID NO: 110847

SEQ ID NO: 111170 - DNA, 601 bp, Human; identical to SEQ ID NO: 110848

SEQ ID NO: 111171 - DNA, 601 bp, Human; identical to SEQ ID NO: 110849

SEQ ID NO: 111172 - DNA, 601 bp, Human; identical to SEQ ID NO: 110850

SEQ ID NO: 111173 - DNA, 601 bp, Human; identical to SEQ ID NO: 110851

SEQ ID NO: 111174 - DNA, 601 bp, Human; identical to SEQ ID NO: 110852

SEQ ID NO: 111175 - DNA, 601 bp, Human; identical to SEQ ID NO: 110853

SEQ ID NO: 111176 - DNA, 601 bp, Human; identical to SEQ ID NO: 110854

SEQ ID NO: 111177 - DNA, 601 bp, Human; identical to SEQ ID NO: 110855

SEQ ID NO: 111178 - DNA, 601 bp, Human; identical to SEQ ID NO: 110856

SEQ ID NO: 111179 - DNA, 601 bp, Human; identical to SEQ ID NO: 110857

SEQ ID NO: 111180 - DNA, 601 bp, Human; identical to SEQ ID NO: 110858

SEQ ID NO: 111181 - DNA, 601 bp, Human; identical to SEQ ID NO: 110859

SEQ ID NO: 111182 - DNA, 601 bp, Human; identical to SEQ ID NO: 110860

SEQ ID NO: 111183 - DNA, 601 bp, Human; identical to SEQ ID NO: 110861

SEQ ID NO: 111184 - DNA, 601 bp, Human; identical to SEQ ID NO: 110862

SEQ ID NO: 111185 - DNA, 601 bp, Human; identical to SEQ ID NO: 110863

SEQ ID NO: 111186 - DNA, 601 bp, Human; identical to SEQ ID NO: 110864

SEQ ID NO: 111187 - DNA, 601 bp, Human; identical to SEQ ID NO: 110865

SEQ ID NO: 111188 - DNA, 601 bp, Human; identical to SEQ ID NO: 110866

SEQ ID NO: 111189 - DNA, 601 bp, Human; identical to SEQ ID NO: 110867

SEQ ID NO: 111190 - DNA, 601 bp, Human; identical to SEQ ID NO: 20558

SEQ ID NO: 111191 - DNA, 601 bp, Human; identical to SEQ ID NO: 20559

SEQ ID NO: 111192 - DNA, 601 bp, Human; identical to SEQ ID NO: 20560

SEQ ID NO: 111193 - DNA, 601 bp, Human; identical to SEQ ID NO: 110710

SEQ ID NO: 111194 - DNA, 601 bp, Human; identical to SEQ ID NO: 110711

SEQ ID NO: 111195 - DNA, 601 bp, Human; identical to SEQ ID NO: 110712

SEQ ID NO: 111196 - DNA, 601 bp, Human; identical to SEQ ID NO: 110713

SEQ ID NO: 111197 - DNA, 601 bp, Human; identical to SEQ ID NO: 110714

SEQ ID NO: 111198 - DNA, 601 bp, Human; identical to SEQ ID NO: 110715

SEQ ID NO: 111199 - DNA, 601 bp, Human; identical to SEQ ID NO: 110716

SEQ ID NO: 111200 - DNA, 601 bp, Human; identical to SEQ ID NO: 110717

SEQ ID NO: 111201 - DNA, 601 bp, Human; identical to SEQ ID NO: 110718

SEQ ID NO: 111202 - DNA, 601 bp, Human; identical to SEQ ID NO: 110719

SEQ ID NO: 111203 - DNA, 601 bp, Human; identical to SEQ ID NO: 110720

SEQ ID NO: 111204 - DNA, 601 bp, Human; identical to SEQ ID NO: 110721

SEQ ID NO: 111205 - DNA, 601 bp, Human; identical to SEQ ID NO: 110722

SEQ ID NO: 111206 - DNA, 601 bp, Human; identical to SEQ ID NO: 110723

SEQ ID NO: 111207 - DNA, 601 bp, Human; identical to SEQ ID NO: 110724

SEQ ID NO: 111208 - DNA, 601 bp, Human; identical to SEQ ID NO: 110725

SEQ ID NO: 111209 - DNA, 601 bp, Human; identical to SEQ ID NO: 110726

SEQ ID NO: 111210 - DNA, 601 bp, Human; identical to SEQ ID NO: 110727

SEQ ID NO: 111211 - DNA, 601 bp, Human; identical to SEQ ID NO: 110728

SEQ ID NO: 111212 - DNA, 601 bp, Human; identical to SEQ ID NO: 110729

SEQ ID NO: 111213 - DNA, 601 bp, Human; identical to SEQ ID NO: 110730

SEQ ID NO: 111214 - DNA, 601 bp, Human; identical to SEQ ID NO: 110731

SEQ ID NO: 111215 - DNA, 601 bp, Human; identical to SEQ ID NO: 110732

SEQ ID NO: 111216 - DNA, 601 bp, Human; identical to SEQ ID NO: 110733

SEQ ID NO: 111217 - DNA, 601 bp, Human; identical to SEQ ID NO: 110734

SEQ ID NO: 111218 - DNA, 601 bp, Human; identical to SEQ ID NO: 110735

SEQ ID NO: 111219 - DNA, 601 bp, Human; identical to SEQ ID NO: 110736

SEQ ID NO: 111220 - DNA, 601 bp, Human; identical to SEQ ID NO: 110737

SEQ ID NO: 111221 - DNA, 601 bp, Human; identical to SEQ ID NO: 110738

SEQ ID NO: 111222 - DNA, 601 bp, Human; identical to SEQ ID NO: 110739

SEQ ID NO: 111223 - DNA, 601 bp, Human; identical to SEQ ID NO: 110740

SEQ ID NO: 111224 - DNA, 601 bp, Human; identical to SEQ ID NO: 110741

SEQ ID NO: 111225 - DNA, 601 bp, Human; identical to SEQ ID NO: 110742

SEQ ID NO: 111226 - DNA, 601 bp, Human; identical to SEQ ID NO: 110743

SEQ ID NO: 111227 - DNA, 601 bp, Human; identical to SEQ ID NO: 110744

SEQ ID NO: 111228 - DNA, 601 bp, Human; identical to SEQ ID NO: 110745

SEQ ID NO: 111229 - DNA, 601 bp, Human; identical to SEQ ID NO: 110746

SEQ ID NO: 111230 - DNA, 601 bp, Human; identical to SEQ ID NO: 110747

SEQ ID NO: 111231 - DNA, 601 bp, Human; identical to SEQ ID NO: 110748

SEQ ID NO: 111232 - DNA, 601 bp, Human; identical to SEQ ID NO: 110749

SEQ ID NO: 111233 - DNA, 601 bp, Human; identical to SEQ ID NO: 110750

SEQ ID NO: 111234 - DNA, 601 bp, Human; identical to SEQ ID NO: 110751

SEQ ID NO: 111235 - DNA, 601 bp, Human; identical to SEQ ID NO: 110752

SEQ ID NO: 111236 - DNA, 601 bp, Human; identical to SEQ ID NO: 110753

SEQ ID NO: 111237 - DNA, 601 bp, Human; identical to SEQ ID NO: 110754

SEQ ID NO: 111238 - DNA, 601 bp, Human; identical to SEQ ID NO: 110755

SEQ ID NO: 111239 - DNA, 601 bp, Human; identical to SEQ ID NO: 110756

SEQ ID NO: 111240 - DNA, 601 bp, Human; identical to SEQ ID NO: 110757

SEQ ID NO: 111241 - DNA, 601 bp, Human; identical to SEQ ID NO: 110758

SEQ ID NO: 111242 - DNA, 601 bp, Human; identical to SEQ ID NO: 110759

SEQ ID NO: 111243 - DNA, 601 bp, Human; identical to SEQ ID NO: 110760

SEQ ID NO: 111244 - DNA, 601 bp, Human; identical to SEQ ID NO: 110761

SEQ ID NO: 111245 - DNA, 601 bp, Human; identical to SEQ ID NO: 110762

SEQ ID NO: 111246 - DNA, 601 bp, Human; identical to SEQ ID NO: 110763

SEQ ID NO: 111247 - DNA, 601 bp, Human; identical to SEQ ID NO: 110764

SEQ ID NO: 111248 - DNA, 601 bp, Human; identical to SEQ ID NO: 110765

SEQ ID NO: 111249 - DNA, 601 bp, Human; identical to SEQ ID NO: 110766

SEQ ID NO: 111250 - DNA, 601 bp, Human; identical to SEQ ID NO: 110767

SEQ ID NO: 111251 - DNA, 601 bp, Human; identical to SEQ ID NO: 110768

SEQ ID NO: 111252 - DNA, 601 bp, Human; identical to SEQ ID NO: 110769

SEQ ID NO: 111253 - DNA, 601 bp, Human; identical to SEQ ID NO: 110770

SEQ ID NO: 111254 - DNA, 601 bp, Human; identical to SEQ ID NO: 110771

SEQ ID NO: 111255 - DNA, 601 bp, Human; identical to SEQ ID NO: 110772

SEQ ID NO: 111256 - DNA, 601 bp, Human; identical to SEQ ID NO: 110773

SEQ ID NO: 111257 - DNA, 601 bp, Human; identical to SEQ ID NO: 110774

SEQ ID NO: 111258 - DNA, 601 bp, Human; identical to SEQ ID NO: 110775

SEQ ID NO: 111259 - DNA, 601 bp, Human; identical to SEQ ID NO: 110776

SEQ ID NO: 111260 - DNA, 601 bp, Human; identical to SEQ ID NO: 110777

SEQ ID NO: 111261 - DNA, 601 bp, Human; identical to SEQ ID NO: 110778

SEQ ID NO: 111262 - DNA, 601 bp, Human; identical to SEQ ID NO: 110779

SEQ ID NO: 111263 - DNA, 601 bp, Human; identical to SEQ ID NO: 110780

SEQ ID NO: 111264 - DNA, 601 bp, Human; identical to SEQ ID NO: 110781

SEQ ID NO: 111265 - DNA, 601 bp, Human; identical to SEQ ID NO: 110782

SEQ ID NO: 111266 - DNA, 601 bp, Human; identical to SEQ ID NO: 110783

SEQ ID NO: 111267 - DNA, 601 bp, Human; identical to SEQ ID NO: 110784

SEQ ID NO: 111268 - DNA, 601 bp, Human; identical to SEQ ID NO: 110785

SEQ ID NO: 111269 - DNA, 601 bp, Human; identical to SEQ ID NO: 110786

SEQ ID NO: 111270 - DNA, 601 bp, Human; identical to SEQ ID NO: 110787

SEQ ID NO: 111271 - DNA, 601 bp, Human; identical to SEQ ID NO: 110788

SEQ ID NO: 111272 - DNA, 601 bp, Human; identical to SEQ ID NO: 110789

SEQ ID NO: 111273 - DNA, 601 bp, Human; identical to SEQ ID NO: 110790

SEQ ID NO: 111274 - DNA, 601 bp, Human; identical to SEQ ID NO: 110791

SEQ ID NO: 111275 - DNA, 601 bp, Human; identical to SEQ ID NO: 110792

SEQ ID NO: 111276 - DNA, 601 bp, Human; identical to SEQ ID NO: 110793

SEQ ID NO: 111277 - DNA, 601 bp, Human; identical to SEQ ID NO: 110794

SEQ ID NO: 111278 - DNA, 601 bp, Human; identical to SEQ ID NO: 110795

SEQ ID NO: 111279 - DNA, 601 bp, Human; identical to SEQ ID NO: 110796

SEQ ID NO: 111280 - DNA, 601 bp, Human; identical to SEQ ID NO: 110797

SEQ ID NO: 111281 - DNA, 601 bp, Human; identical to SEQ ID NO: 110798

SEQ ID NO: 111282 - DNA, 601 bp, Human; identical to SEQ ID NO: 110799

SEQ ID NO: 111283 - DNA, 601 bp, Human; identical to SEQ ID NO: 110800

SEQ ID NO: 111284 - DNA, 601 bp, Human; identical to SEQ ID NO: 110801

SEQ ID NO: 111285 - DNA, 601 bp, Human; identical to SEQ ID NO: 110802

SEQ ID NO: 111286 - DNA, 601 bp, Human; identical to SEQ ID NO: 110803

SEQ ID NO: 111287 - DNA, 601 bp, Human; identical to SEQ ID NO: 110804

SEQ ID NO: 111288 - DNA, 601 bp, Human; identical to SEQ ID NO: 110805

SEQ ID NO: 111289 - DNA, 601 bp, Human; identical to SEQ ID NO: 110806

SEQ ID NO: 111290 - DNA, 601 bp, Human; identical to SEQ ID NO: 110807

SEQ ID NO: 111291 - DNA, 601 bp, Human; identical to SEQ ID NO: 110808

SEQ ID NO: 111292 - DNA, 601 bp, Human; identical to SEQ ID NO: 110809

SEQ ID NO: 111293 - DNA, 601 bp, Human; identical to SEQ ID NO: 110810

SEQ ID NO: 111294 - DNA, 601 bp, Human; identical to SEQ ID NO: 110811

SEQ ID NO: 111295 - DNA, 601 bp, Human; identical to SEQ ID NO: 110812

SEQ ID NO: 111296 - DNA, 601 bp, Human; identical to SEQ ID NO: 110813

SEQ ID NO: 111297 - DNA, 601 bp, Human; identical to SEQ ID NO: 110814

SEQ ID NO: 111298 - DNA, 601 bp, Human; identical to SEQ ID NO: 110815

SEQ ID NO: 111299 - DNA, 601 bp, Human; identical to SEQ ID NO: 110816

SEQ ID NO: 111300 - DNA, 601 bp, Human; identical to SEQ ID NO: 110817

SEQ ID NO: 111301 - DNA, 601 bp, Human; identical to SEQ ID NO: 110818

SEQ ID NO: 111302 - DNA, 601 bp, Human; identical to SEQ ID NO: 110819

SEQ ID NO: 111303 - DNA, 601 bp, Human; identical to SEQ ID NO: 110820

SEQ ID NO: 111304 - DNA, 601 bp, Human; identical to SEQ ID NO: 110821

SEQ ID NO: 111305 - DNA, 601 bp, Human; identical to SEQ ID NO: 110822

SEQ ID NO: 111306 - DNA, 601 bp, Human; identical to SEQ ID NO: 110823

SEQ ID NO: 111307 - DNA, 601 bp, Human; identical to SEQ ID NO: 110824

SEQ ID NO: 111308 - DNA, 601 bp, Human; identical to SEQ ID NO: 110825

SEQ ID NO: 111309 - DNA, 601 bp, Human; identical to SEQ ID NO: 110826

SEQ ID NO: 111310 - DNA, 601 bp, Human; identical to SEQ ID NO: 110827

SEQ ID NO: 111311 - DNA, 601 bp, Human; identical to SEQ ID NO: 110828

SEQ ID NO: 111312 - DNA, 601 bp, Human; identical to SEQ ID NO: 110829

SEQ ID NO: 111313 - DNA, 601 bp, Human; identical to SEQ ID NO: 110830

SEQ ID NO: 111314 - DNA, 601 bp, Human; identical to SEQ ID NO: 110831

SEQ ID NO: 111315 - DNA, 601 bp, Human; identical to SEQ ID NO: 110832

SEQ ID NO: 111316 - DNA, 601 bp, Human; identical to SEQ ID NO: 110833

SEQ ID NO: 111317 - DNA, 601 bp, Human; identical to SEQ ID NO: 110834

SEQ ID NO: 111318 - DNA, 601 bp, Human; identical to SEQ ID NO: 110835

SEQ ID NO: 111319 - DNA, 601 bp, Human; identical to SEQ ID NO: 110836

SEQ ID NO: 111320 - DNA, 601 bp, Human; identical to SEQ ID NO: 110837

SEQ ID NO: 111321 - DNA, 601 bp, Human; identical to SEQ ID NO: 110838

SEQ ID NO: 111322 - DNA, 601 bp, Human; identical to SEQ ID NO: 110839

SEQ ID NO: 111323 - DNA, 601 bp, Human; identical to SEQ ID NO: 110840

SEQ ID NO: 111324 - DNA, 601 bp, Human; identical to SEQ ID NO: 110841

SEQ ID NO: 111325 - DNA, 601 bp, Human; identical to SEQ ID NO: 110842

SEQ ID NO: 111326 - DNA, 601 bp, Human; identical to SEQ ID NO: 110843

SEQ ID NO: 111327 - DNA, 601 bp, Human; identical to SEQ ID NO: 110844

SEQ ID NO: 111328 - DNA, 601 bp, Human; identical to SEQ ID NO: 110845

SEQ ID NO: 111329 - DNA, 601 bp, Human; identical to SEQ ID NO: 110846

SEQ ID NO: 111330 - DNA, 601 bp, Human; identical to SEQ ID NO: 110847

SEQ ID NO: 111331 - DNA, 601 bp, Human; identical to SEQ ID NO: 110848

SEQ ID NO: 111332 - DNA, 601 bp, Human; identical to SEQ ID NO: 110849

SEQ ID NO: 111333 - DNA, 601 bp, Human; identical to SEQ ID NO: 110850

SEQ ID NO: 111334 - DNA, 601 bp, Human; identical to SEQ ID NO: 110851

SEQ ID NO: 111335 - DNA, 601 bp, Human; identical to SEQ ID NO: 110852

SEQ ID NO: 111336 - DNA, 601 bp, Human; identical to SEQ ID NO: 110853

SEQ ID NO: 111337 - DNA, 601 bp, Human; identical to SEQ ID NO: 110854

SEQ ID NO: 111338 - DNA, 601 bp, Human; identical to SEQ ID NO: 110855

SEQ ID NO: 111339 - DNA, 601 bp, Human; identical to SEQ ID NO: 110856

SEQ ID NO: 111340 - DNA, 601 bp, Human; identical to SEQ ID NO: 110857

SEQ ID NO: 111341 - DNA, 601 bp, Human; identical to SEQ ID NO: 110858

SEQ ID NO: 111342 - DNA, 601 bp, Human; identical to SEQ ID NO: 110859

SEQ ID NO: 111343 - DNA, 601 bp, Human; identical to SEQ ID NO: 110860

SEQ ID NO: 111344 - DNA, 601 bp, Human; identical to SEQ ID NO: 110861

SEQ ID NO: 111345 - DNA, 601 bp, Human; identical to SEQ ID NO: 110862

SEQ ID NO: 111346 - DNA, 601 bp, Human; identical to SEQ ID NO: 110863

SEQ ID NO: 111347 - DNA, 601 bp, Human; identical to SEQ ID NO: 110864

SEQ ID NO: 111348 - DNA, 601 bp, Human; identical to SEQ ID NO: 110865

SEQ ID NO: 111349 - DNA, 601 bp, Human; identical to SEQ ID NO: 110866

SEQ ID NO: 111350 - DNA, 601 bp, Human; identical to SEQ ID NO: 110867

SEQ ID NO: 111351 - DNA, 601 bp, Human; identical to SEQ ID NO: 20558

SEQ ID NO: 111352 - DNA, 601 bp, Human; identical to SEQ ID NO: 20559

SEQ ID NO: 111353 - DNA, 601 bp, Human; identical to SEQ ID NO: 20560

SEQ ID NO: 111354 - DNA, 601 bp, Human; identical to SEQ ID NO: 24697

SEQ ID NO: 111355 - DNA, 601 bp, Human; identical to SEQ ID NO: 24696

SEQ ID NO: 111356 - DNA, 601 bp, Human; identical to SEQ ID NO: 24695

SEQ ID NO: 111357 - DNA, 601 bp, Human; identical to SEQ ID NO: 24694

SEQ ID NO: 111358 - DNA, 601 bp, Human; identical to SEQ ID NO: 24693

SEQ ID NO: 111359 - DNA, 601 bp, Human; identical to SEQ ID NO: 24692

SEQ ID NO: 111360 - DNA, 601 bp, Human; identical to SEQ ID NO: 24691

SEQ ID NO: 111361 - DNA, 601 bp, Human; identical to SEQ ID NO: 24690

SEQ ID NO: 111362 - DNA, 601 bp, Human; identical to SEQ ID NO: 24689

SEQ ID NO: 111363 - DNA, 601 bp, Human; identical to SEQ ID NO: 24688

SEQ ID NO: 111364 - DNA, 601 bp, Human; identical to SEQ ID NO: 24687

SEQ ID NO: 111365 - DNA, 601 bp, Human; identical to SEQ ID NO: 24686

SEQ ID NO: 111366 - DNA, 601 bp, Human; identical to SEQ ID NO: 24685

SEQ ID NO: 111367 - DNA, 601 bp, Human; identical to SEQ ID NO: 24684

SEQ ID NO: 111368 - DNA, 601 bp, Human; identical to SEQ ID NO: 24683

SEQ ID NO: 111369 - DNA, 601 bp, Human; identical to SEQ ID NO: 24682

SEQ ID NO: 111370 - DNA, 601 bp, Human; identical to SEQ ID NO: 24681

SEQ ID NO: 111371 - DNA, 601 bp, Human; identical to SEQ ID NO: 24680

SEQ ID NO: 111372 - DNA, 601 bp, Human; identical to SEQ ID NO: 24679

SEQ ID NO: 111373 - DNA, 601 bp, Human; identical to SEQ ID NO: 24678

SEQ ID NO: 111374 - DNA, 601 bp, Human; identical to SEQ ID NO: 24677

SEQ ID NO: 111375 - DNA, 601 bp, Human
tggggagccagccaaggctgtccttgaagtacagagatctctggtctctgcggaaggcaatggcgttttgggtgttcagcctctcaagctcctcctggttgttgaccacaaaaatctgccagagaacacactggtgaggattccagaaaacacttctgcagggggcaggaaaaaagctggaggaggaaacagaatctctatccttgggctgctcaacagtgggaagaggggtttgcacactacactctagcattccttctgaagtgagaggagtgtcttgattccctcaccttctcaatcragttcctaatgtctgagtttgaaactaaaatattcactcggatttaacttttttttcttttttttttgagatggagtctcacgcggttgcccaggctggagtgaagtagcgtgatctcggctcattgcaacctctgcctcccgggttcaagcaattctcctgcctcagcctctcgagtaggtgggattacaggtgtgcaccacaatgcctggctaacttttgtatttttagtagagatagggtttcgccatgttggccaggctggttgcgagctcctgacctcaaggtgatccacccacc

SEQ ID NO: 111376 - DNA, 601 bp, Human
gggtacctggatggggagccagccaaggctgtccttgaagtacagagatctctggtctctgcggaaggcaatggcgttttgggtgttcagcctctcaagctcctcctggttgttgaccacaaaaatctgccagagaacacactggtgaggattccagaaaacacttctgcagggggcaggaaaaaagctggaggaggaaacagaatctctatccttgggctgctcaacagtgggaagaggggtttgcacactacactctagcattccttctgaagtgagaggagtgtcttgattccctcaycttctcaatcaagttcctaatgtctgagtttgaaactaaaatattcactcggatttaacttttttttcttttttttttgagatggagtctcacgcggttgcccaggctggagtgaagtagcgtgatctcggctcattgcaacctctgcctcccgggttcaagcaattctcctgcctcagcctctcgagtaggtgggattacaggtgtgcaccacaatgcctggctaacttttgtatttttagtagagatagggtttcgccatgttggccaggctggttgcgagctcctgacctcaaggtg

SEQ ID NO: 111377 - DNA, 601 bp, Human
cttgagaaggagcagaggcgataggcttgcctcagcttgtaaggaccatgcggcccaagggatccaacctaagtgctgcaccccttaaagaactgacctccattaagcttcacactcctccagggactgcccacaggctctggtcccacagcgatgtgccatgggacaagaagaaggagatcctggctccagccccgcctcacaacttactagctgaggggtggggagactccaggttgttatctgcaaaactgggacactgacatgacctccacctcataaagccagtgtgggggtcccrggagtgagggttggaagactgctgagccccagtgagggtgcatggtgactctcatctgtcaacagagagcttctgtgtgacactggtgagcccagccttgtgtccctggggagccacatgatcttcagcaaagacctctgctctcacacgatgggagggtgttggagtatggatcccagcgttgttttcacagggcagggacagtccattagttccttcctactgtgagagctcctatttgacactgtgcaccagaggcagaagggactctgggcagggccagccttctaggggatgcca

SEQ ID NO: 111378 - DNA, 601 bp, Human
catgtcaggtagccaaagtcagagccgtcacagtcctccacaccctcatgccggtgaccatctccacagtaggcacggtgacagcctgaggggacataaggaggtgcagtcttgagaaggagcagaggcgataggcttgcctcagcttgtaaggaccatgcggcccaagggatccaacctaagtgctgcaccccttaaagaactgacctccattaagcttcacactcctccagggactgcccacaggctctggtcccacagcgatgtgccatgggacaagaagaaggagatcctggctccrgccccgcctcacaacttactagctgaggggtggggagactccaggttgttatctgcaaaactgggacactgacatgacctccacctcataaagccagtgtgggggtcccgggagtgagggttggaagactgctgagccccagtgagggtgcatggtgactctcatctgtcaacagagagcttctgtgtgacactggtgagcccagccttgtgtccctggggagccacatgatcttcagcaaagacctctgctctcacacgatgggagggtgttggagtatggatcccagcgttgttttca

SEQ ID NO: 111379 - DNA, 601 bp, Human
ataggtctcgcatgtcaggtagccaaagtcagagccgtcacagtcctccacaccctcatgccggtgaccatctccacagtaggcacggtgacagcctgaggggacataaggaggtgcagtcttgagaaggagcagaggcgataggcttgcctcagcttgtaaggaccatgcggcccaagggatccaacctaagtgctgcaccccttaaagaactgacctccattaagcttcacactcctccagggactgcccacaggctctggtcccacagcgatgtgccatgggacaagaagaaggagaycctggctccagccccgcctcacaacttactagctgaggggtggggagactccaggttgttatctgcaaaactgggacactgacatgacctccacctcataaagccagtgtgggggtcccgggagtgagggttggaagactgctgagccccagtgagggtgcatggtgactctcatctgtcaacagagagcttctgtgtgacactggtgagcccagccttgtgtccctggggagccacatgatcttcagcaaagacctctgctctcacacgatgggagggtgttggagtatggatcccagc

SEQ ID NO: 111380 - DNA, 601 bp, Human
cggatgatcatccgagacagggcgttaaaccttacaggcacagtcacaggcgtccctctgaggcttctggggaatagctgtgtaaccacagtgagcgtgggggagccctgggctctactcgatcctgtactccatatctgatcgtctacattgatttgtctctgtggagccatgaagagccaactctctggcagaggcctgtcaggggtcttccttccttcagggagaggggcactgcacacagacacatacatggagtggggtcctggccaagcctaaatgggcttagagtctgggggaractgggggagactacaggtctgtagttctcccagcctggttgaacatgctaatatctgagtgttagggagacccccttggaagagagagcacagagaaggcaatggagagacaggcatggctccccagccctgccaagggcccaggtccgagtctacaagagaaaatgggatgggagcaaaagctgaagggactggactcaaggacagaagagatcggaagcaccagtagatccactctggaacccagtgaagagcagggcatggcctaggtaaaaaggaacggcctccccattttcctg

SEQ ID NO: 111381 - DNA, 601 bp, Human
tacctgggattacaggcacgtgccaccaagctcagctaatttttgtatttttagtagaggtgggatttcaccatgttggccagggtggtgccgaactctgaacctcaggtgacctgcccgccttggcctcccaaagttctggaattacaggcgtgagtcacagtgcctggcctgagtaactgcattttaagtttacttataatgactttacatttgaacagcagcctgtgaatgggggctaccatattggacagtgcagtttatacctctgtaggcccggatgatcatccgagacagggcrttaaaccttacaggcacagtcacaggcgtccctctgaggcttctggggaatagctgtgtaaccacagtgagcgtgggggagccctgggctctactcgatcctgtactccatatctgatcgtctacattgatttgtctctgtggagccatgaagagccaactctctggcagaggcctgtcaggggtcttccttccttcagggagaggggcactgcacacagacacatacatggagtggggtcctggccaagcctaaatgggcttagagtctgggggagactgggggagactacaggtctgt

SEQ ID NO: 111382 - DNA, 601 bp, Human
ctggccagatgtggctattgagctcttgaaatgtagttactgtgactgaataactgcattttttttttttttttgagacagagtttcgctctgtcccccaggctggagtgcagtggtgtgatctcggctcactgcagcctctgcctcccaggttcaagcgattgtcctgcctcagcttcctgagtacctgggattacaggcacgtgccaccaagctcagctaatttttgtatttttagtagaggtgggatttcaccatgttggccagggtggtgccgaactctgaacctcaggtgacctgyccgccttggcctcccaaagttctggaattacaggcgtgagtcacagtgcctggcctgagtaactgcattttaagtttacttataatgactttacatttgaacagcagcctgtgaatgggggctaccatattggacagtgcagtttatacctctgtaggcccggatgatcatccgagacagggcgttaaaccttacaggcacagtcacaggcgtccctctgaggcttctggggaatagctgtgtaaccacagtgagcgtgggggagccctgggctctactcgatcctgtactccatatctg

SEQ ID NO: 111383 - DNA, 601 bp, Human
gaatcatgtctctgggatttttgccttgaggtctagctcggggcctgggtggaaggaggtggttgccctgctcttagcacagcatctgtgagggaatcccccttgctacgatgcagcctaccaacaaaaatgtcctgtatctgtgaagccactggccagatgtggctattgagctcttgaaatgtagttactgtgactgaataactgcattttttttttttttttgagacagagtttcgctctgtcccccaggctggagtgcagtggtgtgatctcggctcactgcagcctctgcctcccrggttcaagcgattgtcctgcctcagcttcctgagtacctgggattacaggcacgtgccaccaagctcagctaatttttgtatttttagtagaggtgggatttcaccatgttggccagggtggtgccgaactctgaacctcaggtgacctgcccgccttggcctcccaaagttctggaattacaggcgtgagtcacagtgcctggcctgagtaactgcattttaagtttacttataatgactttacatttgaacagcagcctgtgaatgggggctaccatattggacagtgcagtttatac

SEQ ID NO: 111384 - DNA, 601 bp, Human
caaacagcggccaagggccaatggctctacaagaactttttcccattctcatttggagtgagaggcctgggggagttgaatcatgtctctgggatttttgccttgaggtctagctcggggcctgggtggaaggaggtggttgccctgctcttagcacagcatctgtgagggaatcccccttgctacgatgcagcctaccaacaaaaatgtcctgtatctgtgaagccactggccagatgtggctattgagctcttgaaatgtagttactgtgactgaataactgcattttttttttttttttgagacagagtttcgctctgtcccccaggctggagtgcagtggtgtgatctcggctcactgcagcctctgcctcccaggttcaagcgattgtcctgcctcagcttcctgagtacctgggattacaggcacgtgccaccaagctcagctaatttttgtatttttagtagaggtgggatttcaccatgttggccagggtggtgccgaactctgaacctcaggtgacctgcccgccttggcctcccaaagttctggaattacaggcgtgagtcacagtgcctggcctgagtaactgcatttta

SEQ ID NO: 111385 - DNA, 601 bp, Human
gggtcaggtgggttctcagtactttttcacagttaagtcttttcctgggcagccacatccacgtcaggctgggctgggctgtggccagtcgaggggtcctttggcaggttcaaagctgtgagccaccccgagagaacgtgcccacttccctgctttgtggttcataggcctagagagacccgacagcgggctgcccagtgtgagtgagaatgcctgcacgtttcggtggtcaggggcggagaggcctgtactccagattccccaaagagatcaaaacatactaaaacagcctgcaggtctrtgtgtgtctaacagtgctcagccaagtccacggcctgggtcagcaacattccagaagaggaagagcattgtagccggttgtttggccaaatggtagcgatggggaacaggtctcaggttgggcatgtggaaggttttccagtaccttggattaagacaggatgcagtggtcctaaattcttccagtcagactgagttaacagcatgtcttagtagcaggaatttgtccttgtttttgtcacacaaaggttggtggagacggggccaggacatggccagtttgatgacagtggagaagctg

SEQ ID NO: 111386 - DNA, 601 bp, Human
gcctctgcttggggcaagcctgggtcaggtgggttctcagtactttttcacagttaagtcttttcctgggcagccacatccacgtcaggctgggctgggctgtggccagtcgaggggtcctttggcaggttcaaagctgtgagccaccccgagagaacgtgcccacttccctgctttgtggttcataggcctagagagacccgacagcgggctgcccagtgtgagtgagaatgcctgcacgtttcggtggtcaggggcggagaggcctgtactccagattccccaaagagatcaaaacatwctaaaacagcctgcaggtctatgtgtgtctaacagtgctcagccaagtccacggcctgggtcagcaacattccagaagaggaagagcattgtagccggttgtttggccaaatggtagcgatggggaacaggtctcaggttgggcatgtggaaggttttccagtaccttggattaagacaggatgcagtggtcctaaattcttccagtcagactgagttaacagcatgtcttagtagcaggaatttgtccttgtttttgtcacacaaaggttggtggagacggggccaggacatggccagt

SEQ ID NO: 111387 - DNA, 601 bp, Human
aggtttaaaatgcaggaagctccctctctcatctccttaataaacttctgcctcatgctgccaggcttggagacaggtggaaagaattcagctgcagcgccgtaagccgcaaagttttcaaggttctcccttcctggatggcacgaggctgtacattttccctcccccaaatcttctaaaccacatggaaacatccctctttatcctaatgttaatgaattgggaagccccttccacccagatcaatttcacaggcactggagttccagatgttgagttaagcagcattttaatttgtcaktagtgccccgggagcataaacccataccaccaagcaaaacactatagcctctaagctattagctaacatgtcaactaggtaatgcatcttcagggaaaccagattggaaaggacagcaaaacattgatttttttttttttttttttttttaagaatcctatacctgcagcataatgctgctaaagctggcaaaacaacaaaggacatttctacagcaaggaaatgtcctattctcagtgctggggcagtgaacattgttccatctgagcatggtcacatatatggggcaaagcaattctt

SEQ ID NO: 111388 - DNA, 601 bp, Human
agactccattccatgtagggtgtgtaaaataagcccatgtatcaacatagcatggctggggttggggagaaaaaaggagggttcgtgctaactcaagcttatgagacacatcttctggatttccttccatttctctgaaggcggatgggttactggctatgaccaagggacagggagacacacatgcgcacatgcacacactttggcatctttgtggttccaatgtgggcaccaaccagcacttttctgcctggacgttaacacacactgacaaggaaaccagccctgaagtcaaagttcyaatcaccacggcactatgccatcggaatcacatcaattattgcaggtttttctctttggagaacttaggagtgaggtttaaaatgcaggaagctccctctctcatctccttaataaacttctgcctcatgctgccaggcttggagacaggtggaaagaattcagctgcagcgccgtaagccgcaaagttttcaaggttctcccttcctggatggcacgaggctgtacattttccctcccccaaatcttctaaaccacatggaaacatccctctttatcctaatgttaatgaattgggaag

SEQ ID NO: 111389 - DNA, 601 bp, Human
ttggcactgggtctggcacacataaaataataaatacttattgatgaaatgactgcataaacattttggaaatttgtggcaattaatctttttttttttgcaaggagcaatcaatacacggtttgtttgcaaactgcaagaagagaggtgccatgaccaccttatttattatagtatttccagtgcttcacaccaaacctgttatttaatgggttctaaatactagttttctgaataatggatgaatgaatggatgaaagatgaatatgtaggtggagcaacagatggataaatagaagaygatagctaggtgtggtggcacatgactgtaatcccagcacattgggaggccaagataggaggagcacttgagaccagcctgggcaagatggtgagactcccgcctctacaaaaaatataaaaattagccaggcatggtggtgcatacctacagtcccagctacttggaaggctaaggcaagagattgcttgggcccagaagttcgaggctgcagtgagctatgactgtgccactgcactcagccttgatgacaaagtgagacctcatctcaaaaaaaaagaggggacagattaagggaga

SEQ ID NO: 111390 - DNA, 601 bp, Human
tcagccctttttttgtgtgaacctacataacaacacatagaaaaaatgggattatgggtggagtttttccctcttatcattatactttcccatattacctaccttttttacttttatggtgcatagagaatactttttataatcaagacaaaatttaaagtcattttcatttcaaaatgaaccttggtaaatagaattaacgggaactgctacttcctatttttttacattttagtaatgttttacttttgttcacctctgaaggggaaagatattttaaatgtaaaagcaaaaaactcartaaaagacctctgcatttaccctgagagtggcatgcctcccttcaaaggaccactctcttttggttcctcaaattaatagatgccagattgattccagggtcggcctataagcactaaattctgaccctggaagctctggtctcatcgtgttgaaattacgcttcacaaaggtgtgcacactgcaggattacctgcaggaaacagccttgtgctgctgcttcttttgtagggttattggcagtttctgttccattgtcttcttgggccattacctcctgaagcctaactcaaaccttttc

SEQ ID NO: 111391 - DNA, 601 bp, Human
actggcagacaaacagaggggtgggccagataggaagacataatcataacccatactgctctctgggctacagcggaaaacaaatctgatattcatcacaggttctcagctaagacgctatgctcgtttactgcaagatggatcagttttaacattttcattttcacaaaaatatgtgacaccaaataccatgagtggtttaggataaggctataatatccagaagaaatataatcagggctaaagatgctcctcaggactccatgtcttgtaccttttaataataaaatacccaattcckctctaagagtttgctatccattcttttcgactattaaaaaaaaggaggtcagatcttttaaaaatcatgcctagtattatatgtttactggtatttctaggtgtagaaattactaatatatgaagaacttccataattcttagctaatcaatttggcaagcattacacttcacctcttaaactgccgatagtactgttggttgaaaaccaagatcaaactttgtatatgagttgacctctgggggccagccttcttagatctgcaacttctccaaagtccaagtattataatattcaaag

SEQ ID NO: 111392 - DNA, 601 bp, Human
gactggcagacaaacagaggggtgggccagataggaagacataatcataacccatactgctctctgggctacagcggaaaacaaatctgatattcatcacaggttctcagctaagacgctatgctcgtttactgcaagatggatcagttttaacattttcattttcacaaaaatatgtgacaccaaataccatgagtggtttaggataaggctataatatccagaagaaatataatcagggctaaagatgctcctcaggactccatgtcttgtaccttttaataataaaatacccaattcctctctaagagtttgctatccattcttttcgactattaaaaaaaaggaggtcagatcttttaaaaatcatgcctagtattatatgtttactggtatttctaggtgtagaaattactaatatatgaagaacttccataattcttagctaatcaatttggcaagcattacacttcacctcttaaactgccgatagtactgttggttgaaaaccaagatcaaactttgtatatgagttgacctctgggggccagccttcttagatctgcaacttctccaaagtccaagtattataatattcaaa

SEQ ID NO: 111393 - DNA, 601 bp, Human
ttttttttttttttttttgagacagtctcgctctgtcgcccaggctggagtgcaagtggcatgatctcggctcactgcaagctccgcctcccaggttccagtgatgcctcctgcctcagcctcccgagtagctgggactacaggcgcacgccaccacacccggctaatttttgtattttttagcagagacggggtttcaccatattggccaggctggtctccaactcctgacttcgtgatccgcccgcctcagcctcccaaagtgctgggattatatgactgagccgtggcgcctggcccygaatatttcagtccggctgccacctgagcaacttcagtacttacagtagctggctatggccacattacatattttcctaatttttttttcctagtgaaaactttttagacacatttgattaagtcaaattcttaagaaaatttgccgccaccagggtaaaaatggcatttgagcaagagccttctattaaacggatgttttacaattgtcctgtcaacccaggacgcccccgccagcccttcagaatgcaattcattttatcacaaaaagattcatacaggaaaactcaatcataaatgt

SEQ ID NO: 111394 - DNA, 601 bp, Human
cagcacccagtggtacgatgtgaccaatataaatctgttgagtaattgaacgatggatgaaacattgctctcctatgtttactgttacatcaatagccttcacatctctgggaacaattcattcattcatgtctgcaggcatgccgcaaacatttattgagcacccactgtgtacaagacattgtgctaagcactgcaacaattcttaaatggtggaaagagtatttcttgcttagtttccagatgtttatctgtggcctattgatgactcactctctttttcccctttgcagatataaaktacttttctcccttcattgtataccctattcttctttggtagctacctaaaaactctctttccataaaactctgctaattaaaatattaatattacttttatttacgggtctagcatcatgcctaggaatagggaatctgtaataaatactcttaaatgaatgaatgaagcaaaagttggttggacatctccatttttgaagtcttttagcacccgaaagcagagcactctttatagttagtgtcttgctgttatatttgccattcactaaaccttagctaaaatatttgtgcctgcctt

SEQ ID NO: 111395 - DNA, 601 bp, Human
agatgcacgcgtacatcaccgtgtcctgcagcccctccatcctgctgcccctccctccttccagcaactcctgctagaaatcaaaacgtgaaccgaggggaggagacagcacctggtttcacaatacctggatatacggattgaaagcagcttctcttgacaaatattaaccattcagtatctacgaacattgatcccacctaacaccaaatgggactcccaaatagcgtttgttgtttatagcatgctatatgtcgacatccacactcagaatcaagtctgcagcaagatcggcctgctrtgaaatatttccccattgcacaaagggaagggcctaagcgtaggtgagggctacacccgtgaagaccgccatcttggcttcatagatacaaccttggatgcacgttcacattgtcattactttccagtcacatttccacccagctttttccatcaggcgacaaacagtaaggtgatggtaacgttgaggctacccgccctatgtggggttcatgacaacacctgtgagacatacacatgcttctcttcttagcttccaggtgtcaacatcgactctgatcacagaactggatacactggc

SEQ ID NO: 111396 - DNA, 601 bp, Human
caatgttccctggggggcagaatcaccacttacataaaagaaccaaagatttgaatttaactaatcacaaaaacaaataaggacaggcctagtttaatgcagatacaatttatcaaaaatatagagatttcattctttcttcattcacatccaaaaattagggaaaatccagtagacacaaactcttagattctcccattaaatgaaaaactttgatatattcacttattctaaaaaaccatagtactggctctgaattgccaccatgcaggttttctcatgtcaccatataatacagctyatattatacatatcagaggatctgtaccacctgtattaaaactattttatagtgttgaagacaaggacacaaaaagctaaataagttgaggaaagggtgaagatttttctgaaactttttttttttttttttttgagatggagtctcactctgtcgcccaggctggagtgcagtggtgcgatctcagctcactgcaagctccgcctcccgggttcacaccatcctcctgcctcagcctcccgagcagctgggactacaggcgcccgccaccgcgcccggctaatttttgtatttttagta

SEQ ID NO: 111397 - DNA, 601 bp, Human
aagggaggcccgaggaaaggaacagagatggggaatggccagtcagtggagcagtcagaacacatatgacatttattgtttgtcatcttatgtgggtatggtttgtggcacccccaaacaattacaacagtaacatcagagatcacaggtcatcacagcagatataataataattaatactaataaaacttgaaatattgtgagaattaccaaaatgtgacacaaaggcacaaagtgagcacccgctgttggaaaaatgacactgacagacttgctcgaagcagggtggccacaaaccttyaatttgtacaaaatgaagtacctgcaaagcgcaataaaatgaagtgcaatgaaaggggggatgtctggaccgcatttggctctctcaatcacttctcactatattttctggcttccttcatccttcctattaggaacctatgttctatcatcttgtgaccactttcctaaattgtaacagctttccagagtggtgaattggtggaatgaactccagaccagttggtaagtgactaaccatgcatttgaaggagggtcaagtagatcatcattcaagaggccagtgttttcctccacattt

SEQ ID NO: 111398 - DNA, 601 bp, Human
ttcccacaataagattgaccaattataaacccagcaagtcaatccctgcgtcctgttcttttgggttagtctgtttgatatctttccatgacatgttgataaacgtgtctaaatccatacacaaagcatacctcggagatatcacgggttcagttccagatcatggcaataaaaaagcaggtattccagtaaagtgagtcatgcaaattctttggcttcccagtgcatataaaattcatgttcacactatactatagtctattaagtgtgcaatggcattatgtttaaaaacactacatamcttaattttaaaatactttattgctaaataatgatcacctgagccttcagtgagttgtaatctttttttgctgatggagggtcttgccttgatgttgatgcctgctgactgatcagggtggtggttgctgaaggttgggtggctgtggcaacctcttaaaataagacaacaatgaagtttgctcttccttcaatgaaagatttctctgcagcatgttgctgtttgatagcattttaccctaagtagaactttttttgaaattggagtcaatcctctcagactctgccactgctttattaa

SEQ ID NO: 111399 - DNA, 601 bp, Human
ctctagcctgggtgacacagcgagactccgtctcaaaaaaaaaaaattgagcatcacatattcaccctctgccagacttgattccctttaccgggcttctggcacttacaaagtaactagagaagaggcttattatcatatcaaccaaattcctgaaacatcttggatgaaatcacatgctcagcagaacatgtattgccttaaaaaatatcaatcctcaactatgttgtaccagttttatgtttacttgtttctaaccaaggtagcacaaggtgtctatgtgaattttatatttcctacrtatttaaattttaaaattgcctttataatgccaactgttattggataatccaccttgcatgataatttttggtgttcaggcttaaaagttttttttccagggtattttattttgtttgttctgagacatggtctcagtctgtcatccaggctggagtgcagtggcatgatcagggctcactgaagctcgacctcaacctcctgggctccagccatcctcccgccagcgtatcctgcccgttgccccaaatagttggactacgggtgcaagccacctctcctagctaattgttttgaattt

SEQ ID NO: 111400 - DNA, 601 bp, Human
ctgtgctaagtccattaccacatacttcatttgactctcaccactcaataaaataggtgcaattatggccccagtttacaaatgaagacactggggtgtagaaaatgtaggtaatatgtctaaggtcactcaggcagcaggtggagatactgggaattaaacccaggacctgcctgacagtgaacttttagtttttggtttacataggaatcatgtgttggtattgaggaaatcatatctaattggaacattcctttcaaaaaagaaataattttattttactgtataaatactaccaacytcaccaagcagtatcagagatgaattaaaatatgaaacaccctgctttgatggctagattttataagccatcctcagagcagcaccaaaataattttaggtataccctagatttccaggatgtttttatactatcaataaagttatgcttgttttaatgaacttttacttcttcatttggaattaaaccaggattgtatttgctgaaatgctctctagcgctttaaaatataaagatgagcccattataaaaaagagctttatcccaaagcaaaattgactacttacggtggaaaaaata

SEQ ID NO: 111401 - DNA, 601 bp, Human
tagccagagttttctgagcagatcagattccattctcaaattatttttatttttctgctgctttcataatttgatgagataatcacccaatacacagaattcctttattatttttattcccatcctttatttgctattttttttcctcatctgtatgtctgtgaaactcttttttgggttgaagcttaattttaagcatagtaaaattaacatttagcatggaaatgtcgatttgaccttgctgaattttcctcatttgttgtttatcttaatctatgaagcaccaccatttaaggatggyttaaacgtgccaagcactgtgctaagtccattaccacatacttcatttgactctcaccactcaataaaataggtgcaattatggccccagtttacaaatgaagacactggggtgtagaaaatgtaggtaatatgtctaaggtcactcaggcagcaggtggagatactgggaattaaacccaggacctgcctgacagtgaacttttagtttttggtttacataggaatcatgtgttggtattgaggaaatcatatctaattggaacattcctttcaaaaaagaaataattttattttactg

SEQ ID NO: 111402 - DNA, 601 bp, Human
ggtattcctgccaaagtgaaagaaataaatataagagcaacccattagcaaactgagaaagaatcaaggacatatattgtcatgctgggagttacttttttcccctttaacaaaggaaaccagtcatgtctgaccttgtctcctgggtcccttgctgagaaggggtgtgtgtggtggtgatggtggcaatcttctctgcattggtcagcaaggtggcattcgaggactctgcaaagagggacagagcataaagaaatgaagaccccagagaagacatcctccagccaggaggtgtgcagargccctgtatctgaataacaagtgtgacttctctgtccccatttcaagcagtctgacttgaatttctagacaattaggagtttaataaaccattttaagatcttctctgatgtgggtcatgtatgtccccatgaccctcctcccaaacagacatctccacaaataaaacagagtttgccaaagaaaacactgctctaaaattctagccaaggtatatgtttctcactcctcccctgccactgaaaaaaggcagtcccatcaaagtgctgcaccacagcagaattctcttccagaactttaa

SEQ ID NO: 111403 - DNA, 601 bp, Human
gggaatatccatacaacaggcatgcacacatgtacatacgcatgtgcacacgcatgtctgtattgacataaacttcagaaggtaatcagattatttataatattgaatcctaaatcaggcaggtgggagacaggtatatgaagattacttagctaaatatttttaaaataatttgctttcctgtaatcccagcactttgggaggccgaggcgggcggatcacgaggtcaggagatcgagacgatcctggctaacacggtgaaaccctgtctctactaaaaatacaaaaaattagccgggcrtggtggcaggcgcctgtaagcccagctactcgggaggctgacgcaggagaatggcatgaacccaggaggcagagcttacagtgagccaagatcgcgccactgcactccagcctgggcgacagagcgagactccgtctcaaaaaaaaaaaaaaaaaaagtttgctttatgaatcacataaaaatacattaaaaaccaatcagtaggaaagtgatattttatttcttcaagattaaaacaacactacttataggatcacattttgtgattaaccatgattcttccttctctcctaataccgc

SEQ ID NO: 111404 - DNA, 601 bp, Human
aacattcacaaaggcaccgttttctacaagacaatcagacattttctgaaaaccattcctctactgctatacaccaggaagttagcttcaagtactaatgggttattttccttagcttcttagttatatctaggatattcttcgggtttttaggaaagagtgtaggatctgagagtcacactgagctgggtttggttccttctctagcattctagaactggctgtgcaactctgaaatagttatttaataccacttggcttcagtgtccccatctaaaaattcagtgaagataatagccgyctctgttgcaatgataaaattaaatgagaaaaagaactgactccacctatatatcatttgttccattaacatcgaataaagtgagtttactttccatcttccaagttaaattggagtctaaatcacaagtttttcctttccgacccaatcctcttttgctttgtacaaccactcccaccccagcctctccaaaaatgcaaatagatgttttatatatttgacgactgaagccccccagatgggcataataactgattgcagatgaggacaattctctctctgctaaccaaagaggagtca

SEQ ID NO: 111405 - DNA, 601 bp, Human
ctagaagccatccttctaatcctctcttggttcatcatcacatcgttctctgtggattcaagccccatggcccatgctgattactaaattcaaacaccatctcccagcctctcacctgacctaacacagtcctcccatagcttcgcctcctctagggagtctgccaaaactagatgaagctttctataagcttctggagcgctgtgtagtttctctcaaaacactcataactttttttcttttttttttgttttttgagacagggtctcactttgtcacccaggctggagtgcagtggcayaatctcagctcactgcaacatctgcctcttgggttcaagtgattctcccacctcagcctcccaagtagctgggactataggcatgcaccaccaagcccagctaatttttatattttttttggtacagaggggattttaccatgttggccaggcttgtgtcgaattcctgacctaaaatgatccgcctgccttggcctcccaaagtgctgggattataggcatgagccactacacccggcctactcatcacttttcttaaaattgtttacattcattcattcatatattacacagagtctt

SEQ ID NO: 111406 - DNA, 601 bp, Human
aaactggagccaccagccatgtgtggctacttaaatttaaatgagtttatgttgaattaaagttaatttaaaacttggtttctcaatcacaagaaccactggctgccataatggacagtacagaatactgaacattcccagcatggaaggaagttcttacaggatagcagtggttctaagggaaacagggtgtgcttgcttcccctccctttctagaagccatccttctaatcctctcttggttcatcatcacatcgttctctgtggattcaagccccatggcccatgctgattactaaaytcaaacaccatctcccagcctctcacctgacctaacacagtcctcccatagcttcgcctcctctagggagtctgccaaaactagatgaagctttctataagcttctggagcgctgtgtagtttctctcaaaacactcataactttttttcttttttttttgttttttgagacagggtctcactttgtcacccaggctggagtgcagtggcacaatctcagctcactgcaacatctgcctcttgggttcaagtgattctcccacctcagcctcccaagtagctgggactataggcatgcac

SEQ ID NO: 111407 - DNA, 601 bp, Human
aaccttcctttcagaagcttttattctaaaactggagccaccagccatgtgtggctacttaaatttaaatgagtttatgttgaattaaagttaatttaaaacttggtttctcaatcacaagaaccactggctgccataatggacagtacagaatactgaacattcccagcatggaaggaagttcttacaggatagcagtggttctaagggaaacagggtgtgcttgcttcccctccctttctagaagccatccttctaatcctctcttggttcatcatcacatcgttctctgtggattcargccccatggcccatgctgattactaaattcaaacaccatctcccagcctctcacctgacctaacacagtcctcccatagcttcgcctcctctagggagtctgccaaaactagatgaagctttctataagcttctggagcgctgtgtagtttctctcaaaacactcataactttttttcttttttttttgttttttgagacagggtctcactttgtcacccaggctggagtgcagtggcacaatctcagctcactgcaacatctgcctcttgggttcaagtgattctcccacctcagcctc

SEQ ID NO: 111408 - DNA, 601 bp, Human
aggaggacttaagaggaagccactgctggccttaattaacaagcaaaatctctggccaggacaaagccaaagaaaatatttttctgacacacatttaaaaattaataggcactgcaaatcaatttttagggctttataaaatatttaaggaggattgtaaccctggaatttaagctaggatgaatcaaatctatatggctttcaaattatacaaatttactattcattcattcatttccttacagaaaacctttttaatgccaggcatgggaaatacaaagtaaaaattggactgaaacaygatcttcacaaccattctatatggcatacatcagttttgtcaagcttcaatgtgcaaacaattaaattacattaagtaatgatcagggtgggcctgagatccatggatcacactgtttgtgtagcaaagccatttgggacagagaaaatcattcctcttttgcagatgacaaacatagaggcccaaagtggcagaaacgcctgccatggagttacatggctggtccaaggtaaatgggggtgggaattgggggtacttgtctgtcttcttcctatgagacaagcttttgcaaataagcct

SEQ ID NO: 111409 - DNA, 601 bp, Human
acacttgagcaaagaagaaattagcacgtgtcaaacaagaaatgcacttaatcttgcatttctacagtggttgtatcaaaggatgtctcatgccttcattgaaggtgtaagtaactaggccaaactgttaactttctcattaactgaagactctttagtgaagtttaggaaagtatgatggttaactattttaaaaataatctgcatagtgagaaaaaaaggagagagacaaagctctaatgaatttaattttcattccttaatcattattatatcacgacatcatgtacattttcaagtyagatgttaaattaaggccaatgtctataaataagaaacttctactgaaagatgtggaacccctccctcgtaatttttatatgcataatttcctaaccatatcactcagtttcagtgccattaaactgaagtagcattcataaaattattaatcatttaaaatcaatgaaaacttcaacatctgcatttatggcagaaataataagtgcttggaaaataaaagttccacttaactttgacaaatatgtgtggattttccattaggtacctaccctcacttttcaagttcaaaatctttctt

SEQ ID NO: 111410 - DNA, 601 bp, Human
aaaccccacgtggcgcctctttagctgaatggcaggcttgactctcagagtcatgcggggtaggaaaaaacccttgccaagctttaacagaaaaccctgtgtcaatggtggcacccagtatgggtcactcttccagtagtggcccatcttcactttcagccactctttcccagtttgatttaggtcccactatagtgtgctatgtgactctcacttgtacataaatagatttttacattttaatttttttattttaatagatacatatatttttaatttgccatagagaaatctcactggyaagttatgataccaatataaagtttgcctttagaatttaagaaaaaaagcaatactttaaaaaattgacttatttttcacttaaagtttaaaaagacagttttatataataagaaattaatcagctgaatacataatagggatggtagtaataagagtttccttttgaaaagttaaaaagtaagctatttttttaaagttattttaaagataacattaaataaataatacatgttctcatatgaacaaaatcacaaagggtggttcatcaagatcaaagtttgaaaaacacagttgataa

SEQ ID NO: 111411 - DNA, 601 bp, Human
attaaaaaattcattactgccggcatccttacaggcctaaaaagttgaggtcactttcccttaataaggggactcgtcaagagggaaccagggcaatatttaaaaaggaggacagtaaaccccacgtggcgcctctttagctgaatggcaggcttgactctcagagtcatgcggggtaggaaaaaacccttgccaagctttaacagaaaaccctgtgtcaatggtggcacccagtatgggtcactcttccagtagtggcccatcttcactttcagccactctttcccagtttgatttaggwcccactatagtgtgctatgtgactctcacttgtacataaatagatttttacattttaatttttttattttaatagatacatatatttttaatttgccatagagaaatctcactggcaagttatgataccaatataaagtttgcctttagaatttaagaaaaaaagcaatactttaaaaaattgacttatttttcacttaaagtttaaaaagacagttttatataataagaaattaatcagctgaatacataatagggatggtagtaataagagtttccttttgaaaagttaaaaagtaag

SEQ ID NO: 111412 - DNA, 601 bp, Human
actagggctaaaaacaaaggaggctatgctgaatagtaaaccttcctcctcattacatttgaatatcaattggtcatctttttacatatacgcaccagcataatgctgaatccaatttagagcaagcctcacagaagattaaaaaattcattactgccggcatccttacaggcctaaaaagttgaggtcactttcccttaataaggggactcgtcaagagggaaccagggcaatatttaaaaaggaggacagtaaaccccacgtggcgcctctttagctgaatggcaggcttgactctcasagtcatgcggggtaggaaaaaacccttgccaagctttaacagaaaaccctgtgtcaatggtggcacccagtatgggtcactcttccagtagtggcccatcttcactttcagccactctttcccagtttgatttaggtcccactatagtgtgctatgtgactctcacttgtacataaatagatttttacattttaatttttttattttaatagatacatatatttttaatttgccatagagaaatctcactggcaagttatgataccaatataaagtttgcctttagaatttaagaaaaaa

SEQ ID NO: 111413 - DNA, 601 bp, Human
tgcatgtttcaaaaggaatactttgtgttttttttttaagacttcacatccaaatctctaggcacattaaaaaaaaaattaaactagaaaaccagaacaaactgtattttatttctggagtgggttagaaaagatatctttcctatccagctagacacagtaatttcagatgggaagaggaaagctgtattgttttagtgcaaacaacctactagggctaaaaacaaaggaggctatgctgaatagtaaaccttcctcctcattacatttgaatatcaattggtcatctttttacatataygcaccagcataatgctgaatccaatttagagcaagcctcacagaagattaaaaaattcattactgccggcatccttacaggcctaaaaagttgaggtcactttcccttaataaggggactcgtcaagagggaaccagggcaatatttaaaaaggaggacagtaaaccccacgtggcgcctctttagctgaatggcaggcttgactctcagagtcatgcggggtaggaaaaaacccttgccaagctttaacagaaaaccctgtgtcaatggtggcacccagtatgggtcactcttccagta

SEQ ID NO: 111414 - DNA, 601 bp, Human
ggacttggttcgcttcggggtcgactgcttagagccagactgaaggctgtgcaaggcatccgtcgtgatcactttcccactgactggctggctaggaggcttgggtgtcccataatagtttcctaggtgatggagagacacatttgcatgtttcaaaaggaatactttgtgttttttttttaagacttcacatccaaatctctaggcacattaaaaaaaaaattaaactagaaaaccagaacaaactgtattttatttctggagtgggttagaaaagatatctttcctatccagctagacmcagtaatttcagatgggaagaggaaagctgtattgttttagtgcaaacaacctactagggctaaaaacaaaggaggctatgctgaatagtaaaccttcctcctcattacatttgaatatcaattggtcatctttttacatatacgcaccagcataatgctgaatccaatttagagcaagcctcacagaagattaaaaaattcattactgccggcatccttacaggcctaaaaagttgaggtcactttcccttaataaggggactcgtcaagagggaaccagggcaatatttaaaaaggag

SEQ ID NO: 111415 - DNA, 601 bp, Human
caggtccattgagggcaacatgatctgacctttacctgtaaagctgctgttcatttcaggaacgtcatcctcctcctcattctccgcgtggactatgccagcattttgcatatcattgtaggacttggttcgcttcggggtcgactgcttagagccagactgaaggctgtgcaaggcatccgtcgtgatcactttcccactgactggctggctaggaggcttgggtgtcccataatagtttcctaggtgatggagagacacatttgcatgtttcaaaaggaatactttgtgttttttttttaagacttcacatccaaatctctaggcacattaaaaaaaaaattaaactagaaaaccagaacaaactgtattttatttctggagtgggttagaaaagatatctttcctatccagctagacacagtaatttcagatgggaagaggaaagctgtattgttttagtgcaaacaacctactagggctaaaaacaaaggaggctatgctgaatagtaaaccttcctcctcattacatttgaatatcaattggtcatctttttacatatacgcaccagcataatgctgaatccaatttagagcaagc

SEQ ID NO: 111416 - DNA, 601 bp, Human
aatctcggctcactgcaatctttgcccttcagggaacacacatcataccctgcaaatggtaccccctggagttgtgcagtactcagcctgtatggccttacccaaaggccttgtccttgaaaatcccttcataaaatacaacatacctaagctcggaggtagacagccctgaatatagataaaatatatataatatagtcagtaatacataggctatataatatagaatgcatatatagatataatgttagaattttacttttccatctttctcccttttaaggcatatagcaattttgcrtaagttaactgaacacataatatccttccattatatctctgctttcaaagatataagaggatgctgctggccttctatacagcatcaactgacattaaactgataaaacacattctcatattttgcttcatagcaaccagccataatgatagagatgctgcaagttaccccccccaaaaaaaatcaatgaacaaaatacagatatttatatacatatatcattttgaagagaaagaaaccatgctgatttctcgtttgccttcttcatacattcacccccagctcctttaaggtattctg

SEQ ID NO: 111417 - DNA, 601 bp, Human
attatttttttttttttttatttatattttttgagacagagtcttgttctgtcacccacactagagtgcagtggtgcaatctcggctcactgcaatctttgcccttcagggaacacacatcataccctgcaaatggtaccccctggagttgtgcagtactcagcctgtatggccttacccaaaggccttgtccttgaaaatcccttcataaaatacaacatacctaagctcggaggtagacagccctgaatatagataaaatatatataatatagtcagtaatacataggctatataatakagaatgcatatatagatataatgttagaattttacttttccatctttctcccttttaaggcatatagcaattttgcgtaagttaactgaacacataatatccttccattatatctctgctttcaaagatataagaggatgctgctggccttctatacagcatcaactgacattaaactgataaaacacattctcatattttgcttcatagcaaccagccataatgatagagatgctgcaagttaccccccccaaaaaaaatcaatgaacaaaatacagatatttatatacatatatcatt

SEQ ID NO: 111418 - DNA, 601 bp, Human
tgagaaaaggccactatgggagaggataatctcatatgttgaaaacggataacttattcatggctataactctaaaatattaaaggcaatatttaagtacaataacaacagaagaaacaaggtgttcgtctaatccacaacactgtagactgaagttactcctatcttactcagctgttacatttggagttactatgtaaggtcaaatcttcatatagtaaaaaatattcttgagctcttctgggtcactgcactaacccaaggaacacgcaacattattattattattattatttttttatttttttatttatattttttgagacagagtcttgttctgtcacccacactagagtgcagtggtgcaatctcggctcactgcaatctttgcccttcagggaacacacatcataccctgcaaatggtaccccctggagttgtgcagtactcagcctgtatggccttacccaaaggccttgtccttgaaaatcccttcataaaatacaacatacctaagctcggaggtagacagccctgaatatagataaaatatatataatatagtcagtaatacataggctatataatatagaatgcatat

SEQ ID NO: 111419 - DNA, 601 bp, Human
aatgtgagaaaaggccactatgggagaggataatctcatatgttgaaaacggataacttattcatggctataactctaaaatattaaaggcaatatttaagtacaataacaacagaagaaacaaggtgttcgtctaatccacaacactgtagactgaagttactcctatcttactcagctgttacatttggagttactatgtaaggtcaaatcttcatatagtaaaaaatattcttgagctcttctgggtcactgcactaacccaaggaacacgcaacattattattattattattatttatttttttttttatttatattttttgagacagagtcttgttctgtcacccacactagagtgcagtggtgcaatctcggctcactgcaatctttgcccttcagggaacacacatcataccctgcaaatggtaccccctggagttgtgcagtactcagcctgtatggccttacccaaaggccttgtccttgaaaatcccttcataaaatacaacatacctaagctcggaggtagacagccctgaatatagataaaatatatataatatagtcagtaatacataggctatataatatagaatgc

SEQ ID NO: 111420 - DNA, 601 bp, Human
ataatgtgagaaaaggccactatgggagaggataatctcatatgttgaaaacggataacttattcatggctataactctaaaatattaaaggcaatatttaagtacaataacaacagaagaaacaaggtgttcgtctaatccacaacactgtagactgaagttactcctatcttactcagctgttacatttggagttactatgtaaggtcaaatcttcatatagtaaaaaatattcttgagctcttctgggtcactgcactaacccaaggaacacgcaacattattattattattattatatttttttttttttatttatattttttgagacagagtcttgttctgtcacccacactagagtgcagtggtgcaatctcggctcactgcaatctttgcccttcagggaacacacatcataccctgcaaatggtaccccctggagttgtgcagtactcagcctgtatggccttacccaaaggccttgtccttgaaaatcccttcataaaatacaacatacctaagctcggaggtagacagccctgaatatagataaaatatatataatatagtcagtaatacataggctatataatatagaat

SEQ ID NO: 111421 - DNA, 601 bp, Human
tcaatgactgcagaaaggaggggtgggctgccttcccagatgcttctggccaataggctccttgatcttttgtctgcacagtcccaacgttacttaggcgtcttagtgagacataccttcttcaaaacactcaagcaaaaggcagctaagatagaaacagcagcaagttattaaaaatatcctggtaaatataatatttaatggcttcataatatttctacattttgatatgatgctcatgcctttatcatagctggcccaagcagaagccgacacctcattatgccactgtcactttacrtgcaaactggctggtggattcctatttaatgtggttcagaacacaaaatgctttgataccactagtttcacatacttatggactgggtagtgttaattatttgaaagatttagcatgagttagtgtatgacagattgtcagctgtcgcaggtacactgttgtaagtgaggggacagtcaacgtgctccatacattgtgaagaggtcccatcacgtgcatatctcaaggccactttttcctcagtgcaccctattggccttcttggtatcagacaagaacgtgaggaacacaatcaggtgt

SEQ ID NO: 111422 - DNA, 601 bp, Human
ttcacagtcagttccatggtgagcatctgggatgactgctcactgttcagcttctgccttaatcaatgactgcagaaaggaggggtgggctgccttcccagatgcttctggccaataggctccttgatcttttgtctgcacagtcccaacgttacttaggcgtcttagtgagacataccttcttcaaaacactcaagcaaaaggcagctaagatagaaacagcagcaagttattaaaaatatcctggtaaatataatatttaatggcttcataatatttctacattttgatatgatgctcrtgcctttatcatagctggcccaagcagaagccgacacctcattatgccactgtcactttacgtgcaaactggctggtggattcctatttaatgtggttcagaacacaaaatgctttgataccactagtttcacatacttatggactgggtagtgttaattatttgaaagatttagcatgagttagtgtatgacagattgtcagctgtcgcaggtacactgttgtaagtgaggggacagtcaacgtgctccatacattgtgaagaggtcccatcacgtgcatatctcaaggccactttttc

SEQ ID NO: 111423 - DNA, 601 bp, Human
aaaagcctagaaacatgattaagaaatgttttgatgtctctcagaggtgttcatgaatgaatctgttactttttagttgtggtgatttgttacacattttctttcttctttcttttttttgagatggagtttcactctgtcacccaggctggagtacaatggtgcagcctcggctcactgcaacctctgcctccggggttcaagtgattctcctgccttggcctcctgagtagcttgtattacaggcacccaccaccatactcagctaatttttgtatttttagtagagatggagttttaycatgttggccaggctggtcttgaactcctgacctcaggtgatctgcccgcctcagtttcccaaagtgctgggattacaggcatgtaatccttgttacacactttctaagttgtctctaataaacacaatatttttgcaaaagtctttgtttgtgtatatatctgtgctttggccaacagtctaactctaccttcattaagcccacataggaagtgttctttctcaagggctctttttaggtcaataatttgggcacaatttgtagaagactgtcccattgctttgtgttcacagtcagtt

SEQ ID NO: 111424 - DNA, 601 bp, Human
caccaccaccaataatctaccacccttgaggaggctgcctgtaggtattcccagccctgcatctatttgctcttctcctgctagcaccactcaggtatccttgtggtgcccctccccactccaggtccacatggtccaggacgggacctactcctggctctacatcatactccttgccaatcaggagtattctatcatttttgtctttgttattaggtcaggaataggtacatgatctaaggcaaacaatttgaatgtcagacatggaagatttactggaaccatgaagccagaggtggtsgcttgaggctggagcctgtttgctaataggttctcatgctgcaggtgctggagccatcttgacaaagcttgacatgacctgccagagaattaagtccacacagaggaaaggagaggtgaaagatgaagaaagtcatctaatatcactgactgagcctctgatctctgatttcatacttgaaatcaaggatgtccctcattttgtttgcttgaacccccaaattcactttcctgcttaaaccaatttgagttagttttgcaacttgcacccaagagtgcagattaatagatcaactataag

SEQ ID NO: 111425 - DNA, 601 bp, Human
aaggtaatctgaaagctggatggaagacatgccaagcctactaaactaacaccaccaccaccaataatctaccacccttgaggaggctgcctgtaggtattcccagccctgcatctatttgctcttctcctgctagcaccactcaggtatccttgtggtgcccctccccactccaggtccacatggtccaggacgggacctactcctggctctacatcatactccttgccaatcaggagtattctatcatttttgtctttgttattaggtcaggaataggtacatgatctaaggcaaacaatttgaatgtcagacatggaagatttactggaaccatgaagccagaggtggtcgcttgaggctggagcctgtttgctaataggttctcatgctgcaggtgctggagccatcttgacaaagcttgacatgacctgccagagaattaagtccacacagaggaaaggagaggtgaaagatgaagaaagtcatctaatatcactgactgagcctctgatctctgatttcatacttgaaatcaaggatgtccctcattttgtttgcttgaacccccaaattcactttcctgcttaaaccaatttga

SEQ ID NO: 111426 - DNA, 601 bp, Human
accagtgagtcagattggaacctcttttgaaaaagttatgttcctgtgaaaaccaagagttacccccagaacagtatcatgtgggtggactgatatgacttgagtcttaaaagaaggctcgaaatacttgagtctccttgccttcttattaactagaaacatcaggggtgatgtcatcaaagtatccccgaatggcattattgacattctggttgaatttttatagaggccgatgatattaaatgtcaatctccacagggctttaaaactgaataatcagggtatgtagtgaatttctatstcccacagtaattctgtagacatttctgatttagcaaaaacagagtgaagaatgataaaaggctgttttcaaagctttctctgatgagaagctcccaatgacacacatgagagtaaaggtaatctgaaagctggatggaagacatgccaagcctactaaactaacaccaccaccaccaataatctaccacccttgaggaggctgcctgtaggtattcccagccctgcatctatttgctcttctcctgctagcaccactcaggtatccttgtggtgcccctccccactccaggtccacatg

SEQ ID NO: 111427 - DNA, 601 bp, Human
tgcattgctcacaatcttggaaatgtcaaagaagaaaccaattcatgactcaaactcttaaactaagaaggccatcaaaacacagatggatctgcaccctcattccataggtatcatttgatttcattagtcagaagatgtttgggcacaaaaaagtatccagggtgaaaacacagacacagtggcattactgtccactcttgtataaacgattttataagttatttttatatttgtataaatatttttggtagacactggcaaagatcaaagaatggttaattaagctgaaacgtatacmaaagtttagaatatggagagagctataccagtgagtcagattggaacctcttttgaaaaagttatgttcctgtgaaaaccaagagttacccccagaacagtatcatgtgggtggactgatatgacttgagtcttaaaagaaggctcgaaatacttgagtctccttgccttcttattaactagaaacatcaggggtgatgtcatcaaagtatccccgaatggcattattgacattctggttgaatttttatagaggccgatgatattaaatgtcaatctccacagggctttaaaactgaat

SEQ ID NO: 111428 - DNA, 601 bp, Human
ggaaaagaaagagagagagatttaggtagaaataatggtatactttactctataaaatagacttctccattttcagtataggccatctcccagttttcaggtagaggacctaaattatcctctgcagaaagaggtaggtattgagggaacttctgagaagggtccgtgatgggagcagcgatgatgctactattcacaggtggtaatgctgtttcttggagagtgtgctcctcttgttcaccagaatcggctgcttaatcatgtgaagaggtgagagagagagagagagaaaaaaaaaaaatggtattcagcaatcataccccatacccgggaagtatgcaactatacacatctatattcttaaatgctcttatcctttcctaattcctggccattaactattacttcgatttcatttagatgtctgtgccttaattagaaagcatcgaaatgatcaatgaaatttattttacttaaaaagaagggggaaaaaatcccaagtaatgcattgctcacaatcttggaaatgtcaaagaagaaaccaattcatgactcaaactcttaaactaagaaggccatcaaaacacagatggatctgcac

SEQ ID NO: 111429 - DNA, 601 bp, Human
gagggaaggaagggaaaagaaagagagagagatttaggtagaaataatggtatactttactctataaaatagacttctccattttcagtataggccatctcccagttttcaggtagaggacctaaattatcctctgcagaaagaggtaggtattgagggaacttctgagaagggtccgtgatgggagcagcgatgatgctactattcacaggtggtaatgctgtttcttggagagtgtgctcctcttgttcaccagaatcggctgcttaatcatgtgaagaggtgagagagagagagagaraaaaaaaaaaaatggtattcagcaatcataccccatacccgggaagtatgcaactatacacatctatattcttaaatgctcttatcctttcctaattcctggccattaactattacttcgatttcatttagatgtctgtgccttaattagaaagcatcgaaatgatcaatgaaatttattttacttaaaaagaagggggaaaaaatcccaagtaatgcattgctcacaatcttggaaatgtcaaagaagaaaccaattcatgactcaaactcttaaactaagaaggccatcaaaacacag

SEQ ID NO: 111430 - DNA, 601 bp, Human
aaattcacaacgcatatcaatgaaaaatgtggttagaaagtaagttatttacttaactcaaacccaactgttaatagatacttctagaactttctgtgcctagaacttgatctacatattaacagaaacaaatgctcacagagaatagatgtaggatatgtgtgtatacatgtataatttgcaaaattgagatccttctcatagttttctgcaatgtcctccccttcgttattgttgacttaacagtagatcagtttcaatctatacgagtataacagatgaatctgtggtattttttttwaatttaatcagccattttctttttctttctcagtggtacattaaaacatggtgaatctcaatgataggataataaagtcaaaatactgcatttaaaaactgactactgttggttaggaaaaccacattatcttagattttccagaatggtttcaaatgtcggcttttttttttccttttcagaaaagctagtatttacattttataaatctgaaagactttcctgtctctctgttctcaaacctaattcatacaccttgcaccatggaaaaatattaacttgcgcattacagacctaaac

SEQ ID NO: 111431 - DNA, 601 bp, Human
aataaataaataaataaataaataaataaataaataaataaatgtgtgtatacacacacacacaaagtataaaaaattcacaacgcatatcaatgaaaaatgtggttagaaagtaagttatttacttaactcaaacccaactgttaatagatacttctagaactttctgtgcctagaacttgatctacatattaacagaaacaaatgctcacagagaatagatgtaggatatgtgtgtatacatgtataatttgcaaaattgagatccttctcatagttttctgcaatgtcctccccttcrttattgttgacttaacagtagatcagtttcaatctatacgagtataacagatgaatctgtggtatttttttttaatttaatcagccattttctttttctttctcagtggtacattaaaacatggtgaatctcaatgataggataataaagtcaaaatactgcatttaaaaactgactactgttggttaggaaaaccacattatcttagattttccagaatggtttcaaatgtcggcttttttttttccttttcagaaaagctagtatttacattttataaatctgaaagactttcctgtc

SEQ ID NO: 111432 - DNA, 601 bp, Human
cttaactaatacacttcttgactctcaagaaaagactgcttcttttatccttatctttaaaaagcatttgtcattaacatgaagacagaaacatgggttgtcccctctctctggctggaaaatagcacagaagctctatttcacttatctcagaactcttcccgcgtagattctcaaagagggtattctttttttttttttttttttttttttttgagacagagtcttgctctgttacccaagctgtgcagtggtgcaatctcggctcactgcaacctccacctcccaggttcaagtgatwctcttgcctcagcctctcaagtggctgggactataggcatgcaccaccatacctggctaatttttgtatttttaaatagagatggagtttcgccatgttggccaggctggtctagagttcatgacttcaggtgatctgcctgccttggcctcccaaaatgctgagattacaggcgtgagccactgcacccggctgtcaaagagggtgttctgagttccaagccttttctctaactctcatatgtttagaaaaatcatactacctaattttcattgttttttctaattataaaacatatgc

SEQ ID NO: 111433 - DNA, 601 bp, Human
tttagttgagctcttaactaatacacttcttgactctcaagaaaagactgcttcttttatccttatctttaaaaagcatttgtcattaacatgaagacagaaacatgggttgtcccctctctctggctggaaaatagcacagaagctctatttcacttatctcagaactcttcccgcgtagattctcaaagagggtattctttttttttttttttttttttttttttgagacagagtcttgctctgttacccaagctgtgcagtggtgcaatctcggctcactgcaacctccacctcccasgttcaagtgattctcttgcctcagcctctcaagtggctgggactataggcatgcaccaccatacctggctaatttttgtatttttaaatagagatggagtttcgccatgttggccaggctggtctagagttcatgacttcaggtgatctgcctgccttggcctcccaaaatgctgagattacaggcgtgagccactgcacccggctgtcaaagagggtgttctgagttccaagccttttctctaactctcatatgtttagaaaaatcatactacctaattttcattgttttttctaatta

SEQ ID NO: 111434 - DNA, 601 bp, Human
tctgggttgctggctctttagctttaagtctggataaatggagtaaaacagaaagggaactcaccacctagtattcctttgatcccatgctccctagccagtctgtcttatttgctcttcctttcaaagtcttcttatgtttgttttctatacaatgccaaaggtttataaatccatgcttgattttttaatgttcttttaaatttctactatttcttcaacttcccaaaaactataaaacaaatgtgtatatatttgcatgtgagtgtacatacacgtacatgcataaacaaggtagatstggttctaatgcggtttaatttgctattcaatggaagatatcctaaaaagaagtgtttcggaatgaaaaacacatgaaaacaaagtaacaagtatatataatttaggctaaaatataaatgatatgtatctaatcacttaatatatatgaaatttgatagttgcagcccaaatcccataattatcattagccacatttttgtataagttttctactaaaccttaggtaaatgaaacattggcttcacatcagctaaaacctaagttataaaaagtaggcaaatcactacattctcttgta

SEQ ID NO: 111435 - DNA, 601 bp, Human
cattactgccaggtggggtggaagtcctgagttccctcaagtggtctccactaaatctatgtggaaataaggggaatttccttactgcctggatgcaaagtgccagctctacacttggccttttctgacgccacccagcagggaggtttcagctcctagtcccacagcctgtcaagcttctacccttggggcgtaggaccacaggtttttctgcactgttgctggagtagaatggttgttggataaaagttttctgtcttgtaggatgcccctttcctgatcctttggctagagagagcasgcttttatcagggctttatttgcctctatctgtaggcatttctgggttgctggctctttagctttaagtctggataaatggagtaaaacagaaagggaactcaccacctagtattcctttgatcccatgctccctagccagtctgtcttatttgctcttcctttcaaagtcttcttatgtttgttttctatacaatgccaaaggtttataaatccatgcttgattttttaatgttcttttaaatttctactatttcttcaacttcccaaaaactataaaacaaatgtgtatatatttgca

SEQ ID NO: 111436 - DNA, 601 bp, Human
tattttagaattctgtttttatatatctacagtactgttgagtatatctcctttgtatagcttttaagtggctgctttaggtactacattacatatatatgcacacattttatatatatatatatataatctataaatatattttatatatcttatagtctactggcatcatcattttaccgctttgactgaagtagataaaccttatctccattgatattcttttaccctccctcacttataatgaattaccttaaatattctctctacacacatttagaaacattaaacagtactattrttgcttcaacactcaaacctaatttggaaaatttaaagagatgccaattatatctcaataaaaatgggaaaaaagaaaactcaaaagatgaagaaaagtattttatttatctatagttttactttctccattcttctcttttcctcattgtttttgttggttgtttttttttttagaattttggtattgttttagaattctctttttgtttagagaacatccattggccatttattgagagtaggcctgctggcagcaaattttcttagttttctttcgtctaagaatattttcattttc

SEQ ID NO: 111437 - DNA, 601 bp, Human
gtgctgtatttagttcactttattaaatgtagttattgatatgttagggcttaagtcttccattttgtttgtaattttctttttgttctgtttttctttcctctgttttatttttctgtgggttacatgaatattttagaattctgtttttatatatctacagtactgttgagtatatctcctttgtatagcttttaagtggctgctttaggtactacattacatatatatgcacacattttatatatatatatatataatctataaatatattttatatatcttatagtctactggcatyatcattttaccgctttgactgaagtagataaaccttatctccattgatattcttttaccctccctcacttataatgaattaccttaaatattctctctacacacatttagaaacattaaacagtactattattgcttcaacactcaaacctaatttggaaaatttaaagagatgccaattatatctcaataaaaatgggaaaaaagaaaactcaaaagatgaagaaaagtattttatttatctatagttttactttctccattcttctcttttcctcattgtttttgttggttgtttttt

SEQ ID NO: 111438 - DNA, 601 bp, Human
ttttcattcagttcaatttatttgcttatctttaatttcccttgagacttcctctttgacccatagattatttaaaagtatgttgtttagtttgcttctaattcattggagattttcctactgtatctgacattaatatgtcaactcttgcttctttcgattaacatttacaagatatatttttccatcctttactttcaacatacctatattgctacatttgaaatcatgcgtcatagatagcacacaattaggtcatgctttttaattcactttgccattccccatcgttaaagtgctrtatttagttcactttattaaatgtagttattgatatgttagggcttaagtcttccattttgtttgtaattttctttttgttctgtttttctttcctctgttttatttttctgtgggttacatgaatattttagaattctgtttttatatatctacagtactgttgagtatatctcctttgtatagcttttaagtggctgctttaggtactacattacatatatatgcacacattttatatatatatatatataatctataaatatattttatatatcttatagtctactggcatcatcat

SEQ ID NO: 111439 - DNA, 601 bp, Human
ttcagggatgccctggccagagaggaggaatctccacctcttattatcttgaatgactttagggtccatagtgactccttacttaattcctaatattgacaatttggtctgctctcatttttttctttgtcaatcttattagaggttcttcaatttttttaatccttttgaagaatcagctatttctttcattgatttttatctattgtttttcagctcttgacaatttctcctcttacctttattatttccttccatctttttgagcttaagttattcttctcttcccaggttcttgcaytgggagtttagattgttaatttgagacttttcctcttttctcatatatatgtttagtgctgtaaatttacctctcatcactgccttggctgtgtcccacctattttaatgtgctgtatttacattttcattcagttcaatttatttgcttatctttaatttcccttgagacttcctctttgacccatagattatttaaaagtatgttgtttagtttgcttctaattcattggagattttcctactgtatctgacattaatatgtcaactcttgcttctttcgattaacatttacaagata

SEQ ID NO: 111440 - DNA, 601 bp, Human
gtgtgtgtgtgtgtgtgtgtgtctgccaggttttggtatcaggatgatgctggcctcacaaagagttagggtggagaccctctttttctattgcttggaatagtttcagaaagaatggtaccagctcctctgtataactctggtagtatttggctgtgaatccatctggttctgggctttttttggttggtaggttattaattactgcctcaatttcagaacttgttattggtctattcagggatgcaacttcttcctggtttagtcttgggtgggtgtatgtgtccaggaatttatccakttcttctagattttctagtttatttgcatagaggtatttatactattctctgatggtagtttgtatttctgtaggatcagtggtgatatcccctttatcattttttattgtgtttattctattcttctctctttcagggatgccctggccagagaggaggaatctccacctcttattatcttgaatgactttagggtccatagtgactccttacttaattcctaatattgacaatttggtctgctctcatttttttctttgtcaatcttattagaggttcttcaatttttttaatccttt

SEQ ID NO: 111441 - DNA, 601 bp, Human
tatggttttaggtcttatgtttaagtctttaatccatcttgagttaatttttgtataaggtgtaagtaagagatccagtttcagttttctgcatatggctagccagtttttccaacaccatttattaaatagggaatcctttccccattgcttgtttttgtcaggtttgtcaaagatcatatggttgtagatgtgtggtgttatttctgaggcctctgttctgttccattggtctatatatctgttttgctactgatactatgctgtttcggttactgtagccttgtagtatagtttaaastcagatagcatgatgcctccagctttgttctttttgcttaggattgtcttggctacatgctctttttctggttctatatgaaatttaaagtagttttttctaattctgtgaagaaagtcaatggtagcttgatggggatagcattgaatctataaattactttgggcagtatggccattttcacaatattaattcttcctatccatgagcatggaatgtttttccatttatttgtgtcctctcttatctccttgagcagtggtgcgtagttctccttgaagagctgcttcacatcccttg

SEQ ID NO: 111442 - DNA, 559 bp, Human
tcttttgaaaagtgtctgttcatatcctttgcccactttttgatagggttgtttttttcttgtaaatttgtttaagttccttgtagatgctggatgttagccctttgaatggatagattccaaacatgttctcccattctgtaggttgcccattcactatgatgatagtttcttttgctgtgcagaagctctttagcttaactagatcccatttgtcaattttggcttttgttgccattgcttttggtgttttagacaygaagtctttgcccatgcctatgtccggaaaggtattgcctagattttcttctagggtttttatggttttaggtcttatgtttaagtctttaatccatcttgagttaatttttgtataaggtgtaagtaagagatccagtttcagttttctgcatatggctagccagtttttccaacaccatttattaaatagggaatcctttccccattgcttgtttttgtcaggtttgtcaaagatcatatggttgtagatgtgtggtgttatttctgaggcctctgttctgttccattggtctatata

SEQ ID NO: 111443 - DNA, 556 bp, Human
tcttttgaaaagtgtctgttcatatcctttgcccactttttgatagggttgtttttttcttgtaaatttgtttaagttccttgtagatgctggatgttagccctttgaatggatagattccaaacatgttctcccattctgtaggttgcccattcactatgatgatagtttcttttgctgtgcagaagctctttagcttaactagatcccatttgtcaattttggcttttgttgccattgcttttggtgttttagwcacgaagtctttgcccatgcctatgtccggaaaggtattgcctagattttcttctagggtttttatggttttaggtcttatgtttaagtctttaatccatcttgagttaatttttgtataaggtgtaagtaagagatccagtttcagttttctgcatatggctagccagtttttccaacaccatttattaaatagggaatcctttccccattgcttgtttttgtcaggtttgtcaaagatcatatggttgtagatgtgtggtgttatttctgaggcctctgttctgttccattggtctat

SEQ ID NO: 111444 - DNA, 601 bp, Human
gcctgtgcttatggggtattactcaagaaatctttgcccactctcatgtcctggagagcttcctcaatgttttgtttcggtagtttcatagttggaggtcttagactaaagcctttaatccattttgatttgactttagtatatggagagagatatgggatagtttcattcatctgtatatggatatccagttttcccaacaccatttattgaagagaccatcctttccccaatgtgtgtgcttggcacctttgtctaaaatgagttcaccgtagatgtatggatttgtttctggttctcyattctgttccattggtctatgtgtctgcttttatgccagtactgtgctgctttggttactacatctctgtactattatttgaagtcaggtaatgtacttcctccagttttattctttgactcaggatatatttggctattctgggtctttcgtggttccatataaattttagaattgttttttatatttctgtgaggaatatctttggtatattgatagggattgcattgaatgtgtagacttctttgagtagtatggacattttaacaatattgattcttccaatccatgaacacggaa

SEQ ID NO: 111445 - DNA, 601 bp, Human
taattctcatcaagattgctgtatatatcaataatcaatttcttctattgctgagtagtattccatgaaattaatgtatcacacagcctgtctaaccactcaaagacatctggatcatttctagtttttggctatttggacaaatttactataaaaattcatgtacatgtttaagtatatctctccatttataaggaacttctttgacctctttcattagcattttatagtttacagtatataagatccaatatatggtttgttagattgacacctgtattatttttttgagcaaccttamattatattttatttttgattttggtaaccaagtattctagtatatagatatacacttgctatttattaaattttaaatttttgtgggtacatggtaggtgcacatatttatgaggtgtagaagatacttcgatacagacatacaatgtgtaatgatcacatcagggtaaatgaagtgaccatctccctcaagcatttattctatgttacaaacaattcaattatattcatttaattatttttaaatgtacaattacattattattgactacagtcaccctgctgtgctatcaaatactaa

SEQ ID NO: 111446 - DNA, 601 bp, Human
aggcagaggttgcagtgagcagagactgtgccactgtactctagcctgggcgacagagtgagatgctgtctcaaaataaaataaaaataaaaataattttaaaaagaatgttatgtaaatggaatcattgtatgtcttactttatgactggcttttcccctcagcataattctcatcaagattgttgtatatatcaataatcaattcttttcattgctgagtagtattccatggaatgaatgtatcacagcctgtctaaccactcaaagacatctggatcatttctagtttttggctattkggacaaatttgttataaacattcatgtacatgtttttgtgtgaatttaagtgttcacttctctgggataaatgatcacgtgtgtcattgccaaatggtatgagctgcatgcttagtttcttaggaactgttttctagaatgccagacaatcccaccagcaatggatgagagatccagtttcactgaatttttaccatcacttagtgttgtcactattttttactttagccatcttaataagcaaatgacatctcattgtggttttcatttccatttccctagagctaactaattttttcc

SEQ ID NO: 111447 - DNA, 601 bp, Human
aacaaaaggtaatatagcaaccaccaccatcaccaccacgtatgactgccagaatctgttcttacaataaccctatgagagaagtattattagcattaaaattattgctccccatattacaaatgagaaaactgataatagaaaggtaaagcaatttgtctaaggacaccctgctgagacatcacagaactgggaattaaacccagaaagttttgcactagaatccacagtctgcactactcctacacagtaagataataacaaggatcattgttaggagaggagattatgcaggattaasaaaaaaactgtgtttaaaacaaaaataactgtagattcacattcagttaaaagaaagaagagagatcccacacaccctttacctagaacccatcaataataacatcctgcaaaactatagtataccgtgacaactaggatactgatactgacacagtcaacatacaaaacattttcatcatcacaggggtccctcacgttgctcttttatagtcacacctggttaccttccaaccattccccccaaccctcttcttaatccctggtaactacgaatctgtcctctatttctataattttg

SEQ ID NO: 111448 - DNA, 601 bp, Human
tatttcttccttaactacaacaaagatgctttccaacagcaaatccaaaccagaagagagcctgagtttacagttataaaatggcttggggagggtcttaggtaggctttttacttacctaacatatgattattcaattactgaaagcttaaaaaataataccagttttatttttgaaaaataagttacaaatgataccccttgcgtataccatctacccttgtctagattattttaggctttgcatttgccacagagaaaacttccatttattttaagtatatctatgacttgagtcttsgatgctgaaactcacaaagagggctgctatttcattcattatattacataagaattctcatgacagcatgaaactaccttaattcacataaatgactcaaaactaccaatacacatcattaaatcacaatgtcctaaattatgctttggacataatgaaggcagccccaaattactcgtcataaatagaatctggaccaaggataagcttggagaggctaaacatgtcactcaactgccttttaagggataaagttcaattctagatgaagtatttcaacagatggtgactggggccctg

SEQ ID NO: 111449 - DNA, 601 bp, Human
atacagatgctgcatcactatataaacaaccactcactacaatggcaaggtcaacaacacgtggtctgggacgtaataacaacacaatcctaagacttaactattcaattcctcagtgaccttcttttattgcaagtgctcctataatgttccttaaactagtcttaattgatttttgtttgtcctgcttggcttttttgtattacccaaataaccatccgtactaaacaaataaagaaataagactgagacaggttatgccaaagttcaagggacacagcgagcatctcttcggttcttycccaatcctcactttacaagactacccattaccaatttgctaactctcgttctagtctctgttcagtcagacattttctttgtaaacataatgtactacaactccgcgtgatgcctgcaggcagacacgcaggttgtaagactgacctttcctggataagctagaatgaaaatcataattggaggagtgcaaactaaagaaacagggattaagcaattcactggggaagaaaaccatgcaggccatgtcatgcacgtgtcatgcagcagcagcaggcagggagggtttacctagttcact

SEQ ID NO: 111450 - DNA, 601 bp, Human
ttgttggcatgtgcatcaattacaacagacaggttccaaatgttaagaaaaacagagcttggttctattctatcataattctagccaaccatgactgattatctttatctcacgtaacaaaaataaagaaaaccaaatgaatgcaataatctatactaaatagacttatattttcaggtctttaggcaatctcaaaaatgccaggcagattcaataatcttagtacagttccactcatactgatgttaaacaatcttctacttaaacaatcttcaattgctaaagaatcttccatcagccraggctttcatcagcaatttagctgaaacttatgctttcctatgtatccatcagcaaatgtatcagacggaatgcaaactaattttaatgttgttcaaggttgaacataaaggactgaacgtaatagcaaacgtaattcaatatattccaatagcaaagaaacaagaatttggcatcatctgctagtataaattattcctaaacaacaataactagagtagtcaagacttgatttgcattgacacaactctaaggcaaacagtacatacagatgctgcatcactatataaacaaccactca

SEQ ID NO: 111451 - DNA, 601 bp, Human
acttctttcctgaaaatttcaaattcaaatttccagagaagcaaataaggttgtgctatctccactggctgccagcagacagcagagtgatctgtcacacctattacttaggtagcaagagtggttgaaattggctgaacaaatgattaagacactcattttgtgtctggaaaacctatttctgtctctttcatttactttatctaatatcattggattgacaaattcttttttcgatcaaattagtttcaaattgttctatcattcagggtgaaccttaagtcatccctctcacaatgamcacaaagacaacttattaaacatctttaaaaatagatccatcaatagttattgaccattgttggcatgtgcatcaattacaacagacaggttccaaatgttaagaaaaacagagcttggttctattctatcataattctagccaaccatgactgattatctttatctcacgtaacaaaaataaagaaaaccaaatgaatgcaataatctatactaaatagacttatattttcaggtctttaggcaatctcaaaaatgccaggcagattcaataatcttagtacagttccactcatactga

SEQ ID NO: 111452 - DNA, 396 bp, Human
tcactaatttaaataatgatgtcatcagggcagaaggcttacatataccacaaacagttccagactgaggtagaggcatgcacatgcacacaaacacatacaggctaattactcaaagtttatgttttgttcagatttggctgcacatcaagagacattaatttcatagtttttgctccacatgttacttgtttgcaaacaaagagacaggttttccccccttttcttctaaatcaaaaagaaaaaacatttagcaagttttaaagaagtctttgacttgtaggagacataagctactaamatgcaagacaggtccaatttgcagatgttgatacaacttggcatttgtatatactgagtactgcggaccgatgcaaattgaatgcctaggaaatg

SEQ ID NO: 111453 - DNA, 601 bp, Human
ggctggcccatctttctcagcacttaacctgtgaaagcagtaacacagctcctgatccctaagagctcactatctaaggcggatgattttatttctttaaatgtggtggtacaatggcactgggggatgtatgtgcctttctgaaaactcaaccatgctctacagaacttcctaaggtttcatatcaaaggccaaaactttattaaacaggtaatagttctgtctgaacaagaatctgttgtggaaaggcccactgcaccatattattttacttggtgaaagaagggactaggttgtgggttttttttgtcattaaacaatcctttcaggcagaacaacagttattcaacttaattttaaagcttccctgatacacgtagtcaaggcaaacttatgtaacaccacactctaaagtgaataattagtcctagaagtagctattaagaccaactttgatagaatactacaaacttgaaatatttgaaatagatttttgtttaattcaaggaatcatgtggtcactaatttaaataatgatgtcatcagggcagaaggcttacatataccacaaacagttccagactgaggtagaggcatgcac

SEQ ID NO: 111454 - DNA, 601 bp, Human
gggctggcccatctttctcagcacttaacctgtgaaagcagtaacacagctcctgatccctaagagctcactatctaaggcggatgattttatttctttaaatgtggtggtacaatggcactgggggatgtatgtgcctttctgaaaactcaaccatgctctacagaacttcctaaggtttcatatcaaaggccaaaactttattaaacaggtaatagttctgtctgaacaagaatctgttgtggaaaggcccactgcaccatattattttacttggtgaaagaagggactaggttgtggkttttttttgtcattaaacaatcctttcaggcagaacaacagttattcaacttaattttaaagcttccctgatacacgtagtcaaggcaaacttatgtaacaccacactctaaagtgaataattagtcctagaagtagctattaagaccaactttgatagaatactacaaacttgaaatatttgaaatagatttttgtttaattcaaggaatcatgtggtcactaatttaaataatgatgtcatcagggcagaaggcttacatataccacaaacagttccagactgaggtagaggcatgca

SEQ ID NO: 111455 - DNA, 601 bp, Human
taaggcacacagtaaagtcacgagggttttagacttttaaaaatgggaaaccagaacctcaggcaagagagaaacaaagaaacacacaaagtctgcatcctaggctagttctccattttctcctcaatcctggcaacatttcataaattaccgtggctgaaccttttgaaatgtatgaatgaataaagaagtaattgctaaggagttcagatctgggtagagcaaaaagtagacgaatcagatactccttgtaaagataaacaatccctcttcatctggtctactgaatcctggcttttctcattcattcattcattcaactaatactcattaagtacctgccatataccaggacgatgttgggcctttgtgatgcagtggtgaacaaaagacatggatcctgcccatgtgaatttaataatatgatttgctattttcagatttattgaatattttctcattcattaatatatgcatacatattttcatcataaaattaatattgttaattggtttgtgccttataatgatgtcaggctgtacttaacacaaatgtacataattatagagaggtataaactaatgtgtggattgtgaatgg

SEQ ID NO: 111456 - DNA, 601 bp, Human
gacaaagatccaaacacttagacggctacaaaactaattatatatatacacatatatatgtatacatatgtatatgtgtacatgtatacatatacatatatacatatatatgtatacacatatatgtacatatatatggtacatatatgtgtgtatatatatacacacacacacatatatacacacacaagcatatacgtataaatatacattatttattgttttttgagacagtctctctctgtcacccaggctggagtgcagtggtgcgatcttggctcactgcaacttctgcctcctrggttcaaccaattctcctgcctcagcctcctgagtagctgggattacaagcgtgcatcaccatacccggctaatttttgtattttcagtagaaatggcgtttcaccatgtaggccaggctggtctcgaactcctgacctcaagtgatccacctgctttggtctccccaaatgctgtgattacaggcatgagccaccatgcctgaacttatttttcttaattcaaaataatagtttattagaaatttaggagcatagtattgtgattatttagaactctaagttttttaaaaagctaggct

SEQ ID NO: 111457 - DNA, 601 bp, Human
tccctggaatcaaactgagcagagcaggtggtctgagatgctaaccctcgtgtgttaaaatgctcagttagaaagaggaaataaaaatgaagtttccattactgactgcttatatgcactaagcactgggctaccagttttatatgcattttatttaaaagtcctcagtaaatgccaggaggtaagtcctatttttattcatatcttatgaataaggaaagtaagtgtctgggcagttaaatacctcacctagcataatatagctagtaagcaggaaacaggcatgcaagctcagggttgyctgctttcaaatcccaggattttaaccactgaccccactccaaatgtccaagataccacctgacaggggaagctgctttaattcaataagaagtagattaaggaattattgagacataagattaaagtggctatgtgacattgtctgtaacatacaatgccagaactgctgtgtaactgtctgcagtagggttcacagaaacaaaagcattcatccaaacaatgaagttaaacaaagaattccactcacatctgttaactattttgatcactaaacatagaggcacaattaaaagtacag

SEQ ID NO: 111458 - DNA, 601 bp, Human
gtattcagcttgaaacagttcatcccaccagcaaaatgccaatcagaccaagtccctggaatcaaactgagcagagcaggtggtctgagatgctaaccctcgtgtgttaaaatgctcagttagaaagaggaaataaaaatgaagtttccattactgactgcttatatgcactaagcactgggctaccagttttatatgcattttatttaaaagtcctcagtaaatgccaggaggtaagtcctatttttattcatatcttatgaataaggaaagtaagtgtctgggcagttaaatacctcayctagcataatatagctagtaagcaggaaacaggcatgcaagctcagggttgtctgctttcaaatcccaggattttaaccactgaccccactccaaatgtccaagataccacctgacaggggaagctgctttaattcaataagaagtagattaaggaattattgagacataagattaaagtggctatgtgacattgtctgtaacatacaatgccagaactgctgtgtaactgtctgcagtagggttcacagaaacaaaagcattcatccaaacaatgaagttaaacaaagaattccactca

SEQ ID NO: 111459 - DNA, 601 bp, Human
aatagtattcagcttgaaacagttcatcccaccagcaaaatgccaatcagaccaagtccctggaatcaaactgagcagagcaggtggtctgagatgctaaccctcgtgtgttaaaatgctcagttagaaagaggaaataaaaatgaagtttccattactgactgcttatatgcactaagcactgggctaccagttttatatgcattttatttaaaagtcctcagtaaatgccaggaggtaagtcctatttttattcatatcttatgaataaggaaagtaagtgtctgggcagttaaatacytcacctagcataatatagctagtaagcaggaaacaggcatgcaagctcagggttgtctgctttcaaatcccaggattttaaccactgaccccactccaaatgtccaagataccacctgacaggggaagctgctttaattcaataagaagtagattaaggaattattgagacataagattaaagtggctatgtgacattgtctgtaacatacaatgccagaactgctgtgtaactgtctgcagtagggttcacagaaacaaaagcattcatccaaacaatgaagttaaacaaagaattcca

SEQ ID NO: 111460 - DNA, 601 bp, Human
cttgtttaaaagaaaaagaaaactaaacacaaatattttctataatttaagagcaatgaggcctgaaagttgcaaggttctggagcttccaattttcaagaataatcctctataaaggcctcatcctatgtgtgaatgtaaacaaacaagacctattgaaacgttgtaaacatgcataaataccaaaactgcagcaagaatagggaatgagaactgaaaacacaatatcaaaccattttcatttataggaaagtcttagacaaaacctaatatgttggctagactcttgaaatatctaatrctgagtttcagatttatcttttttaacatactattaaatatctgtggtctctaagtcagtgattcctatctctgggatgggtttgctccccagagacatctggcaatgtctggggacaatttccttgtcacaatgagaggtgggctgtgtgctactggcatctagtggccaggggacatctcacaatgcccaggacaaacccacacaacaaagaattacttaccccaaaatggcaatggtgctgagattgagaaacgttggtttgaatgatcatttaacaagtagtctttatttttaaaa

SEQ ID NO: 111461 - DNA, 601 bp, Human; identical to SEQ ID NO: 29285

SEQ ID NO: 111462 - DNA, 601 bp, Human; identical to SEQ ID NO: 29286

SEQ ID NO: 111463 - DNA, 601 bp, Human; identical to SEQ ID NO: 29287

SEQ ID NO: 111464 - DNA, 601 bp, Human; identical to SEQ ID NO: 29288

SEQ ID NO: 111465 - DNA, 601 bp, Human; identical to SEQ ID NO: 29289

SEQ ID NO: 111466 - DNA, 601 bp, Human; identical to SEQ ID NO: 29290

SEQ ID NO: 111467 - DNA, 601 bp, Human; identical to SEQ ID NO: 29291

SEQ ID NO: 111468 - DNA, 601 bp, Human; identical to SEQ ID NO: 29292

SEQ ID NO: 111469 - DNA, 601 bp, Human; identical to SEQ ID NO: 29293

SEQ ID NO: 111470 - DNA, 601 bp, Human; identical to SEQ ID NO: 29294

SEQ ID NO: 111471 - DNA, 601 bp, Human; identical to SEQ ID NO: 29295

SEQ ID NO: 111472 - DNA, 601 bp, Human; identical to SEQ ID NO: 29296

SEQ ID NO: 111473 - DNA, 601 bp, Human; identical to SEQ ID NO: 29297

SEQ ID NO: 111474 - DNA, 601 bp, Human; identical to SEQ ID NO: 29285

SEQ ID NO: 111475 - DNA, 601 bp, Human; identical to SEQ ID NO: 29286

SEQ ID NO: 111476 - DNA, 601 bp, Human; identical to SEQ ID NO: 29287

SEQ ID NO: 111477 - DNA, 601 bp, Human; identical to SEQ ID NO: 29288

SEQ ID NO: 111478 - DNA, 601 bp, Human; identical to SEQ ID NO: 29289

SEQ ID NO: 111479 - DNA, 601 bp, Human; identical to SEQ ID NO: 29290

SEQ ID NO: 111480 - DNA, 601 bp, Human; identical to SEQ ID NO: 29291

SEQ ID NO: 111481 - DNA, 601 bp, Human; identical to SEQ ID NO: 29292

SEQ ID NO: 111482 - DNA, 601 bp, Human; identical to SEQ ID NO: 29293

SEQ ID NO: 111483 - DNA, 601 bp, Human; identical to SEQ ID NO: 29294

SEQ ID NO: 111484 - DNA, 601 bp, Human; identical to SEQ ID NO: 29295

SEQ ID NO: 111485 - DNA, 601 bp, Human; identical to SEQ ID NO: 29296

SEQ ID NO: 111486 - DNA, 601 bp, Human; identical to SEQ ID NO: 29297

SEQ ID NO: 111487 - DNA, 601 bp, Human
ggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttarccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatt

SEQ ID NO: 111488 - DNA, 601 bp, Human
tacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatamattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacag

SEQ ID NO: 111489 - DNA, 601 bp, Human
aactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggyaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaagga

SEQ ID NO: 111490 - DNA, 601 bp, Human
ttcattaatttcaaaatactggttttggcaaggggaattaagtcattataataaaagacaaatcacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccytgtatctgtggttcttaatcagagaggagcttcagaatcacctagaaaattttcaaaattatgtgtttccagggaaaatgatttagtaagtctaagacccccatgcagctgtatttttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaa

SEQ ID NO: 111491 - DNA, 601 bp, Human
tagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcrattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaaga

SEQ ID NO: 111492 - DNA, 601 bp, Human
aatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggwttaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaac

SEQ ID NO: 111493 - DNA, 601 bp, Human
ctaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagacyatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactatta

SEQ ID NO: 111494 - DNA, 601 bp, Human
ctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaagaacaaggagtgagagaagcattctaggtagagaaactcaaagtcaggagtgtcaaagaacacagggcataaaaatttgccagaacaaatactgcagagtttggtataccagacagagtacacyaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggt

SEQ ID NO: 111495 - DNA, 601 bp, Human
tttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaagaacaaggagtragagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttata

SEQ ID NO: 111496 - DNA, 601 bp, Human
tgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaasaacaaggagtgagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaact

SEQ ID NO: 111497 - DNA, 601 bp, Human
tttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacaygcttaaaataaagggactcaaatgctctgagaatcctgaaaaaccaaccactaacttttcctgggtttagaggagtgccatttgagctggctcttgatggaaaaataagcaggcatttaccaagaacaaggagtgagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaa

SEQ ID NO: 111498 - DNA, 601 bp, Human
agcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccaytttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcat

SEQ ID NO: 111499 - DNA, 601 bp, Human
acactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatamaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgac

SEQ ID NO: 111500 - DNA, 601 bp, Human
ttactcataattaactcaataaacatactagattttacatttaatatatgttaaaatgtctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagatgtgcgccaccacacccggctaattttttgtatttttagtagagacggggtttcaccatgttggccacactggtctcraactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttt

SEQ ID NO: 111501 - DNA, 601 bp, Human
ttgtaagcatctgaatatacctaatactgaaataagagtttaaaaagctgacaacacaatccaagttttacatttatttactcataattaactcaataaacatactagattttacatttaatatatgttaaaatgtctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagawgtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataa

SEQ ID NO: 111502 - DNA, 601 bp, Human
agaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatgkctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagatgtgcgccaccacacccggctaattttttgtatttttagtagagacggggtttcaccatgttggccacactggtctcgaactcctgacctcaggtgatcaccttggcctcccaaagtgctgggattacaggcgtga

SEQ ID NO: 111503 - DNA, 601 bp, Human
agttcaacaatctgtaaaagaaactacatggcttttggccttcaaaaaattgtaacagaaaatattaactgaaccaaatcagtatttcagaagcttttttttttttgcaacttaaattatccactattaagaaaatgacttttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggct

SEQ ID NO: 111504 - DNA, 601 bp, Human
agatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgacttttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccag

SEQ ID NO: 111505 - DNA, 601 bp, Human
tttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccacyggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttc

SEQ ID NO: 111506 - DNA, 601 bp, Human
agtggctcacgcccgtaatcccagcactttgggaggctgagaagggtggatcacctaaggtcaggagttcaagaccagtgctgctaacatggtaaaaccccatctctactaacatcacaaaaattagccacgcatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaaaccccagaaaagctgaacgtaytcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaa

SEQ ID NO: 111507 - DNA, 601 bp, Human
caaaaaagctagactgggcacagtggctcacgcccgtaatcccagcactttgggaggctgagaagggtggatcacctaaggtcaggagttcaagaccagtgctgctaacatggtaaaaccccatctctactaacatcacaaaaattagccacgcatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaamccccagaaaagctgaacgtactcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaattta

SEQ ID NO: 111508 - DNA, 601 bp, Human
gaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacagtggctcacgcccgtaatcccagcactttgggaggctgagaagggtggatcacctaaggtcaggagttcaagaccagtgctgctaacatggtaaaaccccatctctactaacatcacaaaaattagccacrcatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaaaccccagaaaagctgaacgtactcatatacaaaagaccaagtactagaaagcaaaagaaaggatgcctaaataaaaaagatacaacagagaagcagaggcgagaggacagcttgagcgcaggagttcgagaccagcttggataacatagtgag

SEQ ID NO: 111509 - DNA, 601 bp, Human
gaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacaktggctcacgcccgtaatcccagcactttgggaggctgagaagggtggatcacctaaggtcaggagttcaagaccagtgctgctaacatggtaaaaccccatctctactaacatcacaaaaattagccacgcatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaaaccccagaaaagctgaacgtact

SEQ ID NO: 111510 - DNA, 601 bp, Human
aggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacagtggctcacgcccgtaatcccagcactttgggaggctgagaagggtggatcacctaaggtcaggagttcaagaccagtgctgctaacatggtaaaaccccatctctactaacatcacaaaaattagccacgcatagtggcacacgcctgtaatcccagctactcgggaggatgatacaggagaatcacttgaacctgggagggagaggctgcagatcgcgccactgca

SEQ ID NO: 111511 - DNA, 601 bp, Human
caatccactaactctattttctacctgaaaacaaaccaaaaaaactctcatggggctaagtaccttttttgttttctaatctccttattctctcaactcaacctttttttttttttttaaactcagcatccatttttaactattgaaattttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacrggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaaga

SEQ ID NO: 111512 - DNA, 601 bp, Human
gtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaaca

SEQ ID NO: 111513 - DNA, 601 bp, Human
aaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctwcaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaata

SEQ ID NO: 111514 - DNA, 601 bp, Human
ccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcracatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcac

SEQ ID NO: 111515 - DNA, 601 bp, Human
aatatcagaggcaataggtaaggaagtcaatttcttctaattacatcaattcttgttggaaactaaccttaatacagtaccccacgcccccctccccaaaaaaacccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctaytgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaa

SEQ ID NO: 111516 - DNA, 601 bp, Human
actgcaacctccacctcccaggttcaagtaaattctcgggcctcagcctccaaagaagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgtttwttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacata

SEQ ID NO: 111517 - DNA, 601 bp, Human
caaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaycttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagaagctggaattacaggcatgtgccactacacccagctaaaaatgctggtattcttataggttgattttctactcttaactgctgacccataaaaat

SEQ ID NO: 111518 - DNA, 601 bp, Human
tatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacratcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttca

SEQ ID NO: 111519 - DNA, 601 bp, Human
tcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgyagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaa

SEQ ID NO: 111520 - DNA, 601 bp, Human
acagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttayctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaa

SEQ ID NO: 111521 - DNA, 601 bp, Human
aaattaacccaggaaagcaaaatcagaattttcctagagtggaaacctcaggattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaartaactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataat

SEQ ID NO: 111522 - DNA, 601 bp, Human
attagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgaygaaaaatccattcttagccgttgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagtttttaccttaaccagttcaacatactgatgtataagatgtcaagcattaaggaacatagatcgcattcactttgagtgcctgctatgtgccagtcaccatatatggtggtgctgttataaaatgttaagatataa

SEQ ID NO: 111523 - DNA, 601 bp, Human
atatatatatatatgcacaggagaatttttatattgtttaaatattaactagctttatttcaaaccaagaaccaaatatggtccaacaactttcctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctccyggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctg

SEQ ID NO: 111524 - DNA, 601 bp, Human; identical to SEQ ID NO: 20573

SEQ ID NO: 111525 - DNA, 601 bp, Human
gcacaatcttggctcactgcaatctctgcctcccaggttcaagtaattctcctgcctcagcctcctgagtagctggtcttgaactcctggcctcaagtggtccacctgcctcagcctcccaaagtgttgggattacaggtgtgagccactgtgcccaggcagaactggaccttaaaccaaggttttctgcctctatgtaccatgctcttcttctctatcaggctgttatctgtttgggaagatctaaaaatagggagtggcttggcatgcatgggtgggacaatacagacaatacaagagraacccaaaaaacaggagagtggggcagaaggaatgagatctggcgagggaggggcaaaggggaggggagatggtagaatctctgagaaaagacagttcaggatcactggccacaacggctaatctctgatgcttgtgctgaccagctcactgacccggaacctggcagatgaaatggctcatgtagggattgacgccagaaaggacaacccaggttttaagaagcatttgaggcagccccctccactctccagggcaaaggtcacagacccagagtagagggtaggtggagcctctccat

SEQ ID NO: 111526 - DNA, 601 bp, Human; identical to SEQ ID NO: 111525

SEQ ID NO: 111527 - DNA, 601 bp, Human; identical to SEQ ID NO: 111525

SEQ ID NO: 111528 - DNA, 601 bp, Human; identical to SEQ ID NO: 111525

SEQ ID NO: 111529 - DNA, 601 bp, Human; identical to SEQ ID NO: 18654

SEQ ID NO: 111530 - DNA, 601 bp, Human; identical to SEQ ID NO: 18655

SEQ ID NO: 111531 - DNA, 601 bp, Human; identical to SEQ ID NO: 18656

SEQ ID NO: 111532 - DNA, 601 bp, Human; identical to SEQ ID NO: 18657

SEQ ID NO: 111533 - DNA, 601 bp, Human; identical to SEQ ID NO: 18658

SEQ ID NO: 111534 - DNA, 601 bp, Human; identical to SEQ ID NO: 18659

SEQ ID NO: 111535 - DNA, 601 bp, Human; identical to SEQ ID NO: 18660

SEQ ID NO: 111536 - DNA, 601 bp, Human; identical to SEQ ID NO: 18661

SEQ ID NO: 111537 - DNA, 601 bp, Human; identical to SEQ ID NO: 18662

SEQ ID NO: 111538 - DNA, 601 bp, Human; identical to SEQ ID NO: 18663

SEQ ID NO: 111539 - DNA, 601 bp, Human; identical to SEQ ID NO: 18664

SEQ ID NO: 111540 - DNA, 601 bp, Human; identical to SEQ ID NO: 18665

SEQ ID NO: 111541 - DNA, 601 bp, Human; identical to SEQ ID NO: 18666

SEQ ID NO: 111542 - DNA, 601 bp, Human; identical to SEQ ID NO: 18667

SEQ ID NO: 111543 - DNA, 601 bp, Human; identical to SEQ ID NO: 18668

SEQ ID NO: 111544 - DNA, 601 bp, Human; identical to SEQ ID NO: 18669

SEQ ID NO: 111545 - DNA, 601 bp, Human; identical to SEQ ID NO: 18670

SEQ ID NO: 111546 - DNA, 601 bp, Human; identical to SEQ ID NO: 18671

SEQ ID NO: 111547 - DNA, 601 bp, Human; identical to SEQ ID NO: 18672

SEQ ID NO: 111548 - DNA, 601 bp, Human; identical to SEQ ID NO: 18673

SEQ ID NO: 111549 - DNA, 601 bp, Human; identical to SEQ ID NO: 18674

SEQ ID NO: 111550 - DNA, 601 bp, Human; identical to SEQ ID NO: 18675

SEQ ID NO: 111551 - DNA, 601 bp, Human; identical to SEQ ID NO: 18676

SEQ ID NO: 111552 - DNA, 601 bp, Human; identical to SEQ ID NO: 18677

SEQ ID NO: 111553 - DNA, 601 bp, Human; identical to SEQ ID NO: 18678

SEQ ID NO: 111554 - DNA, 601 bp, Human; identical to SEQ ID NO: 18679

SEQ ID NO: 111555 - DNA, 601 bp, Human; identical to SEQ ID NO: 18680

SEQ ID NO: 111556 - DNA, 601 bp, Human; identical to SEQ ID NO: 18681

SEQ ID NO: 111557 - DNA, 601 bp, Human; identical to SEQ ID NO: 18682

SEQ ID NO: 111558 - DNA, 601 bp, Human; identical to SEQ ID NO: 18683

SEQ ID NO: 111559 - DNA, 601 bp, Human; identical to SEQ ID NO: 18684

SEQ ID NO: 111560 - DNA, 601 bp, Human; identical to SEQ ID NO: 18685

SEQ ID NO: 111561 - DNA, 601 bp, Human; identical to SEQ ID NO: 18686

SEQ ID NO: 111562 - DNA, 601 bp, Human; identical to SEQ ID NO: 18687

SEQ ID NO: 111563 - DNA, 601 bp, Human; identical to SEQ ID NO: 18688

SEQ ID NO: 111564 - DNA, 601 bp, Human; identical to SEQ ID NO: 18689

SEQ ID NO: 111565 - DNA, 601 bp, Human; identical to SEQ ID NO: 18690

SEQ ID NO: 111566 - DNA, 601 bp, Human; identical to SEQ ID NO: 18691

SEQ ID NO: 111567 - DNA, 601 bp, Human; identical to SEQ ID NO: 18692

SEQ ID NO: 111568 - DNA, 601 bp, Human; identical to SEQ ID NO: 18693

SEQ ID NO: 111569 - DNA, 601 bp, Human; identical to SEQ ID NO: 18694

SEQ ID NO: 111570 - DNA, 601 bp, Human; identical to SEQ ID NO: 18695

SEQ ID NO: 111571 - DNA, 601 bp, Human; identical to SEQ ID NO: 18696

SEQ ID NO: 111572 - DNA, 601 bp, Human; identical to SEQ ID NO: 18697

SEQ ID NO: 111573 - DNA, 601 bp, Human; identical to SEQ ID NO: 18698

SEQ ID NO: 111574 - DNA, 601 bp, Human; identical to SEQ ID NO: 18699

SEQ ID NO: 111575 - DNA, 601 bp, Human; identical to SEQ ID NO: 18700

SEQ ID NO: 111576 - DNA, 601 bp, Human; identical to SEQ ID NO: 18701

SEQ ID NO: 111577 - DNA, 601 bp, Human; identical to SEQ ID NO: 18702

SEQ ID NO: 111578 - DNA, 601 bp, Human; identical to SEQ ID NO: 18703

SEQ ID NO: 111579 - DNA, 601 bp, Human; identical to SEQ ID NO: 18704

SEQ ID NO: 111580 - DNA, 601 bp, Human; identical to SEQ ID NO: 18705

SEQ ID NO: 111581 - DNA, 601 bp, Human; identical to SEQ ID NO: 18706

SEQ ID NO: 111582 - DNA, 601 bp, Human; identical to SEQ ID NO: 18707

SEQ ID NO: 111583 - DNA, 601 bp, Human; identical to SEQ ID NO: 18708

SEQ ID NO: 111584 - DNA, 601 bp, Human; identical to SEQ ID NO: 18709

SEQ ID NO: 111585 - DNA, 601 bp, Human; identical to SEQ ID NO: 18710

SEQ ID NO: 111586 - DNA, 601 bp, Human; identical to SEQ ID NO: 18711

SEQ ID NO: 111587 - DNA, 601 bp, Human; identical to SEQ ID NO: 18712

SEQ ID NO: 111588 - DNA, 601 bp, Human; identical to SEQ ID NO: 18713

SEQ ID NO: 111589 - DNA, 601 bp, Human; identical to SEQ ID NO: 18714

SEQ ID NO: 111590 - DNA, 601 bp, Human; identical to SEQ ID NO: 18715

SEQ ID NO: 111591 - DNA, 601 bp, Human
cattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaagggaaaagaaagaaaaggaaagaaggaaggaaggaagcaagaaagaaaaaagagaaagaaagaaagggagaaaggaaggaagggaagaaggaaggaaggaagggaaaagaaagaaaggaaaggaaagtaaagaaagaaagraaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatatttaaaatgaaagtta

SEQ ID NO: 111592 - DNA, 601 bp, Human
aataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaagggaaaagaaagaaaaggaaagaaggaaggaaggaagcaagaaagaaaaaagagaaagaaagaaagggagaaaggaaggaagggaagaaggaaggaaggaagggaaaagaaagaaaggaaaggaaagwaaagaaagaaagaaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatattt

SEQ ID NO: 111593 - DNA, 601 bp, Human
aaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaagggaaaagaaagaaaaggaaagaaggaaggaaggaagcaagaaagaaaaaagagaaagaaagaaagggagaaaggaaggaagggaagaaggaaggaaggaagggaaaagaaagaaaggaaaggaaagtaaagaaagaaagaaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatatt

SEQ ID NO: 111594 - DNA, 601 bp, Human
aaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaagggaaaagaaagaaaaggaaagaaggaaggaaggaagcaagaaagaaaaaagagaaagaaagaaagggagaaaggaaggaagggaagaaggaaggaaggaagggaaaagaaagaaaggaaaggaargtaaagaaagaaagaaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatat

SEQ ID NO: 111595 - DNA, 601 bp, Human
aaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaagggaaaagaaagaaaaggaaagaaggaaggaaggaagcaagaaagaaaaaagagaaagaaagaaagggagaaaggaaggaagggaagaaggaaggaaggaagggaaaagaaagaaaggaaaggaaagtaaagaaagaaagaaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttcc

SEQ ID NO: 111596 - DNA, 601 bp, Human
gagaaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaagggaaaagaaagaaaaggaaagaaggaaggaaggaagcaagaaagaaaaaagagaaagaaagaaagggagaaaggaaggaagggaagaaggaaggaaggaagggaaaagaaagaaaggaaaggaaagtaaagaaagaaagaaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagt

SEQ ID NO: 111597 - DNA, 601 bp, Human
gaagggagaaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaagggaaaagaaagaaaaggaaagaaggaaggaaggaagcaagaaagaaaaaagagaaagaaagaaagggagaaaggaaggaagggaagaaggaaggaaggaagggaaaagaaagraaggaaaggaaagtaaagaaagaaagaaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgta

SEQ ID NO: 111598 - DNA, 601 bp, Human
gtcaatggacttcccattaagctctttgatgtgcgtatgtgagtgcgcatttttctgaagctaagagggtctatagcttctattagcccgtgaaaagggtcggagacacaaaactgattaattgcctgtgtactaatttaatctgaggtccctcttaacttgtgaaatcttacgaagctataaatagaattaaaattttagatggaaaccaggaattaatataattattatccctaataagattatttgaaaagcatattttgtacaaaggggtaccaccatgaccaaccatgcattcaarcattagctgaagaacttcactagaagcccagtaaggatttgccatcattagcatccattgcaccagacactagacatgtaagtacatgtagtaaatctaaatatatcacagatatttttgttctgcctttttattatcagagttttaatgggctatcaaggtaaggctgctacttaggattacatgaagtggaaacaacccagtaatagtttgccagcaaataaaacttctttctcacaattttcaagatattcatccaaaatcattttgattgtaacttttggatagctgaatagcact

SEQ ID NO: 111599 - DNA, 601 bp, Human
tgtttccctgttgcttaatattctgaagcaataaaatcctctagttaaatctagttgtccataactgaatgtataaagacccaaaggaaggtaagttttgaggaagtgcttggggaagtgatatagtggctggaaaagtactactggtgtccagtctattccaaatgactgtgcaatcttggactacccacttcctctgtagatttctgtttcctcatctctacaatcagaagattgatctgaacagagggtctgtcaatggacttcccattaagctctttgatgtgcgtatgtgagtgcrcatttttctgaagctaagagggtctatagcttctattagcccgtgaaaagggtcggagacacaaaactgattaattgcctgtgtactaatttaatctgaggtccctcttaacttgtgaaatcttacgaagctataaatagaattaaaattttagatggaaaccaggaattaatataattattatccctaataagattatttgaaaagcatattttgtacaaaggggtaccaccatgaccaaccatgcattcaaacattagctgaagaacttcactagaagcccagtaaggatttgccatc

SEQ ID NO: 111600 - DNA, 601 bp, Human
aaggttatccagtcaggtggtgtatgagcagagaggaagactagccattttcactctcagtccaatgtttatttccacaactatgctgcaatttctaggttctatggcttcattttcatattagaaatcagtaagaaactatactacctataagggaaatatctccaaatgattaattttgtcacatcacttagatttctgctttaaatattaaaataaatagaagtatttttagatgggtggaaagcaaacccagttttgtaaaagattaagcactttcatgctccatttgcaatttatmttgtatgccttaaatgcaggtgaataaaagacggtacatgtttccctgttgcttaatattctgaagcaataaaatcctctagttaaatctagttgtccataactgaatgtataaagacccaaaggaaggtaagttttgaggaagtgcttggggaagtgatatagtggctggaaaagtactactggtgtccagtctattccaaatgactgtgcaatcttggactacccacttcctctgtagatttctgtttcctcatctctacaatcagaagattgatctgaacagagggtctgtcaatgg

SEQ ID NO: 111601 - DNA, 601 bp, Human
cagtcattaataagcatttcaagcaaaaagagtttgcttatttctatttaccagggtcattttgatcaaagtttaaaaaatgaaataaattatttcaaagttcataatgaacaaattaaatactttcattgaaaccatccagattttttagcatcccatagatgtgaccacaattgcagacatttattagagtattctttgaattattatagaaactcagaactttattgctaaattagacttcaacaattttctagtagagcttcctcattttatgagaaagacttttaggagatctgcraaaggttatccagtcaggtggtgtatgagcagagaggaagactagccattttcactctcagtccaatgtttatttccacaactatgctgcaatttctaggttctatggcttcattttcatattagaaatcagtaagaaactatactacctataagggaaatatctccaaatgattaattttgtcacatcacttagatttctgctttaaatattaaaataaatagaagtatttttagatgggtggaaagcaaacccagttttgtaaaagattaagcactttcatgctccatttgcaattta

SEQ ID NO: 111602 - DNA, 601 bp, Human
atagtaagtcaaaggaaatgagtaaaaggatacttagatattatattcacaatgtcaaacctgacattttaaaacctgctttttttttattcatctagcacacaactggctagctatccttttatgaattaagtcaggattattacagaatatacacgtgtcaatccatttgaaatcaagatttaaaaaaagttgttcataatatattgatgtaatttttccaaaatggcattgcttaggaacttcattctgattttgaacaacaataaataacatcgctgaacctggatgttttaagtayccaaggcaacagacatttcaagcttatttcttgcgtgaaaactattaatcatcatgtagataagtcgtgtctcaatgggatatgataacgaagctgactgctgtattatttgtcaggcagtggcttcacagtttattcaggacttttgctctctaaaactccagaaaattacaaaaatataaaaacttcaggatccaactcttttagagcattccatgtggcatgaaagagatgctcattagttcagcaaggatttatttgagcaccagccacaagcaagacactgttgaggagctggga

SEQ ID NO: 111603 - DNA, 601 bp, Human
aatatttctccagtcctgacatctcttattactaccttgttataaaattattttaagattatgcctgtgacctgtgtgtgcttcttcaaagaaatctgaaatgttgcctgtgacctgtgcttgtttgtgaaatcaacattaaatgattcagctgatggcaacatacatcatctgattaatcatttaatcagagggtccataacactcaagtgtttaaaaataaattttcatgaagcccaacatgacagccatagtaagtcaaaggaaatgagtaaaaggatacttagatattatattcacratgtcaaacctgacattttaaaacctgctttttttttattcatctagcacacaactggctagctatccttttatgaattaagtcaggattattacagaatatacacgtgtcaatccatttgaaatcaagatttaaaaaaagttgttcataatatattgatgtaatttttccaaaatggcattgcttaggaacttcattctgattttgaacaacaataaataacatcgctgaacctggatgttttaagtatccaaggcaacagacatttcaagcttatttcttgcgtgaaaactattaatc

SEQ ID NO: 111604 - DNA, 601 bp, Human
tcattaaattaaaagtgtacattattcatcacaatccataatgtaactgaattcattcctatgaactgaattccaattagatttatcatattgttgttgtgaacaccagagaaaagtaggacagtcccacatctaagcaggaagataaaatatatatccgttctttatttccattttttcacttacttgttcaataaataatctatttattcaacaagcataatttctggctcagtattctttgcattagtattcactatgacattaataagaattaaatgctactttggaattttcacargtaactgcttagtgattccagaatcacctggtagaaggggatatttaaattgcaacttaaaaatccaaatgttgttaaaagttttaataaaatttcttataaaaattacttcatatacgagttgacaaattgttcattttctccttgtagaagaacaattaaattgatgagatgtatcatctaactctcatacacgtaattatatatttgcatgacaaatacaattggcatctcatttacctcatttctgtacccttgaatatcacgtaaacatattttgtcctgatttttaaatacttt

SEQ ID NO: 111605 - DNA, 601 bp, Human
gacttatgtcaccccattgtaagcatagatagttaaaatctatttgatttcattaaattaaaagtgtacattattcatcacaatccataatgtaactgaattcattcctatgaactgaattccaattagatttatcatattgttgttgtgaacaccagagaaaagtaggacagtcccacatctaagcaggaagataaaatatatatccgttctttatttccattttttcacttacttgttcaataaataatctatttattcaacaagcataatttctggctcagtattctttgcattagtrttcactatgacattaataagaattaaatgctactttggaattttcacaagtaactgcttagtgattccagaatcacctggtagaaggggatatttaaattgcaacttaaaaatccaaatgttgttaaaagttttaataaaatttcttataaaaattacttcatatacgagttgacaaattgttcattttctccttgtagaagaacaattaaattgatgagatgtatcatctaactctcatacacgtaattatatatttgcatgacaaatacaattggcatctcatttacctcatttctgt

SEQ ID NO: 111606 - DNA, 601 bp, Human
aattttcgatttttgtgaggattcccaatagccaaatagaaaaaaagtgtgtatacatgtgaattggagatgacttgatattaaggattgtcagacttatgtcaccccattgtaagcatagatagttaaaatctatttgatttcattaaattaaaagtgtacattattcatcacaatccataatgtaactgaattcattcctatgaactgaattccaattagatttatcatattgttgttgtgaacaccagagaaaagtaggacagtcccacatctaagcaggaagataaaatatatatcygttctttatttccattttttcacttacttgttcaataaataatctatttattcaacaagcataatttctggctcagtattctttgcattagtattcactatgacattaataagaattaaatgctactttggaattttcacaagtaactgcttagtgattccagaatcacctggtagaaggggatatttaaattgcaacttaaaaatccaaatgttgttaaaagttttaataaaatttcttataaaaattacttcatatacgagttgacaaattgttcattttctccttgtagaagaacaa

SEQ ID NO: 111607 - DNA, 601 bp, Human
ccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattcgtatttagtggagattatcttttaaaggtgcctactttagatatgtcataatattagaaattaaggatgaagtatttctatctatctatgctttgtaggacaattacattaatcccaaagttacstgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggattcccaatagccaaatagaaaaaaagtgtgtatacatgtgaattggagatgacttgatattaaggattgtcagacttatgtcaccccattgtaagcatagatagttaaaatctatttgatttcatt

SEQ ID NO: 111608 - DNA, 601 bp, Human
caaaatggtgcagttaaaccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattcgtatttagtggagattatcttttaaaggtgcctactttagatatgtcataatattagaaattaaggatgaagtatttctatctatctatgctttgtaggacaattayattaatcccaaagttacgtgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggattcccaatagccaaatagaaaaaaagtgtgtatacatgtgaattggagatgacttgatattaaggattgtcagacttatgtcaccccattgtaagcatagatagttaa

SEQ ID NO: 111609 - DNA, 601 bp, Human
gagtgagagagagaagaccaactctctgttccctgaattcaagcccatgccctccacaccatgccatgttttccctgtatatgaccaaacaaaatggtgcagttaaaccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattcgtatttagtggagattawcttttaaaggtgcctactttagatatgtcataatattagaaattaaggatgaagtatttctatctatctatgctttgtaggacaattacattaatcccaaagttacgtgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggattcccaatagccaaataga

SEQ ID NO: 111610 - DNA, 601 bp, Human
agatgacatcatccagtagagtgagagagagaagaccaactctctgttccctgaattcaagcccatgccctccacaccatgccatgttttccctgtatatgaccaaacaaaatggtgcagttaaaccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattmgtatttagtggagattatcttttaaaggtgcctactttagatatgtcataatattagaaattaaggatgaagtatttctatctatctatgctttgtaggacaattacattaatcccaaagttacgtgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggat

SEQ ID NO: 111611 - DNA, 601 bp, Human
cttaatggactgtcctgcctttgagtgtgagtaaaaggggctgagatcattcatcagccaattttacagctgcaatctacttagacctgcccccatctaggtcaccaaggatctttgtcagcatttggtacaaagcctatgtgaatgaagatggtcatttctttggtgttgtcccaagaaatgtaacagaaaatgactataaaagaatggattctgatatgggatgctgagtcctgataatctctctaaatgtctttcatctaggacctgcaatcagccattattaagaaaaagagaaaargattgcaggggacagttccaattaacctgtggcatcccaaatctgtgttttactgaacacctagaactattctccatgggtttggcgtcaaagaggcattaggaaagatggtaactattcctcttacatacaatattaaggcctttgagatttgcttcagcttaacagagatacttttaaactttgttaatttaaatgtttcccaaaattatttgagcagagaatccattctaattataccatgtgcataatactcaatggaatcacatgactttggggaaatcagaggaaaactaatag

SEQ ID NO: 111612 - DNA, 601 bp, Human
tggctgtgcagtaaaagtgcaggatgaaaccagactctctgaagggtagggatattcccgtccctatccctcatcttttccccctttgcagataaaccatcccactttcaaatgaacttgggaggagggggctttgaactgtgcttggggttgtttctcctctggaaatgcttccattctaaaaagttctggcatagggaattggcctaaggaaaaactctgccctccttccccttaatggactgtcctgcctttgagtgtgagtaaaaggggctgagatcattcatcagccaattttacrgctgcaatctacttagacctgcccccatctaggtcaccaaggatctttgtcagcatttggtacaaagcctatgtgaatgaagatggtcatttctttggtgttgtcccaagaaatgtaacagaaaatgactataaaagaatggattctgatatgggatgctgagtcctgataatctctctaaatgtctttcatctaggacctgcaatcagccattattaagaaaaagagaaaaagattgcaggggacagttccaattaacctgtggcatcccaaatctgtgttttactgaacacctagaac

SEQ ID NO: 111613 - DNA, 601 bp, Human
atagaattctgaagtagtgaattgtttccttactgtttaacacattcttgcagtttgtctttttaaaattaaaatcaggaattctgggcagttagttgtttttgaagacaatgtcatttatctttgctttaagaaggaaacagtctacatttaacaaacaattcattttctacatattaattgagcagtgaaaatatggttggcaggtctgaagaacagggaaaaagacagtgtagttagagtgtagttggagggtggcatacaaggagaaaagggataggaagtaagaagttactgaggkccagataatgtagggcctttaaaacacagtaaagatttgcatttcattctatgtatgataagaggtcactggatggttgggagcagagggggatgtgatctggtttctttcttaaaagaattattccgactgctcaagaatggactaggttgggtgtctaagtggaagcaggcagatcagttcagaggttagggaaggagtccaggtgagaaatgatgaaggcctagcctagggtggtaacagtagagaagggagacatggtaagactggggatacattttgaattacagtgtaggtaaa

SEQ ID NO: 111614 - DNA, 601 bp, Human
ccacgtatccatgtacaataagtagtgctgttataaacatataagaaaatgagctatcatgataagtatacagcatagagttaagtttattagaataccctcatattctataatatacaaaattactaacgtgcagtgaaatcatatagaattctgaagtagtgaattgtttccttactgtttaacacattcttgcagtttgtctttttaaaattaaaatcaggaattctgggcagttagttgtttttgaagacaatgtcatttatctttgctttaagaaggaaacagtctacatttaacraacaattcattttctacatattaattgagcagtgaaaatatggttggcaggtctgaagaacagggaaaaagacagtgtagttagagtgtagttggagggtggcatacaaggagaaaagggataggaagtaagaagttactgagggccagataatgtagggcctttaaaacacagtaaagatttgcatttcattctatgtatgataagaggtcactggatggttgggagcagagggggatgtgatctggtttctttcttaaaagaattattccgactgctcaagaatggactaggttgggt

SEQ ID NO: 111615 - DNA, 601 bp, Human
ttacatgtgaaagaaggtagtaatgtaaatagaacctaatataattttttatgggctcatttatgttctgcattttcttataaaattactttttagattgttttgctgctcgaatcattactggttgctatctagggatcaccttcaaacccctttcaaaatacaatgtttaaaaaaaataaaaacaagggcctggcacaatggctcacacctgtatcccagcactgttgggaggccgaggcaggagaattgcttgagcccaggagttcgaggccagcctgggcaacatagagagacgctrtctctataataaataaataaataaatatttttggaaaaacaaatgctgttaaaatgcatttctagcttaggtcacataaaggatctgaaatgggcatgtaaacaatggcaagtttttatatatatcaattaacaggtcttgaaaaaagtattgactctactggcttgtgtgaaatttccctgaatgaaatcagacaatggtgttctcagaaacaatgcatcttagaagagttaatatcagccaaagacattatatcatactaacttctctcccaataaaatgcctagaaaacaatgtatc

SEQ ID NO: 111616 - DNA, 601 bp, Human
aataactattacacagagatgcttgttccttcttcctaaggcctaagaacatttctcactcattcttctatcctagaattcataatggtatatggcactgcacagaaattcattaaatgttagtgaaatattacatgtgaaagaaggtagtaatgtaaatagaacctaatataattttttatgggctcatttatgttctgcattttcttataaaattactttttagattgttttgctgctcgaatcattactggttgctatctagggatcaccttcaaacccctttcaaaatacaatgttyaaaaaaaataaaaacaagggcctggcacaatggctcacacctgtatcccagcactgttgggaggccgaggcaggagaattgcttgagcccaggagttcgaggccagcctgggcaacatagagagacgctgtctctataataaataaataaataaatatttttggaaaaacaaatgctgttaaaatgcatttctagcttaggtcacataaaggatctgaaatgggcatgtaaacaatggcaagtttttatatatatcaattaacaggtcttgaaaaaagtattgactctactggcttgtgt

SEQ ID NO: 111617 - DNA, 601 bp, Human
cagtctttttgttcattcacctattgaggaacatcttggttgcttccaagttttggcaattatgaataaagctgctataaacgtgcatgtgcaggttttggtgtggacacagtttacatttcctttgggtgaatatcatgtagcatgattttggatcatatggtgatatggttaggctttgtgtccccacccaaatctcatcttgaattataatccccataatccccacatgtcaagggagagaccaggtggaggtaactagatcatgagagctgtttcccccatgctgttctcatgatarcgagtgagttctcacgagagctaatggttttatgtgtttggtagttcctcctgcattcattctccttcctgtcaccttgtgaagtaggtgccttgcttccccttctccttccaccatgattataagctttctgaggcctcctcagccatgctgagctgtgagtcaattaaataaacctctttcctttataaatttcccagtctcgggaacttctttttagcactgtgaaaatggacaaatatatatgttaagtatagtttagcttcgtaagaaattgtcaacctatcttccaaagttact

SEQ ID NO: 111618 - DNA, 601 bp, Human
ttatttgatacaacttattcaaaatgttatagtttctacatgtaatctataaaaaaattactgagaaattttatgggtttttttcataatatgtcttgaaatctgttgtgtattttacccctatatctcaactcaggctagctacttttgaaatgcttgatagcaacatgtgtctagtcactatggtattgtacagagtaggtgtagagatcaacaggaaacatttattgagtacctatataagaaattatactagataccagggaaaccaaaaagaaaaaaagtcatctgtaagaagttyagcaggagcaacacagtgaacagattccagcagagattatggcagagattactgtgatcttgggcaaaagtgtgtatcttaggaatttaagatttaagaaagaattttaggcatgaactatatgacaaacatacataaaggcaggagaagcctgctatgctctggtgacaatggatcaaccagtattagagaattcacatgatagatactgaatttcctggatgctcagtggttagctaagtcttaagtttatgaatgaacaaatgacacaagatacaacattagaacgaggatggagaa

SEQ ID NO: 111619 - DNA, 601 bp, Human
tattgtgttgttaccagttagagctattaagagtaatgctatcgtgaataattctgtacaagtcattgtatgaacatatgcttccattaatcttaagtaaatacctaggggtagaacttacagatgaagaaacagaagtacagcatgtaagtgactttgcacaagtaggcagcacaggttttctgactttaaatctatgctcttaactcctatgccgtattgttcttcatgggaagaaaagctatttttcttgacccatttaaactttccataatgtttaatcaaaatattcaatatttargttaaaaacagcaaaatctgggatacaaggtgtaccaacctcaagtaaacatgccaggtgtttggaaaagtagaagaataatgaaccttactacatgcaaactgtgcaatagttacatgtagaatgcatctcaaaaaaaaaaaggttcctggaaaccacagtgctatgaaaagataatcatagaaaacaaggataaatttgaataccacatactcattttaagaaaaattttcactgagagaaaaaatttaaagcaagttgatggcatataaacatccttgaaattcttcaagtgaatac

SEQ ID NO: 111620 - DNA, 601 bp, Human
atgcatgactcctcaacaagtaacctttgttggaagccaagactttcttgtaactgcactgtaatctgtggctattcctacccaattctccttccttctgcctccctttgaagtgatatcacaactacattgtggtttttccttgcctggtttttctcctgttctctttctacctttcatagctattgcctgcaataaatctcttgtggatggttgtaattctaacaccatcttggaatcagcttcctgaatgactgaactgatgcctctacctccagcaagcatggatcttgttgttacyatggatgacatttgtcttttctggaattatagtatgtactgatttgtgcctggcatcacacagcatgatagttttgagattcatccatgttgttgaggttatcagtagtccattccatttttgttgctaagtagtattctgctgtatgaatacagcacaattgttgattgattattgtgttgttaccagttagagctattaagagtaatgctatcgtgaataattctgtacaagtcattgtatgaacatatgcttccattaatcttaagtaaatacctaggggtagaacttacagatgaa

SEQ ID NO: 111621 - DNA, 601 bp, Human
atgtacatttcttgagttttgatgcattaataaacccatgtaacgaccaccacaattgagaaatcatatatcttcattattttccccaattttcctttgtgcctttttctagttaattccttctccttctcctccacctccaccccagccccatgggggtagccatgaaggtacacctcttggatcttttctctccaattagctgccaggagtgctattggcctcctgctgcagcagcaatgggatccaccacagcacaggaacccagactggcctccagccaatgactgggagcagcaasgaaactacagcccagacatgtctgcctaatgcatgactcctcaacaagtaacctttgttggaagccaagactttcttgtaactgcactgtaatctgtggctattcctacccaattctccttccttctgcctccctttgaagtgatatcacaactacattgtggtttttccttgcctggtttttctcctgttctctttctacctttcatagctattgcctgcaataaatctcttgtggatggttgtaattctaacaccatcttggaatcagcttcctgaatgactgaactgatgcctctac

SEQ ID NO: 111622 - DNA, 601 bp, Human
cccttatgaaaagtggtgagaattcaaatagttctcgaaccctatttgtcatatcacttcctgaaaggatactcaatctcttaatttttttctattattttgtactttatggaaaaatatttaggaagattatagaaagaaaatttttaggaagtagcgtctctagttttcctaaaatttatgtcaaacccggcattatttattttacatataaaaagatcataacttttactctttgttaaaactatattaaaacaaaagagaagcaacccactaaataataattgattaatttcatttsgaggtcttctatgtttagtatgtttatggactttttaaacactgaggattcactaattttttttttttttttttttgagacaggatcttacttttttgcccaggctggagtgcagtgatacaatcacagctcactgcaacctcaaccatccaggctcaagtgatcctctcacctcagctaccagactagctgagactacgggggtgtgccaccatgccaggctaattttcgtatatattttttttttggtctaactgtgttgcccaggctggtcatgaactcctaggctcaagtgatctg

SEQ ID NO: 111623 - DNA, 601 bp, Human
tcccacataaaattaaagctgttttagttctcatcgcatttatcatcttgaactcatttgccacattattttatttaaatattccttaacctacagagagtggacttaactgctaaaaagtacttaatacatgttcccaaggaactgcttcaattaccactgcacaaaggtttgtttgtttttaataatacagtattattactagaagtatcatcaagtcatggaatggtcaaaatattcttacttctattgctagggtgttagaaaggactctggactacttgatgtctagatgcagataaaaaaagcagctgttcacttcacataaagtagccgctactgcttaaaggtaagggtaaatcttgttcactgtggatgaaggttactaaagagaaggactaacatataaaataggttcaaatatatacggagatatagacttaaaaaattaagacttctccttcaattaatattccaagaaaagaaactccatattgccatctaaacacagaagcttttctgtaatggtattccagtgaaagtcatttaaattcgaatagaaaaatttaacttgagatctgcccttatgaaaagtggtgag

SEQ ID NO: 111624 - DNA, 601 bp, Human
tcacagttttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatttttgtatttttagtagagacagcgtttcaccatgttggccaggatggtctcgatctcctgacctcgtgatccacccacctcagccttccaaagtgctgggattayaggcgtgagccaccgcgcccggcctcttgtagtttttaaaattaaatttaatccaataaaacatttagtttgcctttatttggaatttgttatctattgttatatactctattaatacctcctcttcagcaaggaaattttcttacatctgcttacacgtacatcatttgttagagcccctaaatattggtaatgatgatgatgatattatagcatgaattactttacgttgaacattggcctaagtgctttaaacacattatttgcctagcatttacaacatttttgtaggtattattt

SEQ ID NO: 111625 - DNA, 601 bp, Human
tcctcttatttacaaatggggaaacagggtatacgagtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactstaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatt

SEQ ID NO: 111626 - DNA, 601 bp, Human
aggaacatcacgacattttcttgcctcttagatggtttgtattttggatgcttctgaagagaaacaaagacatatagaatttaaacattatctgtgtttatttgtagaatacttattttttgtattttgttttttaaatgagtatgtctgatatctcatacatttagaatatttgtaatagaatagcaaatttccaccatggaatcagtggagagctatgcaatttaacaactgcaaagaatcttagagatccttagagtaacacatcctcttatttacaaatggggaaacagggtatacragtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttt

SEQ ID NO: 111627 - DNA, 601 bp, Human
gtctacctgatatggacatttaaattcattaaaaattctgagtttaagaaaacagctaagaggttgagaaatcagagttggctgcccaacttacaattctccttgctgaccagcatcttttggctgcctctcaaaataacaggataaggcacacaaaactgaattcttcacttggattaaatctgaatcttccttctcttattcctttgcttataaaatatcttcctaggcttgagacagtctagagaccacctgagaacactgaatgttccttttgagtatccagtagcataactcacaytgtcaacaaggccttacttacgtgtgctgaacatttttatatttttgtatcctttatcacaaaccaaacactgcttagttataaaatatatgtgtaagtcaacataattttttttgtcaaagcaaagatttttctccaaaatatagctacagaagaaaaggggcttataacaagtgtatagtacacattcagaaacattttgtttcatggatgtttcagtaaatgcttcatttctatgtaggaggtataagattcctgctaaaaatacattcccttccctgaatattcacaatagcttgc

SEQ ID NO: 111628 - DNA, 601 bp, Human
ccaaaaacacctaccatggacttatgtgaatgagaatcaacctctactgtgtttgagcattttaattgacattcatttaacactatttaatatacagatgttcagtagatgttcactaaatgaattaagtttttgtagtttgattttctgaagaatttgaaacagatcaaatgtatagagaagtttcaagaacagtcaaagagtccctctatccacttcacccagaattcctaattattaacattttacctcatttgctccctctgcctaacacatggatgtatttgtgcgtgtgtgtgagtgtgtgtgtgtgtgtgtgtgcgtgtgtgtgcgtatctttttccagcacaatggtgcattaaccctaagtacttcagtaagtacctctctaaagcaaggattctcttctacactaacactgtaaaactgtcacaaccaggaagtcaacactgatagaacactgccatccaagccagaggatgattaaattattatgtgcttattgggtgctcaattgggtgttcagcatgacaagtatcataaccaccataatcatcctggctttctctttcatccaccatctctgtctctctctcttttc

SEQ ID NO: 111629 - DNA, 601 bp, Human
ggggctgcaacttgggaggagtctgggttcctcaatctccctaagggagaaactcacccacctgccaaaaacacctaccatggacttatgtgaatgagaatcaacctctactgtgtttgagcattttaattgacattcatttaacactatttaatatacagatgttcagtagatgttcactaaatgaattaagtttttgtagtttgattttctgaagaatttgaaacagatcaaatgtatagagaagtttcaagaacagtcaaagagtccctctatccacttcacccagaattcctaattrttaacattttacctcatttgctccctctgcctaacacatggatgtatttgtgcgtgtgtgtgagtgtgtgtgtgtgtgtgtgtgcgtgtgtgtgcgtatctttttccagcacaatggtgcattaaccctaagtacttcagtaagtacctctctaaagcaaggattctcttctacactaacactgtaaaactgtcacaaccaggaagtcaacactgatagaacactgccatccaagccagaggatgattaaattattatgtgcttattgggtgctcaattgggtgttcagcatgacaagta

SEQ ID NO: 111630 - DNA, 601 bp, Human
taaaaactatgcttgtagaatgtctcatttatatgacaacagaacgactgagtgaaatggagcttaatattaagtctgttaagaggttagggacaagccaaagacagagtgagactctgtctcaaaaaaaaaaaaaaaaaaaagtaactcagagataaataaaagtaagttctgagctgacatccataaatgctttgtggcattagatgctgctaagagtgaattatttccatgaagccaagatcaagctgttgcacaagctgtacattaattacttgaaaaaaattcccagtagggcaaygtctaaatatatttccatgagaatagtatatatatttgttataaaggtgatgatctagccaagagggtgtctgacctccaaaatatatccactaataaaaaaaatccaaggagcatttggataacagtggttaaaaaaaattgcaaaacagatggacttcacattttgggcatgactacacacgtggccagatcaatcccagtgattcttccatgcaaatatgttagtgtgattagttgattgtaggaaatgtggcatttgcattactaatatgttttgttcttgtcatggttgtaaaaa

SEQ ID NO: 111631 - DNA, 601 bp, Human
accacaaagctcagattgttataataaaaggagggaaacaaagctccctgttgaagaaaatttttgcacacttgatatacaatatttctactaatgaacagagaaagcttgacttgaaaggacacatttatattagatgtcatccctatctagaggccattactatcaagcatctgtcaggtaaaggagatgagatgcctgtaattttttctttaaatattgttttttctaagttgtgttggaaatggggagttgcaagtttgtatttccattgcttaaaaatagaaaacagatgaagaarggagatatcatcagcagaacatagaagatttcataatacggaggctaaaactcttaagaaaaagcaatatttattctagtgcccaacctaccatgagaaagttgtgcgactttgggcaagttatttaattcctctgggtctgaagatgagtctgcacacaagagcctataatgatcccttccaacaccgggactggcgggtctgcagccacagttacatctggaaactccactggtgcttttggagcttcccaagagtatcaggaattcaatatgcagtcataaaaaattttgggtcatg

SEQ ID NO: 111632 - DNA, 601 bp, Human
aaatcttaaaagtatgacaactaaatggatgctaagacaattgtgtttcaactgtgggcttataaactctattgagaaactcatttatgatcatgagttttttccaggatggacatataaagatggatttttaaaacactggcctggagaatagggagagaagaggtaataaaaaagtatttatattacttatatgagacatatctttttataatatctatatttaaaacattttaaagtataaatatttctgtactataatacaatatacagtattatagtttatggtctgtgatttacrgtaattactgtgggtcattttttctgaattaattttataagtgaacaagcaaagtgaccaagagaatgatctatgatccagaaataactttcaatgataaaaaacctgaagtacaacaaagaagtcagaggcagggctagacaaaatggaactaaatatactaagaaggtgcagaaaaagaagagaagagtatgttgtggcttaaccccatatttccccatggcagaaggacagaaactaaatctgagggcaactcaacagtagtcaataattatcagccaaatcaatggatgaataggt

SEQ ID NO: 111633 - DNA, 601 bp, Human
taagaatattacaaaaaatttcctaacatttatataacataattctcaaagtagatagagccaaataactgacttctgctagttttttttccagatatttgtcttttatgtacatggccagaaaccacttagaacttgcataaaaacaagttaagaagcaaaatgtcagttagttcctttctctatcccagagcgcactgtttcattaggaatttttcaataaaaataataatgtagaaggtgtgatttttacagttttcatgtcttgatatatagtgaaattgagcaatgtgagaataartgtgatctagaaaagaaaaatatctttcgatttgagaacagatggttaataataatcatgacagtgattcaaggttaatgacctacatgctaaacttgttttaatttttaaaagccattactaactgaaaactccctgctttagctgaaccaacacttaacaagtgttttttaaagatgtcttgataccttcagagaagttctcctgctgctagttttctctggagcaacagtgggaaaccccaggtggttactcctttgtgaatataagcatccacatgaaattggttgtttccgcatg

SEQ ID NO: 111634 - DNA, 601 bp, Human
aggtttgcacaaataaaatatctttcaggaaaagtgtaaaatatatttcattaatctgtgaaaatgcaactggaagttttgtggcttcctagtttgaactccgcccaagaaggcaaaacctttatagacccatagtttcccgtctaggtactgctctttcacacatctctaagtctgactagacacattgtaacataagctgtggtcacatgacaggtaggtgtctcagtaacaggcaacaccagtcatggaaaaacaaaactaagtgtccaaatgagtgcagaatcctgattgcagctcrcatttactcttaaacaagaggccctcttcttatattctcaggtaagtgactctgtaataagaggattgtgtagcatttacctaacagctttactttaggactgtatactgtccttagatatttttaaaactttttatatttcatttctaaataagaatattacaaaaaatttcctaacatttatataacataattctcaaagtagatagagccaaataactgacttctgctagttttttttccagatatttgtcttttatgtacatggccagaaaccacttagaacttgcataaaaacaa

SEQ ID NO: 111635 - DNA, 601 bp, Human
aaagagcacaaatagacaatctgagcttacacctctaggaactggaaaaacaagacaaagcaaacccaaacccagcagaagaaaagaaataacaaagatcagaatagaaataaataaaattgagtcttagtgtggtggctcacacctgtaatcgcagcactttgggaggccaaggcaggcggatcaccataagtcaggagtttgagacctgcctggccaacatggtgaaaccccgtctctactaaaaatacaaaaattagccaggtgtggtggcaggcacctgtagtcccagctactcggkcagctgaggcaagagaatcacttgaacctggaaggcagatgttgcagtgagccaagatcatactgttgcattccagcctgggtaacaagagtgagactccatctcaaaaaataaaaataaaaataaataaataaataaataaaattgaaacacaaaatacaatacaaaagataaatgaaacaaaaacctgcttctttgaaaagataaacaaaatcaatagaccattggcaagattaaccaagaaaacaagaaaaaagatctaaacaagctcaattagaaatgaaatgggagatactacaa

SEQ ID NO: 111636 - DNA, 601 bp, Human
tgtgtgtgtatgtttggtttttactggattcctgaggaaggccttccactgaacttcattcatgtgctttgctacctgttagaaaatgtaacctaatgtaaatgtaaacctctggtgcctctagttttactgacttatgttatataaatcttggttcctggttctttctgttgccctgttatgagatgtatcactctaagccaagcccaaacactaagataacaagtgctaaagatgacgaatattctgaagagttttcaggacacacagaattgtttgtggccagcacctcagtaccaayaacagatatttcatgttatatagtggggtcattaaggacttatttgagggaataatcaagaaaaacttcctagtcttgctagagatctagatatccaaatataagaagcacaaagaacacctgggaaattcaatgcaaaaagattaccacctgggcacacagccatcaggttgtctaaagtcaagatgaaggaaagaatcttaagagctgtgaggcaaaagcatcaggtatcctataaaagaaaacatagcagattaatagcagatttctcagcataaaccctgctagccagaagagatt

SEQ ID NO: 111637 - DNA, 601 bp, Human
agtggagcctggtgcatagaattatctccttgccatctgtgtcccacaacacatatataaccccctgcatggcatatgaggcctttcctgagaggggtgcttttaagccaacattccagagacctagttcccctgccccaggtgcctcagtttttacacctaggatgctattttgaatcttctcctcaatgacaagtatctgtactcacttagtttgggtccatgccacattcctgaggcaactgaaacccacctactccttgatggccttccaggatgcttgtctgtactatagtggacmtcccttcctgcctcacggatgtccgtgtgtgtgtgtgtatgtttggtttttactggattcctgaggaaggccttccactgaacttcattcatgtgctttgctacctgttagaaaatgtaacctaatgtaaatgtaaacctctggtgcctctagttttactgacttatgttatataaatcttggttcctggttctttctgttgccctgttatgagatgtatcactctaagccaagcccaaacactaagataacaagtgctaaagatgacgaatattctgaagagttttcaggacacacaga

SEQ ID NO: 111638 - DNA, 601 bp, Human
ctacaattaaatgcaattcccatcaaaataccaccatcattcttcacagaactagaaaaaacaatcctaaaattcatatggaaccaaaaaagagcccacatagccaaagcaagattaagcaaaaagaaaaatctggaggcatcacattacctgctttcaaactatactataaggccatagtcaccaaaacagcatggcactggtataaaaataggcacacagaccaataaaacagaatagagaacctagaaataaacccaaatgctaacagccaagtgatctttgacaaagcaaataaaaccataaagtggggaaaggacatttgatgtattgtatgggttacataagatcgattaagtggagatggaaattttacaactttttgttgtatattgtaaactatttttaaatattagtggcaaaaagactaatatggataaatattcccaacaatttgatatttgatgtcccaaactattgtgagattggttataataaaaaatagcaaactaccctgctgatttcccatgaagcttaaccctctctcacatttcagaaccagcctgacttaagcctctacatacttaaacagcttcaaatg

SEQ ID NO: 111639 - DNA, 601 bp, Human
atagtctctggccaatgaaagctgttcagttaatgtgtggtgattcaatacatgcactcctaattctcatttatgaacattttgttaaatcgtggcctataggaaataggcatgtaaaatgcacctgtaagttttatagcacctagtacagagtgacagctcaaaactatttgcagaatgaaagaaaaaaggaagttgactctccaaaacaatacacatggccaaagcctggaaaaaagtaatagtgtcccagtgtaacttctaggaggtgtgaggaagaaagaaaaacaaaattggcacsttttcccaggctttagactgagagatattaacttggagaggggaaagcatagtctaaagagaaacagggctaaggaaggtatcactttcttttactatctctcagacagattgcaatgcaatctcaaggcagcactacactggacaaggtactaggactctgaccattcttgtttttattcttttttttttttttgagacagagtctcactatgtcacccaggctggagcacagtggcactatcttggctcactgcaacctctgcctcccgggttcaagtgattctcctgcctcagcctc

SEQ ID NO: 111640 - DNA, 601 bp, Human
atcataagtagcttcatgctttagttcacattgacgatattcttatatctacatcattaataatcaaaatagtctttctgtctttagttttgctgtctctaagtcagaactcaatactgttgctctaaaatacaaatgttaagatgattcttcaggagcttctcatcacctgtactataatgctactagcatgagagcacccacctagccttcttatctcaagtcctgccctgccactctgtacatatatcccctctttaattcacccttagacagagacagagagggccacgcatcttgycttttcctgaattaatatgtggtttttgccccatgctttagcacatgtgaatccatttgtccagcatgcctttgctcacctgtgtacaagaagagctacataacagatcaaaaggaacatcaaaggcgctggttcttagagtctcatgtccattcctccaattctcgccacttctggatgcactgtttcttatgagcttccttaaatatgctgtgcctttttgctttctgcgtatgggcatctccagtgccaaagtaagaggagatttctgcagaatttcaggaagttaatatcctagtg

SEQ ID NO: 111641 - DNA, 601 bp, Human
attatattaactctaataatcactatgccactttctgttgtaattctttaggcacttcttctttgtatgtttttaattagcatgtagttatatagttatatatttacgtttagatatacctccaagtagccaatattctacatgaagtgataaaggatttatttatccctgaaattatgaaaagtctgccttgttttttctttcttgcattgtgctacagtacacacatacacggacacacgaatgcacacacatgcacactgggttctgctaattatcatttccttagttccatatcatyccccaacccctaagccacctgtgtccataccagtcttcccactgcctaccagccccatgtcagatgacctccatcagtagtatctccatttatggtgtctcgcctttctgacacatagtaacaagtgaggtgttaagactaacaagagaaagaaggcattattcttatctggctagaaagaaaacaatcagcaacttgtcttttatttaagggaagaaggcttcactctactatattttcaagatattccaaaactgcaacagaccctttcaattattttactttcatctattaccaaaa

SEQ ID NO: 111642 - DNA, 601 bp, Human
tctcctgcttcagtttcttgagtagctgggattaccagcgcccatcaccacacccagctaatttctgtatttttagtagagatgggtttcaccatgttggctaggcttgtctctatcccctgtcctcaagtgatccctgcaacttgacctccaaaagtgctgggattataggcatgagccaccatgcctggccttatttatattatattaactctaataatcactatgccactttctgttgtaattctttaggcacttcttctttgtatgtttttaattagcatgtagttatatagttatrtatttacgtttagatatacctccaagtagccaatattctacatgaagtgataaaggatttatttatccctgaaattatgaaaagtctgccttgttttttctttcttgcattgtgctacagtacacacatacacggacacacgaatgcacacacatgcacactgggttctgctaattatcatttccttagttccatatcatcccccaacccctaagccacctgtgtccataccagtcttcccactgcctaccagccccatgtcagatgacctccatcagtagtatctccatttatggtgtc

SEQ ID NO: 111643 - DNA, 601 bp, Human
tttttaattttttgagaccgggtctttctctgtcacccagtctggagtgcagtgcgcgatcttggctcactgcagccccagcttccgggttcaagcaattctcctgcttcagtttcttgagtagctgggattaccagcgcccatcaccacacccagctaatttctgtatttttagtagagatgggtttcaccatgttggctaggcttgtctctatcccctgtcctcaagtgatccctgcaacttgacctccaaaagtgctgggattataggcatgagccaccatgcctggccttatttatrttatattaactctaataatcactatgccactttctgttgtaattctttaggcacttcttctttgtatgtttttaattagcatgtagttatatagttatatatttacgtttagatatacctccaagtagccaatattctacatgaagtgataaaggatttatttatccctgaaattatgaaaagtctgccttgttttttctttcttgcattgtgctacagtacacacatacacggacacacgaatgcacacacatgcacactgggttctgctaattatcatttccttagttccatatcatc

SEQ ID NO: 111644 - DNA, 601 bp, Human
cttaactcctggtctttctcacaatcacagaaaacagtcccttatcacacaaataaaaaagtcatctcaccattcctctgtaccttttatcttaacagacttgtgttttgaaatattatttatactattttttaattttttgagaccgggtctttctctgtcacccagtctggagtgcagtgcgcgatcttggctcactgcagccccagcttccgggttcaagcaattctcctgcttcagtttcttgagtagctgggattaccagcgcccatcaccacacccagctaatttctgtattttyagtagagatgggtttcaccatgttggctaggcttgtctctatcccctgtcctcaagtgatccctgcaacttgacctccaaaagtgctgggattataggcatgagccaccatgcctggccttatttatattatattaactctaataatcactatgccactttctgttgtaattctttaggcacttcttctttgtatgtttttaattagcatgtagttatatagttatatatttacgtttagatatacctccaagtagccaatattctacatgaagtgataaaggatttatttatccctgaa

SEQ ID NO: 111645 - DNA, 601 bp, Human
gttatatacaaatactaagccattttataacaggggcttaggcatctgcagattttagtacccaagggaggtcctgaaaccaatcccctatggctactgaaggacaactgtgtatcattcttaacagaaaaaaacaaaatctgttttgtaaataaaattttttcattattatttccatttcactctggaatttagttagaaattaagattaacaaaatattaattgactactaaaatgtaccagcactagcagcacataccaaaaactaatacaaatattccaataatattaaataatgaytgcatttgtatttcatctgagagtggtttatggttcttccccataagtggctgatttattgatggccactttttcttaactcctggtctttctcacaatcacagaaaacagtcccttatcacacaaataaaaaagtcatctcaccattcctctgtaccttttatcttaacagacttgtgttttgaaatattatttatactattttttaattttttgagaccgggtctttctctgtcacccagtctggagtgcagtgcgcgatcttggctcactgcagccccagcttccgggttcaagcaa

SEQ ID NO: 111646 - DNA, 601 bp, Human
tcctgtcatttgtgaatagaactctgtagtcagaaccagagcatttctggcatttggtctagaatcattctgaagggcaagcctggtgctgtgttgctaagcacaaacaatttggtatttggctccaaaaatatgctcgagattagttcttccctcagcaacaggcgctcagccaaataatttttaaccaactctcagagcccagtattgcttgagctactgagatcctatttcaagttattgctatcaagatatggaggagagtgaaatactgacacttgtgagatcccaagacttacaytaaatccatacaatttctgtcctgaattaaaaatttttttaaaaaagagatgaaaagtgtgacatttccaaaccacgtaattggtttctttcaccttaaactccaagttagagaagtattttgttgttgtttgttttgttttaaaactagacttggtggaatacagaacataaacattttaaacaaaatattaaacttctagaacagtggatcacttaaaatgaaaactttaagactttccttagactgagttttttattcttaaaaaaaattaaaaggaagttgaattttatttctaaa

SEQ ID NO: 111647 - DNA, 601 bp, Human
gtcaagtaaggttgtcctaagaagccatgttaccccttctgctggtgagcacagagcccaggtataaaatttttttttttttttttgagacagagtctcgctctgtcacccaggctggagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatggtctcgatctgacctcrtgatctgcccgcctcagcctcccaaagtgctgggattacaggtgtgagccaccacgcctggctgcagaatctttacctaggttactgttgtccatgtgggtaacaatcttgacatctgaagtgttcattgaataaaaatttgtattgaatattcttctaacaaaatctgaaaaaagtacagagctatttttgaaatggatgagaatgtatggtaatttagctagttcattgtatgtgtcctgttttcagttatcattgctactgaattatttatctttaggtgtataaattatagtcaag

SEQ ID NO: 111648 - DNA, 601 bp, Human
agtaaatggtcaagtaaggttgtcctaagaagccatgttaccccttctgctggtgagcacagagcccaggtataaaatttttttttttttttttgagacagagtctcgctctgtcacccaggctggagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatggtctcgatctgacctcgtgatctgcccgcctcagcctcccaaagtgctgggattacaggtgtgagccaccacgcctggctgcagaatctttacctaggttactgttgtccatgtgggtaacaatcttgacatctgaagtgttcattgaataaaaatttgtattgaatattcttctaacaaaatctgaaaaaagtacagagctatttttgaaatggatgagaatgtatggtaatttagctagttcattgtatgtgtcctgttttcagttatcattgctactgaattatttatctttaggtgtataaatta

SEQ ID NO: 111649 - DNA, 601 bp, Human
tgtcaaagaagtaaatggtcaagtaaggttgtcctaagaagccatgttaccccttctgctggtgagcacagagcccaggtataaaatttttttttttttttttgagacagagtctcgctctgtcacccaggctggagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatrgtctcgatctgacctcgtgatctgcccgcctcagcctcccaaagtgctgggattacaggtgtgagccaccacgcctggctgcagaatctttacctaggttactgttgtccatgtgggtaacaatcttgacatctgaagtgttcattgaataaaaatttgtattgaatattcttctaacaaaatctgaaaaaagtacagagctatttttgaaatggatgagaatgtatggtaatttagctagttcattgtatgtgtcctgttttcagttatcattgctactgaattatttatctttaggtg

SEQ ID NO: 111650 - DNA, 601 bp, Human
tcttgaagatattgatggtgttaatcacttgaatgcagtgacattaataatttcttagataaaaagtatactgtttccaatcataaattccctgcctcccagactctctgtgagcctcatgtgcataagtggagggaaggacctgctgatctaagaatacccctagtgtcaaagaagtaaatggtcaagtaaggttgtcctaagaagccatgttaccccttctgctggtgagcacagagcccaggtataaaatttttttttttttttttgagacagagtctcgctctgtcacccaggctgsagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatggtctcgatctgacctcgtgatctgcccgcctcagcctcccaaagtgctgggattacaggtgtgagccaccacgcctggctgcagaatctttacctaggttactgttgtccatgtgggtaacaatcttgacatct

SEQ ID NO: 111651 - DNA, 601 bp, Human
tcgattcaagaacatatcagaatagtaattatgttgtatttgattcagtggctgagattgaagggcaactaaccaacagaggagaagatattattgattgttctaaagatttatcctccaaagctttcctttaccctatcttgttacatcttttttaaacaatgctaattgtgtcccttgtacatattcttattcaactcctcagcaaacatcttctatgtgaccaacattctgagaggtgctggagatgcagggaagagtaagatgctatgcttgacctgcagtatcttgaagctagttrgggcagcaaaccattaagacattcagcagcatagctgttgtctgcagaaacagatggggatccaagggttggaaataatacagaggagagatggattcatttgaagagttctcttgttgcatgcttaatataattaaagtgcctagccactagtagatgacagttttctaattttacacatcatgtaatccccttagtcttgaagatattgatggtgttaatcacttgaatgcagtgacattaataatttcttagataaaaagtatactgtttccaatcataaattccctgcctcccaga

SEQ ID NO: 111652 - DNA, 601 bp, Human
caaatttatctatcatgcaggcatgacactaggttttcacttgcactggaagtcaactgctggaaaattagtctgtagaaaaccgtaggccacagagttcctgaatgtgttagtaagaggcttagattttattttggatgggctgggaaataattgaagggttgtaacagggaatgtgcagaattgcattgtggagagatctaattggagattgggggaaagatgagcaggccctaaactgtgataatgttggcaagcttgaagggagggacagaatcagaaaatatttgtaagtgacatytctaggcccctgtgatttactggctggaggatgagcaggtgagaggtgtttgttttgaaaaaagtgattttgaagagaggtcagaaaaagattttcatttttttacttcatgtgttcatgagttggggagtcagggtacagaaggaaagacacatgaagccagggactgacacagagaccagacacacagtgggtgcttcatggatagctgttgaatgatttgtgaaaatcagatagcagtggtgagggtttttatgcaagtgaaatacaaatgaacttctcaaggtgccatatctgagt

SEQ ID NO: 111653 - DNA, 601 bp, Human
tctttccaggtcattctcaaacctccatatcaaagctatagatcaataactatcagaacaagttaaacattaagataaagttaatcatcttttctttataataataaccaccactgaattgcaattgttatgaggtattatgctaaacactttatcaaatcttatgaaataggggtaatttttattctcatctcacatgagaacttgaggcacataaaaattaaggcattttgccccaggtctcatggctggcaagtggtctgtctgacagtagagagccagcttcaagcactgtactatwgggccactgtgtcatgactataaacctttcatggcatggtctatacatttgggctcttcagcttcaaatttatctatcatgcaggcatgacactaggttttcacttgcactggaagtcaactgctggaaaattagtctgtagaaaaccgtaggccacagagttcctgaatgtgttagtaagaggcttagattttattttggatgggctgggaaataattgaagggttgtaacagggaatgtgcagaattgcattgtggagagatctaattggagattgggggaaagatgagcaggcccta

SEQ ID NO: 111654 - DNA, 601 bp, Human
ttttgcagtcatcttttattcttgtatcactatcttcaatcattgtggccaattctttccaggtcattctcaaacctccatatcaaagctatagatcaataactatcagaacaagttaaacattaagataaagttaatcatcttttctttataataataaccaccactgaattgcaattgttatgaggtattatgctaaacactttatcaaatcttatgaaataggggtaatttttattctcatctcacatgagaacttgaggcacataaaaattaaggcattttgccccaggtctcatgrctggcaagtggtctgtctgacagtagagagccagcttcaagcactgtactatagggccactgtgtcatgactataaacctttcatggcatggtctatacatttgggctcttcagcttcaaatttatctatcatgcaggcatgacactaggttttcacttgcactggaagtcaactgctggaaaattagtctgtagaaaaccgtaggccacagagttcctgaatgtgttagtaagaggcttagattttattttggatgggctgggaaataattgaagggttgtaacagggaatgtgcagaa

SEQ ID NO: 111655 - DNA, 601 bp, Human
attacttgaaatgcaatgctacccacggctgcctgtcattttgggagtttcttatagattctttttagggataagaattatgttaaaaccagatgctagaattgctttaatttttattccccagtttctcatttccattttgacaaagaggcccaaaacatgaatagccttttgatctgtttttttctcccatatcagttcccatgagaccagtgacttcattctttctgttattgcaggtttacattttgcagtcatcttttattcttgtatcactatcttcaatcattgtggccaattytttccaggtcattctcaaacctccatatcaaagctatagatcaataactatcagaacaagttaaacattaagataaagttaatcatcttttctttataataataaccaccactgaattgcaattgttatgaggtattatgctaaacactttatcaaatcttatgaaataggggtaatttttattctcatctcacatgagaacttgaggcacataaaaattaaggcattttgccccaggtctcatggctggcaagtggtctgtctgacagtagagagccagcttcaagcactgtactatag

SEQ ID NO: 111656 - DNA, 601 bp, Human
tgtagtagttaaaggcttgattggacattgctaaattgggtactagatctctaaagagatggaatttaccccctagtaggctttatcctttttcacttgtctcagatttggaactcatttcttttaggttgaaaattttatgttcatgttggaaacttaaattttaacaattaaaagattacttgaaatgcaatgctacccacggctgcctgtcattttgggagtttcttatagattctttttagggataagaattatgttaaaaccagatgctagaattgctttaatttttattccccartttctcatttccattttgacaaagaggcccaaaacatgaatagccttttgatctgtttttttctcccatatcagttcccatgagaccagtgacttcattctttctgttattgcaggtttacattttgcagtcatcttttattcttgtatcactatcttcaatcattgtggccaattctttccaggtcattctcaaacctccatatcaaagctatagatcaataactatcagaacaagttaaacattaagataaagttaatcatcttttctttataataataaccaccactgaattgcaat

SEQ ID NO: 111657 - DNA, 601 bp, Human
aatctgagtctttctttcaccttatgagctgtttaggaagaagatgtatatgtgtgtaacagggagcaagaggagattaacttgtaagccattatctgatgcaaaggcagacatttactaagtcatctgtgaagagatggttcgataatagctaagcattcatataaatcttcagggactcgaattctctcaagtgtgacagaatactcctctcaactgccagcgctcctgttgtaaaaaatcacatttggcaaagggctctggtgttttgagttctgctcagtgacaggtttgttttaartaagattaatactgaggacaataaaatgaccttcaattaagactccttttaaattttgtctacctgatttccactatggttcgtgtctagctgtactctatctaagaatgatctttaaaacattcaggattatgagagagatatctaggaagtcataggaaataaccactattcaatgctgttctgtacaccattagtaaaccataagagaggacaaacatttatccaagaaagagactattacatagccaccaggacccaatatggattcagcacaattgagcaatacatgtaacagat

SEQ ID NO: 111658 - DNA, 601 bp, Human
gggttgctatgatagttattatacacaattgagtttaaaatgaatatatgtgtcagttctattattaaatgttataaaatatgagggaataataaatgctatgtaatttataaactacaagaaaatttatatcaggaaactgcttatttcctaatatatgcactgtcttcagtgtctccaaaactgtcaactctgccaatgtgactagcagatgatgagcaggcagtccgtgtgatattatcaattacatagtcagaaatctgagtctttctttcaccttatgagctgtttaggaagaagrtgtatatgtgtgtaacagggagcaagaggagattaacttgtaagccattatctgatgcaaaggcagacatttactaagtcatctgtgaagagatggttcgataatagctaagcattcatataaatcttcagggactcgaattctctcaagtgtgacagaatactcctctcaactgccagcgctcctgttgtaaaaaatcacatttggcaaagggctctggtgttttgagttctgctcagtgacaggtttgttttaaataagattaatactgaggacaataaaatgaccttcaattaagac

SEQ ID NO: 111659 - DNA, 601 bp, Human
agaagaatgcatttagaagccctagataacatacaatataaaaataatatttgcaaattatgcatttgttttcttttctttctttttttttttttttttgagatggagtttcgctcatgttgcctaggctagaatacagtggcacaatctcggctcactgcaaccaccgcctcctgggttcaaacgattcttctgcctcagcctccccagtagttgggattacaggtatgtgccaccatgcccggctaattttgtatttttagtagagatggagtttctccatgttggtcaagctggtctygaactcccgacctcaggtgatccacccgccttggcctcccaaagtgctgggattacaggcctgagccaccgcgcctggcctgttttcattttaagtgtagttgtctagcattttcaatacattcccccccgtttgacaaattttatcttgccatttagctaatgggcaagcaaaaaattaagtggaataattggacagaacaattatctggtaacctaaacaatggtaacatgagataggtattttatgcattgtttggacttataaactatctagtgttctaataatagacataatggt

SEQ ID NO: 111660 - DNA, 601 bp, Human
aaatgtgaccttcctgtataaactttccatgagctggcttgtctgactgaacccaaatggctaatggattttctttcccgttacatgctctctaatttatgatgctttgcttggggggaaaatgagaggtgggagtctgtttacggaacatggaagtccttttgcagaggtacaagagtggaaatggctgttccccagcctggctctctgagtcagacctgacatccacagagagagcactgcagtaactgcaaacgcttctgttttgattgtggtaattagaacaatcagggcacaaacygcaaggtcactggcaagggtagcagcaggcatgattcctcccttagtaattttaaagcagcagatttcaaaagggaaaaccaagcagatgaaagtgagcagatttgttcttcagcacatgtgagatacccttggagatgccaataaatcactggagagactgtgaaggaggcttaggccctgcagatgaagttagtgatggagggaaatcgtgtttatcctcgggctgtcaggtctgaaatacctgggttaagtaaatggcctctgggatggtcacagtcggcaattattagcagttaca

SEQ ID NO: 111661 - DNA, 601 bp, Human
caccctcctgatctcaattgaaatgtgaccttcctgtataaactttccatgagctggcttgtctgactgaacccaaatggctaatggattttctttcccgttacatgctctctaatttatgatgctttgcttggggggaaaatgagaggtgggagtctgtttacggaacatggaagtccttttgcagaggtacaagagtggaaatggctgttccccagcctggctctctgagtcagacctgacatccacagagagagcactgcagtaactgcaaacgcttctgttttgattgtggtaattrgaacaatcagggcacaaactgcaaggtcactggcaagggtagcagcaggcatgattcctcccttagtaattttaaagcagcagatttcaaaagggaaaaccaagcagatgaaagtgagcagatttgttcttcagcacatgtgagatacccttggagatgccaataaatcactggagagactgtgaaggaggcttaggccctgcagatgaagttagtgatggagggaaatcgtgtttatcctcgggctgtcaggtctgaaatacctgggttaagtaaatggcctctgggatggtcacagtc

SEQ ID NO: 111662 - DNA, 601 bp, Human
actcaataggtattcagatgtttcccattagtaagttgtgaccatgcaataaaaaccatgctcaccaatattccccaataaacttcaagatttgtaagctcatgcatacccacatttatgttaaaatttgaaataatgaaatatttttgcattgtgaaaaatagatatatatgcattttgtgaccaaaaccatcaccacagttccattgctgttgttgttcttcttcttgttattattattattatttttggtttgtttgtatctggcacatttggggttataaatcacaaataacataartaagataatgttaatctccttcttacaaaatccaatggcttcccacaagtctatatataatatgcaaatttcttactatagcttataagatctggaataatttttcctatctccagccttcacctcttctcacattcatcatattctagctaatcaggactcttttatgtcataaaatatgctagatttgcacacccttaaagccttcatatacgagtttgttctgccttggatacctctgttccacattcccgaacattctctctctcatcacacagctggaccctttcaccctcctga

SEQ ID NO: 111663 - DNA, 601 bp, Human
agaagctatcaagacattatgtagcaacctttttctcagtattccaggaaaataaaaatgtgcatgcattaactcaataggtattcagatgtttcccattagtaagttgtgaccatgcaataaaaaccatgctcaccaatattccccaataaacttcaagatttgtaagctcatgcatacccacatttatgttaaaatttgaaataatgaaatatttttgcattgtgaaaaatagatatatatgcattttgtgaccaaaaccatcaccacagttccattgctgttgttgttcttcttcttrttattattattattatttttggtttgtttgtatctggcacatttggggttataaatcacaaataacataaataagataatgttaatctccttcttacaaaatccaatggcttcccacaagtctatatataatatgcaaatttcttactatagcttataagatctggaataatttttcctatctccagccttcacctcttctcacattcatcatattctagctaatcaggactcttttatgtcataaaatatgctagatttgcacacccttaaagccttcatatacgagtttgttctgcct

SEQ ID NO: 111664 - DNA, 601 bp, Human
acagcatctatccactctcctatagagatgaagttaactcccttgacaactatcacttgtccccaatccccacccttccacttgacatacaaacccaaagagattcatgctcatttatgctcagtagaaaacataattccataggttactgctattattaatcaaatatttactagatttatatctattagtcaattctctttagaatttctttgactgtttctataaatctttattcctcagatattcctttaaaccagtcttaccagcttattggctccactactaattaattagttgrataaaatctttgaaatgtgtttatgtttgtataaaaaccatcttctttacttttcaaaaactatacttgagcacactgtgaaaagataaattgctaggttcaactgaggaactgaataattttttcctcttttagttttaacattctacacaatctaaattattttaaaactcagaaaatgctttaagctcatatttatagacttcccaagtagtacaatctgttaactgaggtaggtaagtaaacgtccttgaaaacttccataaatgatggtgaataaattaaaaaggtggaaacaat

SEQ ID NO: 111665 - DNA, 601 bp, Human
cgcatgccaccacatcccacttttttttttttttgtatttttagtagagacaaggtttcaccatgttggccagggtggtctcaaactactgatctcaagtaattggccagccttggcgtcccaaagtgcaagactgcaggcttgagccaccacgctccaccaaaagtttcttagcactcattctcatgagaaaaattgctgaaaacttggcaataaagaaacagaatgactacatgtcctttaaatgttatttttaaggggctcaatcaatgactatgaagttatctaagataaaacaccwgattttgacattgccattaacttttttattagagcccccagatctacaggttatatgtgcagatgtgcagtggctgctttatttcccttttcaagagcttttcttatacagcatctatccactctcctatagagatgaagttaactcccttgacaactatcacttgtccccaatccccacccttccacttgacatacaaacccaaagagattcatgctcatttatgctcagtagaaaacataattccataggttactgctattattaatcaaatatttactagatttatatctattagtc

SEQ ID NO: 111666 - DNA, 601 bp, Human
taagaagaagattgcttctcagccaaattttctgatatacagatattctcaaaagacaagcacacacacacacgcacacacacacacacacacacacacacacaccccccaaggctctggaatgtgccttaacaatcttatttttgcacattttaaaaggaggtcattatgaaatttgcacatattttatgacctgtaatgtacttctctgatctgatttcacttgagctaataaaaaaatacaaatcaggtgcttgctgtgatcaagatgctaaagttatatttacactgcttcataaaygtaaggtgttaaagcttagtgagacaagaagtaaactgataattgattaaccagggtgctatacaaatctacctagagggtgccttcccaggttaatgcaattatgggagaaagatcctggctcctggctacagaaatgccaactaaagtgttatccaccccatccttcactttggaggatgcgttaagatgacactgtgctgtgtcaaaatgaaaatacaaacaaaagcaaataaaccgagtgataataaataaaccgagtgactcagtttccttatccattttccagttacctttttt

SEQ ID NO: 111667 - DNA, 601 bp, Human
ttgtgtcttgaaaatctttctgctgtaattacctaaagactgtggttagataattattgagggacttttgcaattgtcccttttctctatatagatcaccacattaattaaacgagagtctcactgggaacaggttgctgttctgcatctttaagtatttttagtactttattttcaaaagagaaaaagaaccactaagaagaagattgcttctcagccaaattttctgatatacagatattctcaaaagacaagcacacacacacacgcacacacacacacacacacacacacacacacmccccaaggctctggaatgtgccttaacaatcttatttttgcacattttaaaaggaggtcattatgaaatttgcacatattttatgacctgtaatgtacttctctgatctgatttcacttgagctaataaaaaaatacaaatcaggtgcttgctgtgatcaagatgctaaagttatatttacactgcttcataaatgtaaggtgttaaagcttagtgagacaagaagtaaactgataattgattaaccagggtgctatacaaatctacctagagggtgccttcccaggttaatgcaattat

SEQ ID NO: 111668 - DNA, 601 bp, Human
gcagcacaaaggtgcttttattagaacgtccactagatcagaatgaccagtgcacaaaatttattttcctagcagactcaccaaatttaacctggaagagaatgtctgactctgttgaattttcttaggcaaatacaatatttgaaagtcactgaatgtttcaaacaaaatataacaacattcagataacagaactgtgttattgttctcatgtgtttatgcccagaaaataagcagactggagcttctctaagattaaaagtcaaaacagtattacaattccagcccagatttgactatytaatcatttaaaccttagtatcatcatcatcaccaccgtcactgcatactcattaagttaaaaaaaattcctttaaaataaatggaaaagaaaatatctgtgtaaatagattaaagcgattcctgctcaccactccctttctccctggggcaggagacttgagcacatcaaaggaactcatagcgttcttggagtaagtgtgaaagccaccgtgatgaactaaatgaatgcttacatctaaagaaagatataaacatattacattaaaaggtggcatgacataatggtatatcactgatt

SEQ ID NO: 111669 - DNA, 601 bp, Human
agtttcacaatacagagcagagagggtgttggttgataaagaattgtctcaaatgagaggaaaagaatggagccaataacagagatgatgtttaatttgggaaaggtgggacatgttaacatgagtccagagaactaaaatgagcttatggcatgcagatgctgaagatgaagaaaggaaaggaaggaaaaggaggaatttatatttatttattgaataatcttgtaaaactgttaatcacccctttttactgacgataagacataaatgtcagaggtgttttgcctaaagtaaaaaattygatagtcaagctgggtttaaaaccatatcagtcttacgtcaaagcatgttttaattgctgttgtgtggttgtgattttaagggaagaagaagagttttataatgggttctctgaaaaataaaatatcaattagaaagaaacaaaacaactgctgagaagcagtgaatccaagcagaatctgagtatcatcactttttagttaaactaaccagtccaatatcctgatttttctttaacaggcaaagaatttttgagtctttcccatagactgagttcttgtgaactattttacagcaataa

SEQ ID NO: 111670 - DNA, 601 bp, Human
caatttttgataaaatctaaggaattttatttttaaaacattgaattaaagcaaactttggatactctgatttctcttgaggtcataaatcctctgcctttttaagagatctatgtggagaggaacaactctgggtcttaaacgaattattgaggtcttgttttggaaaggctagatattttgttaaaaaatataagatttcaaaaaacctaaaactttggacaatgttatttaatcatcaaaagcaaaacaatatgcatatttcagaaataacactatattttcagtcttactattatgyataagaaagaacaatataaaaataatgtaatgattacatttattgtttacatactctgaggagtatttaattgcatcctagtaagtatattctgtcacatgagaagccatagaaattggcatgttctgctgtatccaatgcccaaaggataataaagcatgataaaattacacttaacgaacccaacctccttttccaattatatatggttaagttaaaattcaaactttaatttttgggaaagtatagttatggcttagatctaaggtagaaataaaatgaccaaaggacttggtgcat

SEQ ID NO: 111671 - DNA, 601 bp, Human
aactaccaatataacaaatgttaaacacttttgaaaaaatcaattttttctcaaattttcattatgatattatattaacccagaatatgttagggcaataaaataaatgagaaaaacgtctggattttggtatatgcctgtatgcttaataagagaacctacagggtaggatatagagacatagtaagaaaataccttttattctctctctactaggccctatccctggaatagctgtagacttttttttttcaaatgggattgttttacgaacagtgaaatagactcagttcagtatctyatatctgcatttgacacacagaaagaaaaatggttatcaaaaaattacaatggaatgaccctcattgctaataaggaaagacttaaaagctatattaggaaacagaaatggctgagactgacctctttctccctaaaaagcttattcaagttctttttaaataaacctgtagggttgaatagctgatataactgattatcatttcgtactcgtcccagctgaagtgctctataaaacagatcatgagacgaagcttccttcactgctaatagcttattgggaagtacaattccagggaag

SEQ ID NO: 111672 - DNA, 601 bp, Human
tttacagatcaaataagatatctatctaggtttgggtgggggaaatgggtgggatatagaagaaacatgagtttaatatttcatcagttttaaaaagtatatacagtagtctccttttatccgtggttttgttttccatggtttcagttgcccaccaccaattgcaaccccaaaatactaagatatttagagacagagagagagggaaagagaaagcgagaccatacccacataacttttattacagtatattattataattgttctcttttgttattagttattgttgttaatctcttastgtgcctagtttataaattaaactttttcataggtacataagcattggaaaaaacagtatatgtagggtttgctactatccgcaatttcaggtgtcctagtgggggtttcagaatgtatccctgtagataaaggaagactgctgtatgctcatttcaatagttagttctctaactatgtttttctgaatatgtgatctaaatttgttgactctatcacattcgtagattttaagcatactaaaatatttggcagctattccaaggagaatataacaacaaacacttcatatgaccatcag

SEQ ID NO: 111673 - DNA, 601 bp, Human
aagaaaacaaaaaaagaaaagccctacgtgatccgaatttgaatttgattaacatttaactatcactgacaacttacagcaaatataaggtggtgaaaaacatgttcattgcttacaacagtggctacaatcagcaaattttgcactgtgagaaactacacaagacaaagaatacgtctaatttcaataagtaaattgcaactaaaaagaagttagtgggaacctgccgcttaaagtagaagtgagagagcattagccaattgcaacctaagaactttatttcattctcattgggaaccckacataagcaaatggaaaacacatatgaggtagttggggaaatttgaacactgacttgatatttaagaattattgtttatttctttaggtgtgatgatatattgcagttttacttcaaaaagttcttaacttttacaaattaattaaatgtttacagatcaaataagatatctatctaggtttgggtgggggaaatgggtgggatatagaagaaacatgagtttaatatttcatcagttttaaaaagtatatacagtagtctccttttatccgtggttttgttttccatggtttcagttgc

SEQ ID NO: 111674 - DNA, 601 bp, Human; identical to SEQ ID NO: 18716

SEQ ID NO: 111675 - DNA, 601 bp, Human; identical to SEQ ID NO: 18717

SEQ ID NO: 111676 - DNA, 601 bp, Human; identical to SEQ ID NO: 18718

SEQ ID NO: 111677 - DNA, 601 bp, Human; identical to SEQ ID NO: 18654

SEQ ID NO: 111678 - DNA, 601 bp, Human; identical to SEQ ID NO: 18655

SEQ ID NO: 111679 - DNA, 601 bp, Human; identical to SEQ ID NO: 18656

SEQ ID NO: 111680 - DNA, 601 bp, Human; identical to SEQ ID NO: 18657

SEQ ID NO: 111681 - DNA, 601 bp, Human; identical to SEQ ID NO: 18658

SEQ ID NO: 111682 - DNA, 601 bp, Human; identical to SEQ ID NO: 18659

SEQ ID NO: 111683 - DNA, 601 bp, Human; identical to SEQ ID NO: 18660

SEQ ID NO: 111684 - DNA, 601 bp, Human; identical to SEQ ID NO: 18661

SEQ ID NO: 111685 - DNA, 601 bp, Human; identical to SEQ ID NO: 18662

SEQ ID NO: 111686 - DNA, 601 bp, Human; identical to SEQ ID NO: 18663

SEQ ID NO: 111687 - DNA, 601 bp, Human; identical to SEQ ID NO: 18664

SEQ ID NO: 111688 - DNA, 601 bp, Human; identical to SEQ ID NO: 18665

SEQ ID NO: 111689 - DNA, 601 bp, Human; identical to SEQ ID NO: 18666

SEQ ID NO: 111690 - DNA, 601 bp, Human; identical to SEQ ID NO: 18667

SEQ ID NO: 111691 - DNA, 601 bp, Human; identical to SEQ ID NO: 18668

SEQ ID NO: 111692 - DNA, 601 bp, Human; identical to SEQ ID NO: 18669

SEQ ID NO: 111693 - DNA, 601 bp, Human; identical to SEQ ID NO: 18670

SEQ ID NO: 111694 - DNA, 601 bp, Human; identical to SEQ ID NO: 18671

SEQ ID NO: 111695 - DNA, 601 bp, Human; identical to SEQ ID NO: 18672

SEQ ID NO: 111696 - DNA, 601 bp, Human; identical to SEQ ID NO: 18673

SEQ ID NO: 111697 - DNA, 601 bp, Human; identical to SEQ ID NO: 18674

SEQ ID NO: 111698 - DNA, 601 bp, Human; identical to SEQ ID NO: 18675

SEQ ID NO: 111699 - DNA, 601 bp, Human; identical to SEQ ID NO: 18676

SEQ ID NO: 111700 - DNA, 601 bp, Human; identical to SEQ ID NO: 18677

SEQ ID NO: 111701 - DNA, 601 bp, Human; identical to SEQ ID NO: 18678

SEQ ID NO: 111702 - DNA, 601 bp, Human; identical to SEQ ID NO: 18679

SEQ ID NO: 111703 - DNA, 601 bp, Human; identical to SEQ ID NO: 18680

SEQ ID NO: 111704 - DNA, 601 bp, Human; identical to SEQ ID NO: 18681

SEQ ID NO: 111705 - DNA, 601 bp, Human; identical to SEQ ID NO: 18682

SEQ ID NO: 111706 - DNA, 601 bp, Human; identical to SEQ ID NO: 18683

SEQ ID NO: 111707 - DNA, 601 bp, Human; identical to SEQ ID NO: 18684

SEQ ID NO: 111708 - DNA, 601 bp, Human; identical to SEQ ID NO: 18685

SEQ ID NO: 111709 - DNA, 601 bp, Human; identical to SEQ ID NO: 18686

SEQ ID NO: 111710 - DNA, 601 bp, Human; identical to SEQ ID NO: 18687

SEQ ID NO: 111711 - DNA, 601 bp, Human; identical to SEQ ID NO: 18688

SEQ ID NO: 111712 - DNA, 601 bp, Human; identical to SEQ ID NO: 18689

SEQ ID NO: 111713 - DNA, 601 bp, Human; identical to SEQ ID NO: 18690

SEQ ID NO: 111714 - DNA, 601 bp, Human; identical to SEQ ID NO: 18691

SEQ ID NO: 111715 - DNA, 601 bp, Human; identical to SEQ ID NO: 18692

SEQ ID NO: 111716 - DNA, 601 bp, Human; identical to SEQ ID NO: 18693

SEQ ID NO: 111717 - DNA, 601 bp, Human; identical to SEQ ID NO: 18694

SEQ ID NO: 111718 - DNA, 601 bp, Human; identical to SEQ ID NO: 18695

SEQ ID NO: 111719 - DNA, 601 bp, Human; identical to SEQ ID NO: 18696

SEQ ID NO: 111720 - DNA, 601 bp, Human; identical to SEQ ID NO: 18697

SEQ ID NO: 111721 - DNA, 601 bp, Human; identical to SEQ ID NO: 18698

SEQ ID NO: 111722 - DNA, 601 bp, Human; identical to SEQ ID NO: 18699

SEQ ID NO: 111723 - DNA, 601 bp, Human; identical to SEQ ID NO: 18700

SEQ ID NO: 111724 - DNA, 601 bp, Human; identical to SEQ ID NO: 18701

SEQ ID NO: 111725 - DNA, 601 bp, Human; identical to SEQ ID NO: 18702

SEQ ID NO: 111726 - DNA, 601 bp, Human; identical to SEQ ID NO: 18703

SEQ ID NO: 111727 - DNA, 601 bp, Human; identical to SEQ ID NO: 18704

SEQ ID NO: 111728 - DNA, 601 bp, Human; identical to SEQ ID NO: 18705

SEQ ID NO: 111729 - DNA, 601 bp, Human; identical to SEQ ID NO: 18706

SEQ ID NO: 111730 - DNA, 601 bp, Human; identical to SEQ ID NO: 18707

SEQ ID NO: 111731 - DNA, 601 bp, Human; identical to SEQ ID NO: 18708

SEQ ID NO: 111732 - DNA, 601 bp, Human; identical to SEQ ID NO: 18709

SEQ ID NO: 111733 - DNA, 601 bp, Human; identical to SEQ ID NO: 18710

SEQ ID NO: 111734 - DNA, 601 bp, Human; identical to SEQ ID NO: 18711

SEQ ID NO: 111735 - DNA, 601 bp, Human; identical to SEQ ID NO: 18712

SEQ ID NO: 111736 - DNA, 601 bp, Human; identical to SEQ ID NO: 18713

SEQ ID NO: 111737 - DNA, 601 bp, Human; identical to SEQ ID NO: 18714

SEQ ID NO: 111738 - DNA, 601 bp, Human; identical to SEQ ID NO: 18715

SEQ ID NO: 111739 - DNA, 601 bp, Human; identical to SEQ ID NO: 111591

SEQ ID NO: 111740 - DNA, 601 bp, Human; identical to SEQ ID NO: 111592

SEQ ID NO: 111741 - DNA, 601 bp, Human; identical to SEQ ID NO: 111593

SEQ ID NO: 111742 - DNA, 601 bp, Human; identical to SEQ ID NO: 111594

SEQ ID NO: 111743 - DNA, 601 bp, Human; identical to SEQ ID NO: 111595

SEQ ID NO: 111744 - DNA, 601 bp, Human; identical to SEQ ID NO: 111596

SEQ ID NO: 111745 - DNA, 601 bp, Human; identical to SEQ ID NO: 111597

SEQ ID NO: 111746 - DNA, 601 bp, Human; identical to SEQ ID NO: 111598

SEQ ID NO: 111747 - DNA, 601 bp, Human; identical to SEQ ID NO: 111599

SEQ ID NO: 111748 - DNA, 601 bp, Human; identical to SEQ ID NO: 111600

SEQ ID NO: 111749 - DNA, 601 bp, Human; identical to SEQ ID NO: 111601

SEQ ID NO: 111750 - DNA, 601 bp, Human; identical to SEQ ID NO: 111602

SEQ ID NO: 111751 - DNA, 601 bp, Human; identical to SEQ ID NO: 111603

SEQ ID NO: 111752 - DNA, 601 bp, Human; identical to SEQ ID NO: 111604

SEQ ID NO: 111753 - DNA, 601 bp, Human; identical to SEQ ID NO: 111605

SEQ ID NO: 111754 - DNA, 601 bp, Human; identical to SEQ ID NO: 111606

SEQ ID NO: 111755 - DNA, 601 bp, Human; identical to SEQ ID NO: 111607

SEQ ID NO: 111756 - DNA, 601 bp, Human; identical to SEQ ID NO: 111608

SEQ ID NO: 111757 - DNA, 601 bp, Human; identical to SEQ ID NO: 111609

SEQ ID NO: 111758 - DNA, 601 bp, Human; identical to SEQ ID NO: 111610

SEQ ID NO: 111759 - DNA, 601 bp, Human; identical to SEQ ID NO: 111611

SEQ ID NO: 111760 - DNA, 601 bp, Human; identical to SEQ ID NO: 111612

SEQ ID NO: 111761 - DNA, 601 bp, Human; identical to SEQ ID NO: 111613

SEQ ID NO: 111762 - DNA, 601 bp, Human; identical to SEQ ID NO: 111614

SEQ ID NO: 111763 - DNA, 601 bp, Human; identical to SEQ ID NO: 111615

SEQ ID NO: 111764 - DNA, 601 bp, Human; identical to SEQ ID NO: 111616

SEQ ID NO: 111765 - DNA, 601 bp, Human; identical to SEQ ID NO: 111617

SEQ ID NO: 111766 - DNA, 601 bp, Human; identical to SEQ ID NO: 111618

SEQ ID NO: 111767 - DNA, 601 bp, Human; identical to SEQ ID NO: 111619

SEQ ID NO: 111768 - DNA, 601 bp, Human; identical to SEQ ID NO: 111620

SEQ ID NO: 111769 - DNA, 601 bp, Human; identical to SEQ ID NO: 111621

SEQ ID NO: 111770 - DNA, 601 bp, Human; identical to SEQ ID NO: 111622

SEQ ID NO: 111771 - DNA, 601 bp, Human; identical to SEQ ID NO: 111623

SEQ ID NO: 111772 - DNA, 601 bp, Human; identical to SEQ ID NO: 111624

SEQ ID NO: 111773 - DNA, 601 bp, Human; identical to SEQ ID NO: 111625

SEQ ID NO: 111774 - DNA, 601 bp, Human; identical to SEQ ID NO: 111626

SEQ ID NO: 111775 - DNA, 601 bp, Human; identical to SEQ ID NO: 111627

SEQ ID NO: 111776 - DNA, 601 bp, Human; identical to SEQ ID NO: 111628

SEQ ID NO: 111777 - DNA, 601 bp, Human; identical to SEQ ID NO: 111629

SEQ ID NO: 111778 - DNA, 601 bp, Human; identical to SEQ ID NO: 111630

SEQ ID NO: 111779 - DNA, 601 bp, Human; identical to SEQ ID NO: 111631

SEQ ID NO: 111780 - DNA, 601 bp, Human; identical to SEQ ID NO: 111632

SEQ ID NO: 111781 - DNA, 601 bp, Human; identical to SEQ ID NO: 111633

SEQ ID NO: 111782 - DNA, 601 bp, Human; identical to SEQ ID NO: 111634

SEQ ID NO: 111783 - DNA, 601 bp, Human; identical to SEQ ID NO: 111635

SEQ ID NO: 111784 - DNA, 601 bp, Human; identical to SEQ ID NO: 111636

SEQ ID NO: 111785 - DNA, 601 bp, Human; identical to SEQ ID NO: 111637

SEQ ID NO: 111786 - DNA, 601 bp, Human; identical to SEQ ID NO: 111638

SEQ ID NO: 111787 - DNA, 601 bp, Human; identical to SEQ ID NO: 111639

SEQ ID NO: 111788 - DNA, 601 bp, Human; identical to SEQ ID NO: 111640

SEQ ID NO: 111789 - DNA, 601 bp, Human; identical to SEQ ID NO: 111641

SEQ ID NO: 111790 - DNA, 601 bp, Human; identical to SEQ ID NO: 111642

SEQ ID NO: 111791 - DNA, 601 bp, Human; identical to SEQ ID NO: 111643

SEQ ID NO: 111792 - DNA, 601 bp, Human; identical to SEQ ID NO: 111644

SEQ ID NO: 111793 - DNA, 601 bp, Human; identical to SEQ ID NO: 111645

SEQ ID NO: 111794 - DNA, 601 bp, Human; identical to SEQ ID NO: 111646

SEQ ID NO: 111795 - DNA, 601 bp, Human; identical to SEQ ID NO: 111647

SEQ ID NO: 111796 - DNA, 601 bp, Human; identical to SEQ ID NO: 111648

SEQ ID NO: 111797 - DNA, 601 bp, Human; identical to SEQ ID NO: 111649

SEQ ID NO: 111798 - DNA, 601 bp, Human; identical to SEQ ID NO: 111650

SEQ ID NO: 111799 - DNA, 601 bp, Human; identical to SEQ ID NO: 111651

SEQ ID NO: 111800 - DNA, 601 bp, Human; identical to SEQ ID NO: 111652

SEQ ID NO: 111801 - DNA, 601 bp, Human; identical to SEQ ID NO: 111653

SEQ ID NO: 111802 - DNA, 601 bp, Human; identical to SEQ ID NO: 111654

SEQ ID NO: 111803 - DNA, 601 bp, Human; identical to SEQ ID NO: 111655

SEQ ID NO: 111804 - DNA, 601 bp, Human; identical to SEQ ID NO: 111656

SEQ ID NO: 111805 - DNA, 601 bp, Human; identical to SEQ ID NO: 111657

SEQ ID NO: 111806 - DNA, 601 bp, Human; identical to SEQ ID NO: 111658

SEQ ID NO: 111807 - DNA, 601 bp, Human; identical to SEQ ID NO: 111659

SEQ ID NO: 111808 - DNA, 601 bp, Human; identical to SEQ ID NO: 111660

SEQ ID NO: 111809 - DNA, 601 bp, Human; identical to SEQ ID NO: 111661

SEQ ID NO: 111810 - DNA, 601 bp, Human; identical to SEQ ID NO: 111662

SEQ ID NO: 111811 - DNA, 601 bp, Human; identical to SEQ ID NO: 111663

SEQ ID NO: 111812 - DNA, 601 bp, Human; identical to SEQ ID NO: 111664

SEQ ID NO: 111813 - DNA, 601 bp, Human; identical to SEQ ID NO: 111665

SEQ ID NO: 111814 - DNA, 601 bp, Human; identical to SEQ ID NO: 111666

SEQ ID NO: 111815 - DNA, 601 bp, Human; identical to SEQ ID NO: 111667

SEQ ID NO: 111816 - DNA, 601 bp, Human; identical to SEQ ID NO: 111668

SEQ ID NO: 111817 - DNA, 601 bp, Human; identical to SEQ ID NO: 111669

SEQ ID NO: 111818 - DNA, 601 bp, Human; identical to SEQ ID NO: 111670

SEQ ID NO: 111819 - DNA, 601 bp, Human; identical to SEQ ID NO: 111671

SEQ ID NO: 111820 - DNA, 601 bp, Human; identical to SEQ ID NO: 111672

SEQ ID NO: 111821 - DNA, 601 bp, Human; identical to SEQ ID NO: 111673

SEQ ID NO: 111822 - DNA, 601 bp, Human; identical to SEQ ID NO: 18716

SEQ ID NO: 111823 - DNA, 601 bp, Human; identical to SEQ ID NO: 18717

SEQ ID NO: 111824 - DNA, 601 bp, Human; identical to SEQ ID NO: 18718

SEQ ID NO: 111825 - DNA, 601 bp, Human; identical to SEQ ID NO: 18656

SEQ ID NO: 111826 - DNA, 601 bp, Human; identical to SEQ ID NO: 18657

SEQ ID NO: 111827 - DNA, 601 bp, Human; identical to SEQ ID NO: 18658

SEQ ID NO: 111828 - DNA, 601 bp, Human; identical to SEQ ID NO: 18659

SEQ ID NO: 111829 - DNA, 601 bp, Human; identical to SEQ ID NO: 18660

SEQ ID NO: 111830 - DNA, 601 bp, Human; identical to SEQ ID NO: 18661

SEQ ID NO: 111831 - DNA, 601 bp, Human; identical to SEQ ID NO: 18662

SEQ ID NO: 111832 - DNA, 601 bp, Human; identical to SEQ ID NO: 18663

SEQ ID NO: 111833 - DNA, 601 bp, Human; identical to SEQ ID NO: 18664

SEQ ID NO: 111834 - DNA, 601 bp, Human; identical to SEQ ID NO: 18665

SEQ ID NO: 111835 - DNA, 601 bp, Human; identical to SEQ ID NO: 18666

SEQ ID NO: 111836 - DNA, 601 bp, Human; identical to SEQ ID NO: 18667

SEQ ID NO: 111837 - DNA, 601 bp, Human; identical to SEQ ID NO: 18668

SEQ ID NO: 111838 - DNA, 601 bp, Human; identical to SEQ ID NO: 18669

SEQ ID NO: 111839 - DNA, 601 bp, Human; identical to SEQ ID NO: 18670

SEQ ID NO: 111840 - DNA, 601 bp, Human; identical to SEQ ID NO: 18671

SEQ ID NO: 111841 - DNA, 601 bp, Human; identical to SEQ ID NO: 18672

SEQ ID NO: 111842 - DNA, 601 bp, Human; identical to SEQ ID NO: 18673

SEQ ID NO: 111843 - DNA, 601 bp, Human; identical to SEQ ID NO: 18674

SEQ ID NO: 111844 - DNA, 601 bp, Human; identical to SEQ ID NO: 18675

SEQ ID NO: 111845 - DNA, 601 bp, Human; identical to SEQ ID NO: 18676

SEQ ID NO: 111846 - DNA, 601 bp, Human; identical to SEQ ID NO: 18677

SEQ ID NO: 111847 - DNA, 601 bp, Human; identical to SEQ ID NO: 18678

SEQ ID NO: 111848 - DNA, 601 bp, Human; identical to SEQ ID NO: 18679

SEQ ID NO: 111849 - DNA, 601 bp, Human; identical to SEQ ID NO: 18680

SEQ ID NO: 111850 - DNA, 601 bp, Human; identical to SEQ ID NO: 18681

SEQ ID NO: 111851 - DNA, 601 bp, Human; identical to SEQ ID NO: 18682

SEQ ID NO: 111852 - DNA, 601 bp, Human; identical to SEQ ID NO: 18683

SEQ ID NO: 111853 - DNA, 601 bp, Human; identical to SEQ ID NO: 18684

SEQ ID NO: 111854 - DNA, 601 bp, Human; identical to SEQ ID NO: 18685

SEQ ID NO: 111855 - DNA, 601 bp, Human; identical to SEQ ID NO: 18686

SEQ ID NO: 111856 - DNA, 601 bp, Human; identical to SEQ ID NO: 18687

SEQ ID NO: 111857 - DNA, 601 bp, Human; identical to SEQ ID NO: 18688

SEQ ID NO: 111858 - DNA, 601 bp, Human; identical to SEQ ID NO: 18689

SEQ ID NO: 111859 - DNA, 601 bp, Human; identical to SEQ ID NO: 18690

SEQ ID NO: 111860 - DNA, 601 bp, Human; identical to SEQ ID NO: 18691

SEQ ID NO: 111861 - DNA, 601 bp, Human; identical to SEQ ID NO: 18692

SEQ ID NO: 111862 - DNA, 601 bp, Human; identical to SEQ ID NO: 18693

SEQ ID NO: 111863 - DNA, 601 bp, Human; identical to SEQ ID NO: 18694

SEQ ID NO: 111864 - DNA, 601 bp, Human; identical to SEQ ID NO: 18695

SEQ ID NO: 111865 - DNA, 601 bp, Human; identical to SEQ ID NO: 18696

SEQ ID NO: 111866 - DNA, 601 bp, Human; identical to SEQ ID NO: 18697

SEQ ID NO: 111867 - DNA, 601 bp, Human; identical to SEQ ID NO: 18698

SEQ ID NO: 111868 - DNA, 601 bp, Human; identical to SEQ ID NO: 18699

SEQ ID NO: 111869 - DNA, 601 bp, Human; identical to SEQ ID NO: 18700

SEQ ID NO: 111870 - DNA, 601 bp, Human; identical to SEQ ID NO: 18701

SEQ ID NO: 111871 - DNA, 601 bp, Human; identical to SEQ ID NO: 18702

SEQ ID NO: 111872 - DNA, 601 bp, Human; identical to SEQ ID NO: 18703

SEQ ID NO: 111873 - DNA, 601 bp, Human; identical to SEQ ID NO: 18704

SEQ ID NO: 111874 - DNA, 601 bp, Human; identical to SEQ ID NO: 18705

SEQ ID NO: 111875 - DNA, 601 bp, Human; identical to SEQ ID NO: 18706

SEQ ID NO: 111876 - DNA, 601 bp, Human; identical to SEQ ID NO: 18707

SEQ ID NO: 111877 - DNA, 601 bp, Human; identical to SEQ ID NO: 18708

SEQ ID NO: 111878 - DNA, 601 bp, Human; identical to SEQ ID NO: 18709

SEQ ID NO: 111879 - DNA, 601 bp, Human; identical to SEQ ID NO: 18710

SEQ ID NO: 111880 - DNA, 601 bp, Human; identical to SEQ ID NO: 18711

SEQ ID NO: 111881 - DNA, 601 bp, Human; identical to SEQ ID NO: 18712

SEQ ID NO: 111882 - DNA, 601 bp, Human; identical to SEQ ID NO: 18713

SEQ ID NO: 111883 - DNA, 601 bp, Human; identical to SEQ ID NO: 18714

SEQ ID NO: 111884 - DNA, 601 bp, Human; identical to SEQ ID NO: 18715

SEQ ID NO: 111885 - DNA, 601 bp, Human; identical to SEQ ID NO: 111591

SEQ ID NO: 111886 - DNA, 601 bp, Human; identical to SEQ ID NO: 111592

SEQ ID NO: 111887 - DNA, 601 bp, Human; identical to SEQ ID NO: 111593

SEQ ID NO: 111888 - DNA, 601 bp, Human; identical to SEQ ID NO: 111594

SEQ ID NO: 111889 - DNA, 601 bp, Human; identical to SEQ ID NO: 111595

SEQ ID NO: 111890 - DNA, 601 bp, Human; identical to SEQ ID NO: 111596

SEQ ID NO: 111891 - DNA, 601 bp, Human; identical to SEQ ID NO: 111597

SEQ ID NO: 111892 - DNA, 601 bp, Human; identical to SEQ ID NO: 111598

SEQ ID NO: 111893 - DNA, 601 bp, Human; identical to SEQ ID NO: 111599

SEQ ID NO: 111894 - DNA, 601 bp, Human; identical to SEQ ID NO: 111600

SEQ ID NO: 111895 - DNA, 601 bp, Human; identical to SEQ ID NO: 111601

SEQ ID NO: 111896 - DNA, 601 bp, Human; identical to SEQ ID NO: 111602

SEQ ID NO: 111897 - DNA, 601 bp, Human; identical to SEQ ID NO: 111603

SEQ ID NO: 111898 - DNA, 601 bp, Human; identical to SEQ ID NO: 111604

SEQ ID NO: 111899 - DNA, 601 bp, Human; identical to SEQ ID NO: 111605

SEQ ID NO: 111900 - DNA, 601 bp, Human; identical to SEQ ID NO: 111606

SEQ ID NO: 111901 - DNA, 601 bp, Human; identical to SEQ ID NO: 111607

SEQ ID NO: 111902 - DNA, 601 bp, Human; identical to SEQ ID NO: 111608

SEQ ID NO: 111903 - DNA, 601 bp, Human; identical to SEQ ID NO: 111609

SEQ ID NO: 111904 - DNA, 601 bp, Human; identical to SEQ ID NO: 111610

SEQ ID NO: 111905 - DNA, 601 bp, Human; identical to SEQ ID NO: 111611

SEQ ID NO: 111906 - DNA, 601 bp, Human; identical to SEQ ID NO: 111612

SEQ ID NO: 111907 - DNA, 601 bp, Human; identical to SEQ ID NO: 111613

SEQ ID NO: 111908 - DNA, 601 bp, Human; identical to SEQ ID NO: 111614

SEQ ID NO: 111909 - DNA, 601 bp, Human; identical to SEQ ID NO: 111615

SEQ ID NO: 111910 - DNA, 601 bp, Human; identical to SEQ ID NO: 111616

SEQ ID NO: 111911 - DNA, 601 bp, Human; identical to SEQ ID NO: 111617

SEQ ID NO: 111912 - DNA, 601 bp, Human; identical to SEQ ID NO: 111618

SEQ ID NO: 111913 - DNA, 601 bp, Human; identical to SEQ ID NO: 111619

SEQ ID NO: 111914 - DNA, 601 bp, Human; identical to SEQ ID NO: 111620

SEQ ID NO: 111915 - DNA, 601 bp, Human; identical to SEQ ID NO: 111621

SEQ ID NO: 111916 - DNA, 601 bp, Human; identical to SEQ ID NO: 111622

SEQ ID NO: 111917 - DNA, 601 bp, Human; identical to SEQ ID NO: 111623

SEQ ID NO: 111918 - DNA, 601 bp, Human; identical to SEQ ID NO: 111624

SEQ ID NO: 111919 - DNA, 601 bp, Human; identical to SEQ ID NO: 111625

SEQ ID NO: 111920 - DNA, 601 bp, Human; identical to SEQ ID NO: 111626

SEQ ID NO: 111921 - DNA, 601 bp, Human; identical to SEQ ID NO: 111627

SEQ ID NO: 111922 - DNA, 601 bp, Human; identical to SEQ ID NO: 111628

SEQ ID NO: 111923 - DNA, 601 bp, Human; identical to SEQ ID NO: 111629

SEQ ID NO: 111924 - DNA, 601 bp, Human; identical to SEQ ID NO: 111630

SEQ ID NO: 111925 - DNA, 601 bp, Human; identical to SEQ ID NO: 111631

SEQ ID NO: 111926 - DNA, 601 bp, Human; identical to SEQ ID NO: 111632

SEQ ID NO: 111927 - DNA, 601 bp, Human; identical to SEQ ID NO: 111633

SEQ ID NO: 111928 - DNA, 601 bp, Human; identical to SEQ ID NO: 111634

SEQ ID NO: 111929 - DNA, 601 bp, Human; identical to SEQ ID NO: 111635

SEQ ID NO: 111930 - DNA, 601 bp, Human; identical to SEQ ID NO: 111636

SEQ ID NO: 111931 - DNA, 601 bp, Human; identical to SEQ ID NO: 111637

SEQ ID NO: 111932 - DNA, 601 bp, Human; identical to SEQ ID NO: 111638

SEQ ID NO: 111933 - DNA, 601 bp, Human; identical to SEQ ID NO: 111639

SEQ ID NO: 111934 - DNA, 601 bp, Human; identical to SEQ ID NO: 111640

SEQ ID NO: 111935 - DNA, 601 bp, Human; identical to SEQ ID NO: 111641

SEQ ID NO: 111936 - DNA, 601 bp, Human; identical to SEQ ID NO: 111642

SEQ ID NO: 111937 - DNA, 601 bp, Human; identical to SEQ ID NO: 111643

SEQ ID NO: 111938 - DNA, 601 bp, Human; identical to SEQ ID NO: 111644

SEQ ID NO: 111939 - DNA, 601 bp, Human; identical to SEQ ID NO: 111645

SEQ ID NO: 111940 - DNA, 601 bp, Human; identical to SEQ ID NO: 111646

SEQ ID NO: 111941 - DNA, 601 bp, Human; identical to SEQ ID NO: 111647

SEQ ID NO: 111942 - DNA, 601 bp, Human; identical to SEQ ID NO: 111648

SEQ ID NO: 111943 - DNA, 601 bp, Human; identical to SEQ ID NO: 111649

SEQ ID NO: 111944 - DNA, 601 bp, Human; identical to SEQ ID NO: 111650

SEQ ID NO: 111945 - DNA, 601 bp, Human; identical to SEQ ID NO: 111651

SEQ ID NO: 111946 - DNA, 601 bp, Human; identical to SEQ ID NO: 111652

SEQ ID NO: 111947 - DNA, 601 bp, Human; identical to SEQ ID NO: 111653

SEQ ID NO: 111948 - DNA, 601 bp, Human; identical to SEQ ID NO: 111654

SEQ ID NO: 111949 - DNA, 601 bp, Human; identical to SEQ ID NO: 111655

SEQ ID NO: 111950 - DNA, 601 bp, Human; identical to SEQ ID NO: 111656

SEQ ID NO: 111951 - DNA, 601 bp, Human; identical to SEQ ID NO: 111657

SEQ ID NO: 111952 - DNA, 601 bp, Human; identical to SEQ ID NO: 111658

SEQ ID NO: 111953 - DNA, 601 bp, Human; identical to SEQ ID NO: 111659

SEQ ID NO: 111954 - DNA, 601 bp, Human; identical to SEQ ID NO: 111660

SEQ ID NO: 111955 - DNA, 601 bp, Human; identical to SEQ ID NO: 111661

SEQ ID NO: 111956 - DNA, 601 bp, Human; identical to SEQ ID NO: 111662

SEQ ID NO: 111957 - DNA, 601 bp, Human; identical to SEQ ID NO: 111663

SEQ ID NO: 111958 - DNA, 601 bp, Human; identical to SEQ ID NO: 111664

SEQ ID NO: 111959 - DNA, 601 bp, Human; identical to SEQ ID NO: 111665

SEQ ID NO: 111960 - DNA, 601 bp, Human; identical to SEQ ID NO: 111666

SEQ ID NO: 111961 - DNA, 601 bp, Human; identical to SEQ ID NO: 111667

SEQ ID NO: 111962 - DNA, 601 bp, Human; identical to SEQ ID NO: 111668

SEQ ID NO: 111963 - DNA, 601 bp, Human; identical to SEQ ID NO: 111669

SEQ ID NO: 111964 - DNA, 601 bp, Human; identical to SEQ ID NO: 111670

SEQ ID NO: 111965 - DNA, 601 bp, Human; identical to SEQ ID NO: 111671

SEQ ID NO: 111966 - DNA, 601 bp, Human; identical to SEQ ID NO: 111672

SEQ ID NO: 111967 - DNA, 601 bp, Human; identical to SEQ ID NO: 111673

SEQ ID NO: 111968 - DNA, 601 bp, Human; identical to SEQ ID NO: 18716

SEQ ID NO: 111969 - DNA, 601 bp, Human; identical to SEQ ID NO: 18717

SEQ ID NO: 111970 - DNA, 601 bp, Human; identical to SEQ ID NO: 18656

SEQ ID NO: 111971 - DNA, 601 bp, Human; identical to SEQ ID NO: 18657

SEQ ID NO: 111972 - DNA, 601 bp, Human; identical to SEQ ID NO: 18658

SEQ ID NO: 111973 - DNA, 601 bp, Human; identical to SEQ ID NO: 18659

SEQ ID NO: 111974 - DNA, 601 bp, Human; identical to SEQ ID NO: 18660

SEQ ID NO: 111975 - DNA, 601 bp, Human; identical to SEQ ID NO: 18661

SEQ ID NO: 111976 - DNA, 601 bp, Human; identical to SEQ ID NO: 18662

SEQ ID NO: 111977 - DNA, 601 bp, Human; identical to SEQ ID NO: 18663

SEQ ID NO: 111978 - DNA, 601 bp, Human; identical to SEQ ID NO: 18664

SEQ ID NO: 111979 - DNA, 601 bp, Human; identical to SEQ ID NO: 18665

SEQ ID NO: 111980 - DNA, 601 bp, Human; identical to SEQ ID NO: 18666

SEQ ID NO: 111981 - DNA, 601 bp, Human; identical to SEQ ID NO: 18667

SEQ ID NO: 111982 - DNA, 601 bp, Human; identical to SEQ ID NO: 18668

SEQ ID NO: 111983 - DNA, 601 bp, Human; identical to SEQ ID NO: 18669

SEQ ID NO: 111984 - DNA, 601 bp, Human; identical to SEQ ID NO: 18670

SEQ ID NO: 111985 - DNA, 601 bp, Human; identical to SEQ ID NO: 18671

SEQ ID NO: 111986 - DNA, 601 bp, Human; identical to SEQ ID NO: 18672

SEQ ID NO: 111987 - DNA, 601 bp, Human; identical to SEQ ID NO: 18673

SEQ ID NO: 111988 - DNA, 601 bp, Human; identical to SEQ ID NO: 18674

SEQ ID NO: 111989 - DNA, 601 bp, Human; identical to SEQ ID NO: 18675

SEQ ID NO: 111990 - DNA, 601 bp, Human; identical to SEQ ID NO: 18676

SEQ ID NO: 111991 - DNA, 601 bp, Human; identical to SEQ ID NO: 18677

SEQ ID NO: 111992 - DNA, 601 bp, Human; identical to SEQ ID NO: 18678

SEQ ID NO: 111993 - DNA, 601 bp, Human; identical to SEQ ID NO: 18679

SEQ ID NO: 111994 - DNA, 601 bp, Human; identical to SEQ ID NO: 18680

SEQ ID NO: 111995 - DNA, 601 bp, Human; identical to SEQ ID NO: 18681

SEQ ID NO: 111996 - DNA, 601 bp, Human; identical to SEQ ID NO: 18682

SEQ ID NO: 111997 - DNA, 601 bp, Human; identical to SEQ ID NO: 18683

SEQ ID NO: 111998 - DNA, 601 bp, Human; identical to SEQ ID NO: 18684

SEQ ID NO: 111999 - DNA, 601 bp, Human; identical to SEQ ID NO: 18685

SEQ ID NO: 112000 - DNA, 601 bp, Human; identical to SEQ ID NO: 18686

SEQ ID NO: 112001 - DNA, 601 bp, Human; identical to SEQ ID NO: 18687

SEQ ID NO: 112002 - DNA, 601 bp, Human; identical to SEQ ID NO: 18688

SEQ ID NO: 112003 - DNA, 601 bp, Human; identical to SEQ ID NO: 18689

SEQ ID NO: 112004 - DNA, 601 bp, Human; identical to SEQ ID NO: 18690

SEQ ID NO: 112005 - DNA, 601 bp, Human; identical to SEQ ID NO: 18691

SEQ ID NO: 112006 - DNA, 601 bp, Human; identical to SEQ ID NO: 18692

SEQ ID NO: 112007 - DNA, 601 bp, Human; identical to SEQ ID NO: 18693

SEQ ID NO: 112008 - DNA, 601 bp, Human; identical to SEQ ID NO: 18694

SEQ ID NO: 112009 - DNA, 601 bp, Human; identical to SEQ ID NO: 18695

SEQ ID NO: 112010 - DNA, 601 bp, Human; identical to SEQ ID NO: 18696

SEQ ID NO: 112011 - DNA, 601 bp, Human; identical to SEQ ID NO: 18697

SEQ ID NO: 112012 - DNA, 601 bp, Human; identical to SEQ ID NO: 18698

SEQ ID NO: 112013 - DNA, 601 bp, Human; identical to SEQ ID NO: 18699

SEQ ID NO: 112014 - DNA, 601 bp, Human; identical to SEQ ID NO: 18700

SEQ ID NO: 112015 - DNA, 601 bp, Human; identical to SEQ ID NO: 18701

SEQ ID NO: 112016 - DNA, 601 bp, Human; identical to SEQ ID NO: 18702

SEQ ID NO: 112017 - DNA, 601 bp, Human; identical to SEQ ID NO: 18703

SEQ ID NO: 112018 - DNA, 601 bp, Human; identical to SEQ ID NO: 18704

SEQ ID NO: 112019 - DNA, 601 bp, Human; identical to SEQ ID NO: 18705

SEQ ID NO: 112020 - DNA, 601 bp, Human; identical to SEQ ID NO: 18706

SEQ ID NO: 112021 - DNA, 601 bp, Human; identical to SEQ ID NO: 18707

SEQ ID NO: 112022 - DNA, 601 bp, Human; identical to SEQ ID NO: 18708

SEQ ID NO: 112023 - DNA, 601 bp, Human; identical to SEQ ID NO: 18709

SEQ ID NO: 112024 - DNA, 601 bp, Human; identical to SEQ ID NO: 18710

SEQ ID NO: 112025 - DNA, 601 bp, Human; identical to SEQ ID NO: 18711

SEQ ID NO: 112026 - DNA, 601 bp, Human; identical to SEQ ID NO: 18712

SEQ ID NO: 112027 - DNA, 601 bp, Human; identical to SEQ ID NO: 18713

SEQ ID NO: 112028 - DNA, 601 bp, Human; identical to SEQ ID NO: 18714

SEQ ID NO: 112029 - DNA, 601 bp, Human; identical to SEQ ID NO: 18715

SEQ ID NO: 112030 - DNA, 601 bp, Human; identical to SEQ ID NO: 111591

SEQ ID NO: 112031 - DNA, 601 bp, Human; identical to SEQ ID NO: 111592

SEQ ID NO: 112032 - DNA, 601 bp, Human; identical to SEQ ID NO: 111593

SEQ ID NO: 112033 - DNA, 601 bp, Human; identical to SEQ ID NO: 111594

SEQ ID NO: 112034 - DNA, 601 bp, Human; identical to SEQ ID NO: 111595

SEQ ID NO: 112035 - DNA, 601 bp, Human; identical to SEQ ID NO: 111596

SEQ ID NO: 112036 - DNA, 601 bp, Human; identical to SEQ ID NO: 111597

SEQ ID NO: 112037 - DNA, 601 bp, Human; identical to SEQ ID NO: 111598

SEQ ID NO: 112038 - DNA, 601 bp, Human; identical to SEQ ID NO: 111599

SEQ ID NO: 112039 - DNA, 601 bp, Human; identical to SEQ ID NO: 111600

SEQ ID NO: 112040 - DNA, 601 bp, Human; identical to SEQ ID NO: 111601

SEQ ID NO: 112041 - DNA, 601 bp, Human; identical to SEQ ID NO: 111602

SEQ ID NO: 112042 - DNA, 601 bp, Human; identical to SEQ ID NO: 111603

SEQ ID NO: 112043 - DNA, 601 bp, Human; identical to SEQ ID NO: 111604

SEQ ID NO: 112044 - DNA, 601 bp, Human; identical to SEQ ID NO: 111605

SEQ ID NO: 112045 - DNA, 601 bp, Human; identical to SEQ ID NO: 111606

SEQ ID NO: 112046 - DNA, 601 bp, Human; identical to SEQ ID NO: 111607

SEQ ID NO: 112047 - DNA, 601 bp, Human; identical to SEQ ID NO: 111608

SEQ ID NO: 112048 - DNA, 601 bp, Human; identical to SEQ ID NO: 111609

SEQ ID NO: 112049 - DNA, 601 bp, Human; identical to SEQ ID NO: 111610

SEQ ID NO: 112050 - DNA, 601 bp, Human; identical to SEQ ID NO: 111611

SEQ ID NO: 112051 - DNA, 601 bp, Human; identical to SEQ ID NO: 111612

SEQ ID NO: 112052 - DNA, 601 bp, Human; identical to SEQ ID NO: 111613

SEQ ID NO: 112053 - DNA, 601 bp, Human; identical to SEQ ID NO: 111614

SEQ ID NO: 112054 - DNA, 601 bp, Human; identical to SEQ ID NO: 111615

SEQ ID NO: 112055 - DNA, 601 bp, Human; identical to SEQ ID NO: 111616

SEQ ID NO: 112056 - DNA, 601 bp, Human; identical to SEQ ID NO: 111617

SEQ ID NO: 112057 - DNA, 601 bp, Human; identical to SEQ ID NO: 111618

SEQ ID NO: 112058 - DNA, 601 bp, Human; identical to SEQ ID NO: 111619

SEQ ID NO: 112059 - DNA, 601 bp, Human; identical to SEQ ID NO: 111620

SEQ ID NO: 112060 - DNA, 601 bp, Human; identical to SEQ ID NO: 111621

SEQ ID NO: 112061 - DNA, 601 bp, Human; identical to SEQ ID NO: 111622

SEQ ID NO: 112062 - DNA, 601 bp, Human; identical to SEQ ID NO: 111623

SEQ ID NO: 112063 - DNA, 601 bp, Human; identical to SEQ ID NO: 111624

SEQ ID NO: 112064 - DNA, 601 bp, Human; identical to SEQ ID NO: 111625

SEQ ID NO: 112065 - DNA, 601 bp, Human; identical to SEQ ID NO: 111626

SEQ ID NO: 112066 - DNA, 601 bp, Human; identical to SEQ ID NO: 111627

SEQ ID NO: 112067 - DNA, 601 bp, Human; identical to SEQ ID NO: 111628

SEQ ID NO: 112068 - DNA, 601 bp, Human; identical to SEQ ID NO: 111629

SEQ ID NO: 112069 - DNA, 601 bp, Human; identical to SEQ ID NO: 111630

SEQ ID NO: 112070 - DNA, 601 bp, Human; identical to SEQ ID NO: 111631

SEQ ID NO: 112071 - DNA, 601 bp, Human; identical to SEQ ID NO: 111632

SEQ ID NO: 112072 - DNA, 601 bp, Human; identical to SEQ ID NO: 111633

SEQ ID NO: 112073 - DNA, 601 bp, Human; identical to SEQ ID NO: 111634

SEQ ID NO: 112074 - DNA, 601 bp, Human; identical to SEQ ID NO: 111635

SEQ ID NO: 112075 - DNA, 601 bp, Human; identical to SEQ ID NO: 111636

SEQ ID NO: 112076 - DNA, 601 bp, Human; identical to SEQ ID NO: 111637

SEQ ID NO: 112077 - DNA, 601 bp, Human; identical to SEQ ID NO: 111638

SEQ ID NO: 112078 - DNA, 601 bp, Human; identical to SEQ ID NO: 111639

SEQ ID NO: 112079 - DNA, 601 bp, Human; identical to SEQ ID NO: 111640

SEQ ID NO: 112080 - DNA, 601 bp, Human; identical to SEQ ID NO: 111641

SEQ ID NO: 112081 - DNA, 601 bp, Human; identical to SEQ ID NO: 111642

SEQ ID NO: 112082 - DNA, 601 bp, Human; identical to SEQ ID NO: 111643

SEQ ID NO: 112083 - DNA, 601 bp, Human; identical to SEQ ID NO: 111644

SEQ ID NO: 112084 - DNA, 601 bp, Human; identical to SEQ ID NO: 111645

SEQ ID NO: 112085 - DNA, 601 bp, Human; identical to SEQ ID NO: 111646

SEQ ID NO: 112086 - DNA, 601 bp, Human; identical to SEQ ID NO: 111647

SEQ ID NO: 112087 - DNA, 601 bp, Human; identical to SEQ ID NO: 111648

SEQ ID NO: 112088 - DNA, 601 bp, Human; identical to SEQ ID NO: 111649

SEQ ID NO: 112089 - DNA, 601 bp, Human; identical to SEQ ID NO: 111650

SEQ ID NO: 112090 - DNA, 601 bp, Human; identical to SEQ ID NO: 111651

SEQ ID NO: 112091 - DNA, 601 bp, Human; identical to SEQ ID NO: 111652

SEQ ID NO: 112092 - DNA, 601 bp, Human; identical to SEQ ID NO: 111653

SEQ ID NO: 112093 - DNA, 601 bp, Human; identical to SEQ ID NO: 111654

SEQ ID NO: 112094 - DNA, 601 bp, Human; identical to SEQ ID NO: 111655

SEQ ID NO: 112095 - DNA, 601 bp, Human; identical to SEQ ID NO: 111656

SEQ ID NO: 112096 - DNA, 601 bp, Human; identical to SEQ ID NO: 111657

SEQ ID NO: 112097 - DNA, 601 bp, Human; identical to SEQ ID NO: 111658

SEQ ID NO: 112098 - DNA, 601 bp, Human; identical to SEQ ID NO: 111659

SEQ ID NO: 112099 - DNA, 601 bp, Human; identical to SEQ ID NO: 111660

SEQ ID NO: 112100 - DNA, 601 bp, Human; identical to SEQ ID NO: 111661

SEQ ID NO: 112101 - DNA, 601 bp, Human; identical to SEQ ID NO: 111662

SEQ ID NO: 112102 - DNA, 601 bp, Human; identical to SEQ ID NO: 111663

SEQ ID NO: 112103 - DNA, 601 bp, Human; identical to SEQ ID NO: 111664

SEQ ID NO: 112104 - DNA, 601 bp, Human; identical to SEQ ID NO: 111665

SEQ ID NO: 112105 - DNA, 601 bp, Human; identical to SEQ ID NO: 111666

SEQ ID NO: 112106 - DNA, 601 bp, Human; identical to SEQ ID NO: 111667

SEQ ID NO: 112107 - DNA, 601 bp, Human; identical to SEQ ID NO: 111668

SEQ ID NO: 112108 - DNA, 601 bp, Human; identical to SEQ ID NO: 111669

SEQ ID NO: 112109 - DNA, 601 bp, Human; identical to SEQ ID NO: 111670

SEQ ID NO: 112110 - DNA, 601 bp, Human; identical to SEQ ID NO: 111671

SEQ ID NO: 112111 - DNA, 601 bp, Human; identical to SEQ ID NO: 111672

SEQ ID NO: 112112 - DNA, 601 bp, Human; identical to SEQ ID NO: 111673

SEQ ID NO: 112113 - DNA, 601 bp, Human; identical to SEQ ID NO: 18716

SEQ ID NO: 112114 - DNA, 601 bp, Human; identical to SEQ ID NO: 18717

SEQ ID NO: 112115 - DNA, 601 bp, Human
aggaacccctcctgaccctgaacttctatctcagtttcaagcttcctagtcttccccccacacacacacctagctcctcaggcggagagcacccctttcttggccacccgggtatcccccagggggagtacggggctcaaaacacccttctggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttgrttagagaaactgatttttcttttttctttttttttcccaaaagagtacctctgatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctg

SEQ ID NO: 112116 - DNA, 601 bp, Human
atctcagtttcaagcttcctagtcttccccccacacacacacctagctcctcaggcggagagcacccctttcttggccacccgggtatcccccagggggagtacggggctcaaaacacccttctggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttgattagagaaactgatttttcttttttctttttttttcccaaaagagtacctctgatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaac

SEQ ID NO: 112117 - DNA, 601 bp, Human
tcttccccccacacacacacctagctcctcaggcggagagcacccctttcttggccacccgggtatcccccagggggagtacggggctcaaaacacccttctggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttgattagagaaactgatttttcttttttctttttttttcccaaaagagtacmtctgatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaa

SEQ ID NO: 112118 - DNA, 601 bp, Human
gggagtacggggctcaaaacacccttctggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttgattagagaaactgatttttcttttttctttttttttcccaaaagagtacctctgatcattttagcctgcaactaatgatagagatattagggctagttaaccacagttttacaagactcctctycccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgc

SEQ ID NO: 112119 - DNA, 601 bp, Human
atgttctacacctgtcatttgatttttctcttgctcaagccttaaaagagctgccaaccgcactgctgtttttcctgaaagacctggaatttcacatggttacttctaactttgccattggcttttaacattttcgtgttaatgttaattttcattttatgttaatgactctgcctatgaaatagtgtttctttattcttgtacaaataaaggtcagtactacaaccaaatttaaaatcttccgaaaagattaaaggtataagcagattcaatacttggcaaaactattaagataatagcaaaaaaaaaaaaaaaacccacattttttacctaaaaaccttttaagtgattggttaaaatagtttggccgggtgcggtggctcacgcctgtaatcctagcactttgggaggcagaggcgggtggatcacctgaggtcaggagaccagcctggccaacatggcaaaaccccgtctctattaaaaatacaaaaattagccaagcatggtggcgggcacctgtaatcccagctactctggaggctgaggcaggagaattgcttgaactggggaggggaggcagtgagccgagatcgcaccattg

SEQ ID NO: 112120 - DNA, 601 bp, Human
tgtattaaccttcgcttacaggaattgcccttgcacttttccatccctacaccctcagtcatctgttcttacctttcaggtaaggagctaaacagaacctgctgcctgaatgggggaacctgcatgctggggtccttttgtgcctgccctccctccttctacggacggaactgtgagcacgatgtgcgcaaagagtaagcaattcagaggggcggggagccgtggagaggagagagaaagggaagtggaaatttcagacccaaggctatcgccttacctgttcattctcaggaactgtggktctgtgccccatgacacctggctgcccaagaagtgttccctgtgtaaatgctggcacggtcagctccgctgctttcctcaggcatttctacccggctgtggtaagcggaggttctcctctttcttttgccctttgaagttacgtagttgccttggggggtgcttagttagcaggctctccttgtacctcttgtcttgctagagcctggcagccaaagttctgcttataaaagcatcgcagactcctgatgagatagttgccttggcctctttgatatttatttcctcgggaacctggcta

SEQ ID NO: 112121 - DNA, 601 bp, Human
cggagggcagtggcttacgcctgtaatcccagcactttgggaggctgaggcgggcggatcacgaggtcaggagatcgagcccatcccggctaacacggtgaaacccagcctctactaaaaatataaaaaaaaattagcccggcgtggtggagggcgcctgtagttccagttactcaggaggctgagtgaggcaggagaatggcgtgaacccgggaggtggagcttgcagtgagccgagatggcgccactgcactccagcctgggcgacagagcaaaactccgtctcaaaaaaaaaaaaaaattcaagccaggcacggtggctcacgcctgtaatcccagcactttgggaggccgaggcgggtggatcacgaggtcaggagctcaagaccagcctgggcaagatggtgaaaccccatctctactaaaaatacaaaaaattagccgggcgtggtggcacgtgcctgtaatcccagctactccggaggctgaggcagagaattgcttaaacctggaggggcggaggttgcagtgagccgagatcgcaccactgcactccagcctgggcgacacagcgagaccctgcctcaaaaaaataaaataa

SEQ ID NO: 112122 - DNA, 601 bp, Human
aaaaaattagccgggcatggtggcgggtgcctgtaatcccagatatttgggaggctgaggcggcagaatcacttgaacccgggaggcagagattgcagtgagccaaggttgtgccactgcactccagcctggtgacacagcaagactccgtctcaaaaataataataataaaattaatttttaaaaattcgggcggagggcagtggcttacgcctgtaatcccagcactttgggaggctgaggcgggcggatcacgaggtcaggagatcgagcccatcccggctaacacggtgaaacccascctctactaaaaatataaaaaaaaattagcccggcgtggtggagggcgcctgtagttccagttactcaggaggctgagtgaggcaggagaatggcgtgaacccgggaggtggagcttgcagtgagccgagatggcgccactgcactccagcctgggcgacagagcaaaactccgtctcaaaaaaaaaaaaaaattcaagccaggcacggtggctcacgcctgtaatcccagcactttgggaggccgaggcgggtggatcacgaggtcaggagctcaagaccagcctgggcaagatggtga

SEQ ID NO: 112123 - DNA, 601 bp, Human
aaccaaaggctctcctctcagtcaacaatcacctaaggcaccaaaaacaccaatgacaacagatactttttaggcttcatcaaacaaaaaacccttgttccatgactcacctctcttttctcaccttttaggacgaagtgtccctctgtcacacaggctggagtgcagaggcgcaatctcagctcactgcaacctccgcccactacaacctccgcctcccaggttcaagtgattctcctgcctcagcctccacagtagttgagattaaaggcatgtgcaaccacgcctggctaatttttgyatttttagtagaaacggggtttcgccatgttgcccaggctggtctcaaactcctggcctcaagtgatccacacactcagcctcccaaagtgctgggattacagacatgagccaccacgcccagcctcacctctctattacttatcatccccattgtgggttctcctttctctacccagtcctcatatgcgcatgctttccatgtctcttgagtacttcaaattgccaactaacattgctacctaaagtccggcaaacaccactaattcactgacttagggtcctccaaacctgttcattc

SEQ ID NO: 112124 - DNA, 601 bp, Human
aaacaaaaaaaacaaaaaaaaacttgtctccttcccttcactgccaacattcttaaacaagtattctaaactcataatctttttcctctcattctccccttaattatggccagtggtttcctctattaaccaaaggctctcctctcagtcaacaatcacctaaggcaccaaaaacaccaatgacaacagatactttttaggcttcatcaaacaaaaaacccttgttccatgactcacctctcttttctcaccttttaggacgaagtgtccctctgtcacacaggctggagtgcagaggcgyaatctcagctcactgcaacctccgcccactacaacctccgcctcccaggttcaagtgattctcctgcctcagcctccacagtagttgagattaaaggcatgtgcaaccacgcctggctaatttttgcatttttagtagaaacggggtttcgccatgttgcccaggctggtctcaaactcctggcctcaagtgatccacacactcagcctcccaaagtgctgggattacagacatgagccaccacgcccagcctcacctctctattacttatcatccccattgtgggttctcctttctcta

SEQ ID NO: 112125 - DNA, 601 bp, Human
ccttaagaatgcctccctcccgccagacacagtggctcacacctgtaatcccaacactttgagaggccgaggcaggcggattgcttgagctcaaagttcaagaccagcctgggaaacatggcaaaaccctctccccacaaaaaattagccagtcgtggtggtgtgtgcctgtagtcccagctactccagaggctgaggtgggaggatcacttgagcctgggaggtccaggttatagtgaaccatgcaccactgcaatccagcaccggcaagagaacaagaccttgtctcaaaaaaaaaaaacaaaaaaaacaaaaaaaaacttgtctccttcccttcactgccaacattcttaaacaagtattctaaactcataatctttttcctctcattctccccttaattatggccagtggtttcctctattaaccaaaggctctcctctcagtcaacaatcacctaaggcaccaaaaacaccaatgacaacagatactttttaggcttcatcaaacaaaaaacccttgttccatgactcacctctcttttctcaccttttaggacgaagtgtccctctgtcacacaggctggagtgcagaggcgcaa

SEQ ID NO: 112126 - DNA, 601 bp, Human
aatgttttgttacataaacactgagtaagaatctagtttaaattgacccttaagaatgcctccctcccgccagacacagtggctcacacctgtaatcccaacactttgagaggccgaggcaggcggattgcttgagctcaaagttcaagaccagcctgggaaacatggcaaaaccctctccccacaaaaaattagccagtcgtggtggtgtgtgcctgtagtcccagctactccagaggctgaggtgggaggatcacttgagcctgggaggtccaggttatagtgaaccatgcaccactgyaatccagcaccggcaagagaacaagaccttgtctcaaaaaaaaaaaacaaaaaaaacaaaaaaaaacttgtctccttcccttcactgccaacattcttaaacaagtattctaaactcataatctttttcctctcattctccccttaattatggccagtggtttcctctattaaccaaaggctctcctctcagtcaacaatcacctaaggcaccaaaaacaccaatgacaacagatactttttaggcttcatcaaacaaaaaacccttgttccatgactcacctctcttttctcacctttt

SEQ ID NO: 112127 - DNA, 601 bp, Human
tcacagtatattactgagttctgctggggactatgtaagtatttctgctataacatatgttgcttctgacaactcctgcattctgcacaaattaaaaataacacagcagaccagatgtggtggcttacatctgtaatcccagcactttgggaggccgaggcaggcagatcacctgaggtcaggagttcgagaccagcctggccaacatggcaaaaccccttctctactaaaaatacaaaaattcacagggcttggtggtgcacgcctgtaatccccgctactggagaggctgaagcacaasaatcacttgaacgtgggaggtggaggttatactgagcagagatcataccactcactactctccagtctgggcaacagagcaagactgtctcaaaaataaaataaaataaggccgggctcagtggctcatgtctgtaatctcagcactttggaaggctgaggtgggcggatcatctgaggtcgggagttcaagaccagcctaacatgaagaaacctcatctctattaaaaatgtaaaattaggccgggcacagtggctcacgcctgtaatcccagcactttgggaggccgaggcaggtgga

SEQ ID NO: 112128 - DNA, 601 bp, Human
cactgcactccagcctgggcaagggtaagaccctatctttaaaaaaaagagacagaataaaaagaagctattagaaatttaaaatacaatagcaaaaattggaaaacaaaattgagaacatctcttagtagagaaaaaatattttttaaaaaagggaagaaaaccaaaggatcaatgtaagagatccaacatttgaatactaggagtctcatatggtaataaaagaggagaaaatctcaagaaaatttccaacaactgaaggacataaatttcaagaccaaaagaattcaatcagatgatsaacacaatggatgaaaagagatctacaacaaggaacatccctgtgaaattttagaactggatcaaaagaagatcctacaagcttttaaatttttcactcatcattacttctgcagccaatgaaagctagaaaactaaagaacacgtcttcattttatttatttatttgtttatttgtttatttatttatttattgagacagagtttcgctcttgtcgctcaggctggagtgcaatggcgcgacctgggctcattgcaacctccacctcccgggttcaagcaattcccttgcctcggcctc

SEQ ID NO: 112129 - DNA, 601 bp, Human
acacaaagacctaaacagaaaaagaaattaacttagcaaagagggactatgaaggacaatgaagacttctgcaaagataagagaaagtaccaaacacaccaggcacagtggctcacgcctataatcccagcactttgggaggcaggcgaatcacctgaggtcaggagtttaagacgagcctggtcaacatggcaaaatcccatctctactaaaaatacaaaagttagccaggcgtaatggcacgtgtctgtaatcccagttactcgggaggctgaggcaggagaatcacttaaacacaggrggcggaggttgcagtgagctgggatcatgccgctgtactccagtctgggtgacagagtaagactctgtctccaaaaaaaaaaaaaaaaaggaaccaaatccatcaaatttagacaaaaacaatgctatagagctatcaagaagagaataggctgggtacagtggctcacacctgtaaacccagcactttggaaggcagcgataggtggatcacttgaggtcaggagttcgagaccagcctgaccaacatggtgaaaccccgtctctactaaaaatacgaaaatcagcccggtgtcatggt

SEQ ID NO: 112130 - DNA, 601 bp, Human
aaactctatctcaaaaaaaaaaaaaaaaaaaaaaaaaatccctagtgctttctgttccctgcactgagtgatgacacaaagacctaaacagaaaaagaaattaacttagcaaagagggactatgaaggacaatgaagacttctgcaaagataagagaaagtaccaaacacaccaggcacagtggctcacgcctataatcccagcactttgggaggcaggcgaatcacctgaggtcaggagtttaagacgagcctggtcaacatggcaaaatcccatctctactaaaaatacaaaagttagmcaggcgtaatggcacgtgtctgtaatcccagttactcgggaggctgaggcaggagaatcacttaaacacagggggcggaggttgcagtgagctgggatcatgccgctgtactccagtctgggtgacagagtaagactctgtctccaaaaaaaaaaaaaaaaaggaaccaaatccatcaaatttagacaaaaacaatgctatagagctatcaagaagagaataggctgggtacagtggctcacacctgtaaacccagcactttggaaggcagcgataggtggatcacttgaggtcaggagt

SEQ ID NO: 112131 - DNA, 601 bp, Human
caacaatgttctaagcatcattattgctcctctagcctctctaaaaatcatttctaagcacctacatctcatattgtttccctttctgcttaaaatccctagtgctgccgggcgcggtggctcatgcctgtaatctcagcactttgggaggccgaggcgggtggatcacctgaggtcgggagtttgagaccagcctgaccagcatggagaaaccccgtctctactaaaaatacaaaattagccaggcgtggtggcacatgcctgtaatcccagctactagggaggctgaggcaggagaaaygcttgaacctgggaggcggaggttgcggtgagccgcgatcgcgccactgcactccagcctgggcaacaagagtgaaactctatctcaaaaaaaaaaaaaaaaaaaaaaaaaatccctagtgctttctgttccctgcactgagtgatgacacaaagacctaaacagaaaaagaaattaacttagcaaagagggactatgaaggacaatgaagacttctgcaaagataagagaaagtaccaaacacaccaggcacagtggctcacgcctataatcccagcactttgggaggcaggcgaatca

SEQ ID NO: 112132 - DNA, 601 bp, Human
tattaacaagggtctcctctggcatatgcaaaaagactaagaagatgcttttgcataaactcaaagttacaaaggatagtttccggtgccaataaaattctgctactcactgaataaactaatctgtcaaagaattagcaacaacctaatcagactcaggcaaactctagttgaaactcgggtaaaattaggaaaaatactaaatgagattgaaactggaccacaaaaccacttctttgaaacaaaaaaaaaaatcactgtaacataaacaggcacaggagtatggagcagactcgtacasattaagtcttaatttaaatgactgattcatttaaaaagaaaaagaaaaaccaataactactacctttgtcactcatctacaatgtgctaggcactgacctgggtgtaaaatatttctgaaacagtgttccaatgtccattctccagtttgctgggtgttatgaggcagctattcctaaagcaatagcagtggcagcttcctagtcctgaatagtagctatatactgtttttaaaacagtttactggttccattggtggcctcacacataaaagctcccaaagaaggtcagttctacaaca

SEQ ID NO: 112133 - DNA, 601 bp, Human
caggccagagtgcaatggcgcaatctcagctaactgcaacctccgccttccgggtttaagtgattctcctgtctcagcctcctgagtagctaggattacaggcgcccgacactacattcggctaatttttggtatttttagtagagatggggtttcaccatgttggccaggctggtctcgaacccctgacctcaggagatccacctgcctcggcctcccaaagtgctgggattacaggcgtgagccaccatgcccggccttgtgatcacaatttctattaacaagggtctcctctggcatrtgcaaaaagactaagaagatgcttttgcataaactcaaagttacaaaggatagtttccggtgccaataaaattctgctactcactgaataaactaatctgtcaaagaattagcaacaacctaatcagactcaggcaaactctagttgaaactcgggtaaaattaggaaaaatactaaatgagattgaaactggaccacaaaaccacttctttgaaacaaaaaaaaaaatcactgtaacataaacaggcacaggagtatggagcagactcgtacagattaagtcttaatttaaatgactga

SEQ ID NO: 112134 - DNA, 601 bp, Human
gctcagcatcaacatgccatgtctcttatatctagccatgctccagacctttagagaaaaaataaaccttattttcaatttaaagtaaaatatacccacataaaaaccttgtcctaaaactagataattttatttcgtaacaggctcaaactgcttatcaagcatgcatttgctccaacagccactcatcagcttcaacactgtcctcatgttaacttcccttccaaagggaaaaaggatgtgatccacagtatttttccaaaggaaaattaatgaacttccccgaaattaaaacaaatayaacttaatacacaaaaactcggccaggcacggtggttcactcctgtaatcccagtactatagggggccgaggcaggcagatcacctgaggtcaggagttagagaccagactggtcaacatggtgaaatacaaaaatacaaaagttggctgggcgtggtggctcatgcctgtaatcccagctactcaagaggctgaggcaggagaatcgcttgaacccaggagatggaggtagcagtgagtcaagatcactccattgcactccagcctgggcaacaaagcgagattccatctcaaaaaaaa

SEQ ID NO: 112135 - DNA, 601 bp, Human
gtaaggttcttctgaacagctgtctggtagcccctgaacaccactcaacactagtgcagtactcaagtgactatcacacaaatccgtgtctggggatctcttcacacccagagctcagcatcaacatgccatgtctcttatatctagccatgctccagacctttagagaaaaaataaaccttattttcaatttaaagtaaaatatacccacataaaaaccttgtcctaaaactagataattttatttcgtaacaggctcaaactgcttatcaagcatgcatttgctccaacagccactcawcagcttcaacactgtcctcatgttaacttcccttccaaagggaaaaaggatgtgatccacagtatttttccaaaggaaaattaatgaacttccccgaaattaaaacaaatataacttaatacacaaaaactcggccaggcacggtggttcactcctgtaatcccagtactatagggggccgaggcaggcagatcacctgaggtcaggagttagagaccagactggtcaacatggtgaaatacaaaaatacaaaagttggctgggcgtggtggctcatgcctgtaatcccagctactcaag

SEQ ID NO: 112136 - DNA, 601 bp, Human
gcaggagaatcgcttgaacccgggggggcagaggttgctgtgagccaagatcgcaccattgcactccagcctgggcgacagagcaaggctccatctaaaacaaacaaatgaacaaacaaaaaaaccacatccaatcacagaatcgctggaaaatgaaccctcaatggaactcttagagaaatatatcattactaggtgataactttagggtacattcttccaaaagtcataccacatacataacatgcagaaagtcattccaggcctgcaataacaataactacttgaaaatgaattaggrggccaggcccggtggttcatgcctgtaatcctagcactttgggaggccaaaatgggcagaatgcttgagcccaggagttcgagaccaccctgggcaacatggtgaaaccccatttctacaaagaatacaaaaattagctgggagtagtggcctgtgcctgtagtcccagctactagagagactgagatgggaggattgcttgggccagggaggttaaggctgcagtgagctgtggtcatgccacggcactccagccactgtcgctctgggcaacagagcaagatccttatttaaaaaaaa

SEQ ID NO: 112137 - DNA, 601 bp, Human
gaaaagatttaatagtattcactttttactcatcataaaagctcagcagtcatgccacatgcttaaatctcatgctttaaaacaccacacgatggcaggctttaactgaagactagtccagaagaggaaaaaattaactgttaaaaaaaatcccatactgtaataatttacaaccaaaatgcctagttcacacaagtgctgggtctccacaggaatgaactgacacttgtgaaggagtctctattttgccccactataaaactaccagaagggctaggatacatgtcataagacatatgaytgaaaataaaaccatattttaaatgcagtattacacaatacttacaaaagctactgactcaaaattaattacttaacaattacaaacagtaatttttaaagctcaggtcataatgtggtacttctcaatgtgatcctgcctcatggcaggagaatgacctgtgccttccagggaccaaaatggtccagcaagaatgatactgcataaaacagcatgtcaactttacaagttattgtatggaacaacctgtaaaatcggcatattttatgcagtattgttcttgtttatttgacttcacag

SEQ ID NO: 112138 - DNA, 601 bp, Human
ccttaataataccaaaattattgccgggcatggtgggccatgcctgtaatcccagcattttgggaggccgaggcaagtggatcacctgaggtcaggagtttgaggcaagcctggccaaaatgaagccctgtctctataaaaaatacaaaaattagcagggcatggtggggtgtgcctgtaatcccagctacctgggagggtgaggcaggagaattgcctgaacccgggaggtagaggttgcagtgagccgagatcataccactgcactccagcctgggtgacagagtgagactccgtctcaaaaaataataataacatcaaaattattaatacctgttcttaaaactgctattgtatttttcttggagaaacaggatcttaaaaataaactaaaaaagtaaaagagtacttttacttactgatgtttgaggactggctaaaggaggaatctttaattaataaaaatttcaaaataatattgtaatattaaaataaagtgaagaaataaactggccaaatgttgatcacatatgaaaagatttaatagtattcactttttactcatcataaaagctcagcagtcatgccacatgcttaaatc

SEQ ID NO: 112139 - DNA, 601 bp, Human
aaaattatagttcatttggatatattttgcccaataattatattttaaaggtcagtatttctctcatccaaataattattaacagtagttacacagagaagccttaataataccaaaattattgccgggcatggtgggccatgcctgtaatcccagcattttgggaggccgaggcaagtggatcacctgaggtcaggagtttgaggcaagcctggccaaaatgaagccctgtctctataaaaaatacaaaaattagcagggcatggtggggtgtgcctgtaatcccagctacctgggaggstgaggcaggagaattgcctgaacccgggaggtagaggttgcagtgagccgagatcataccactgcactccagcctgggtgacagagtgagactccgtctcaaaaaataataataacatcaaaattattaatacctgttcttaaaactgctattgtatttttcttggagaaacaggatcttaaaaataaactaaaaaagtaaaagagtacttttacttactgatgtttgaggactggctaaaggaggaatctttaattaataaaaatttcaaaataatattgtaatattaaaataaagtga

SEQ ID NO: 112140 - DNA, 601 bp, Human
tattttgcataaaaattatttcagtttataaaaccaactaccaaaaaactgaggttcagggccgggcacggtggctcatgcctgtaatcccagcactttggaaggccaaggctggcggatcacttgaggtcaggagttcgagaccagccttgccaacatggtaaaacctcgtctttaccaaaaaatacaaaaacttaagctgggcatggtggcgcaatgcctgtagtcccacctactcgagaggctcaggcaggagaatcacttgaactcaggaggtggaggttgcagtgagccgagaccrcaccactgcactccagcctgggtgacagagagagaccttgtatcaaaaaaacaaacaaacaggccgggcgtggtggctcatgcctgtaatcccagcactctgggaggctgaggtgggcggatcacctgatgttgggagttcaagacctgcctgaccaacatggagaaaccccgtctctactaaaaatacaaaaaaattatccaggcatggaggcgcatgcctgtaatcccagctactcagggggctgaggaaggagaatcacttgaacccaggaggcagaggttgcagtgagccgagatt

SEQ ID NO: 112141 - DNA, 601 bp, Human; identical to SEQ ID NO: 32622

SEQ ID NO: 112142 - DNA, 601 bp, Human; identical to SEQ ID NO: 32623

SEQ ID NO: 112143 - DNA, 601 bp, Human; identical to SEQ ID NO: 32624

SEQ ID NO: 112144 - DNA, 601 bp, Human; identical to SEQ ID NO: 32625

SEQ ID NO: 112145 - DNA, 601 bp, Human; identical to SEQ ID NO: 32626

SEQ ID NO: 112146 - DNA, 601 bp, Human; identical to SEQ ID NO: 32627

SEQ ID NO: 112147 - DNA, 601 bp, Human; identical to SEQ ID NO: 32628

SEQ ID NO: 112148 - DNA, 601 bp, Human; identical to SEQ ID NO: 32629

SEQ ID NO: 112149 - DNA, 601 bp, Human; identical to SEQ ID NO: 32630

SEQ ID NO: 112150 - DNA, 601 bp, Human; identical to SEQ ID NO: 32631

SEQ ID NO: 112151 - DNA, 601 bp, Human; identical to SEQ ID NO: 32632

SEQ ID NO: 112152 - DNA, 601 bp, Human; identical to SEQ ID NO: 32633

SEQ ID NO: 112153 - DNA, 601 bp, Human; identical to SEQ ID NO: 32634

SEQ ID NO: 112154 - DNA, 601 bp, Human; identical to SEQ ID NO: 32635

SEQ ID NO: 112155 - DNA, 601 bp, Human; identical to SEQ ID NO: 32636

SEQ ID NO: 112156 - DNA, 601 bp, Human; identical to SEQ ID NO: 32637

SEQ ID NO: 112157 - DNA, 601 bp, Human; identical to SEQ ID NO: 32638

SEQ ID NO: 112158 - DNA, 601 bp, Human; identical to SEQ ID NO: 32639

SEQ ID NO: 112159 - DNA, 601 bp, Human; identical to SEQ ID NO: 32640

SEQ ID NO: 112160 - DNA, 601 bp, Human; identical to SEQ ID NO: 32641

SEQ ID NO: 112161 - DNA, 601 bp, Human; identical to SEQ ID NO: 32642

SEQ ID NO: 112162 - DNA, 601 bp, Human; identical to SEQ ID NO: 32643

SEQ ID NO: 112163 - DNA, 601 bp, Human; identical to SEQ ID NO: 32644

SEQ ID NO: 112164 - DNA, 601 bp, Human; identical to SEQ ID NO: 32645

SEQ ID NO: 112165 - DNA, 601 bp, Human; identical to SEQ ID NO: 32646

SEQ ID NO: 112166 - DNA, 601 bp, Human; identical to SEQ ID NO: 32647

SEQ ID NO: 112167 - DNA, 601 bp, Human; identical to SEQ ID NO: 32648

SEQ ID NO: 112168 - DNA, 601 bp, Human; identical to SEQ ID NO: 32649

SEQ ID NO: 112169 - DNA, 601 bp, Human; identical to SEQ ID NO: 32650

SEQ ID NO: 112170 - DNA, 601 bp, Human; identical to SEQ ID NO: 32651

SEQ ID NO: 112171 - DNA, 601 bp, Human; identical to SEQ ID NO: 32652

SEQ ID NO: 112172 - DNA, 601 bp, Human; identical to SEQ ID NO: 32653

SEQ ID NO: 112173 - DNA, 601 bp, Human; identical to SEQ ID NO: 32654

SEQ ID NO: 112174 - DNA, 601 bp, Human; identical to SEQ ID NO: 32655

SEQ ID NO: 112175 - DNA, 601 bp, Human; identical to SEQ ID NO: 32656

SEQ ID NO: 112176 - DNA, 601 bp, Human; identical to SEQ ID NO: 32657

SEQ ID NO: 112177 - DNA, 601 bp, Human; identical to SEQ ID NO: 39136

SEQ ID NO: 112178 - DNA, 601 bp, Human
tcattttcgtaaatactttggtctaacatcttccatgatcttttatggtgaaaaaaacatgctaattatagaagtcctaatacacaaacacacacatacacacacaaaaacacacacacacgacaaggtaaacaaaaatcacccagaaattttgttaacaatttgatgtcttttccccattcttttctctgcatatttttaagtaattgttttaaaatgtcaaatccattttatatagctttgaatctgatttctcctccctccacttaatacaggatacgagaaaatacaatttttttttgaaaatgccgccttaaaggctgcgaagagcaaccttgaatggatgctctataatttactgaaccaatcccctttatttgagggcttaggaagttgccaatgttttgctcttattaaatgatggtgaccatccttctacctctgtcagaactctgacaatttcctttagatacaattctagaaacgagacaaccgagaaaaaaagtgttttagatgctgagacttaaatccctcttgccacattgccttccaaaaaggtacttgggcttcacgaggttatagacatgtgtagaaggtgttc

SEQ ID NO: 112179 - DNA, 601 bp, Human
gtttgaagctgtgtggcaggaaatgaggtggaaatattggacaagtggtcaagttaggtggtcaagtgcctacggtgccaagtggactgttcggtctttattctgtagacatgtggctgacagggtgccatccaccagacccacaccctccttttgtctgtgcacccactaatccatgcatacacccagccaccaatccatgctccgtccggcttccactcatctatctatccacccatccagccgaagcatcctctgcaccaggcacaggattacttcttgtttctttttcttggaacctgagggtcttgaggtttccctagcaaccccttgatacatattcaactccagaactatcagccccacatgcatccctctgcagactattcaggtgatggtggtattataaacaaggaattaagtagtcatgtgacagtgaggctcacctggactgatgactgggaaacatgtacccaggataaaggtatcatgggtaggtctactgagcacagaatgatgtggaaatctcattctgacaaataattctttttaagagtcagttatagagctgttagagcacatggtaatgctgttagagcat

SEQ ID NO: 112180 - DNA, 601 bp, Human
acacacacttgcatccccgatttcttcctgaacaactactgccttagattttgacatggttgcccaagacctgctgactttttcaaaaagagattttgtgaagttctttgagctgccttttattttttttttttctagagcaggcagccagggctgtacagagatgattggtacctggaatgtaatcttcagaattaacattcctcatgccgggccgggcctggcctggggagcaggaaggaaacaagcctctccagtcacgggcagagtcccatggagaggggcacagatccctaatccrtcttattctgggaagtattttggcacagcctggctctgtggtttataaacaaattctttgtttgctgggggtatttgcagctctgcttacaaggaagttatacacccctctgcagcctttcataatgtggctgatttttaccttccggtaagggatgggttgtaaactgcctgggtttggggcaacacaaatcacttcttaaaggtgactttactgtgcagtgaaaggcttgggaaagcctctagcatcctctagcgtcatttattctgtggcttttcctaataccttgctcattcactc

SEQ ID NO: 112181 - DNA, 601 bp, Human
gggtctagcaacctgcagtttatgaagatgctcaggtaggctacagtttgacatgcaattctctaagcaatttggggtaagcagtacaggcagctgaaagagctggcttcctgtcccagacagcaagggctttgcagggatgtggagcattccagtctgagagtgatactgtcccactgcatagtcaggtgtcctctgatttccccctcaatattgcagagagaaaatttaagagaaaaaaatccatatttccaccagtcacacaactgttctcatctctccatgtttcttccgtgcacakgtttatgtaaaatagttagtgcagtatttgctttttacaccttagtgcacacacacttgcatccccgatttcttcctgaacaactactgccttagattttgacatggttgcccaagacctgctgactttttcaaaaagagattttgtgaagttctttgagctgccttttattttttttttttctagagcaggcagccagggctgtacagagatgattggtacctggaatgtaatcttcagaattaacattcctcatgccgggccgggcctggcctggggagcaggaaggaaacaagcctc

SEQ ID NO: 112182 - DNA, 601 bp, Human
tgtaaaccttttttttttctttctggggcatgtgtgtgcttgtgtatgtgtgtgcatatacacaatgtttaatgtaatgtttaatgtaaggaacaccgagcacaccaggggatgctgaagctgctggcctgggggttccactttgggaaccactgctctattctgtgagactctccaccccagcgccttccttctcttcattcactcgcctccatcttggtcttcccccaaaagtttcccatttggagtcaaacccagtcaaccttttgaaaaccaagaacaagggcacaggtgagaaaawttaaagccgtctttactcttcctgactgtcactggtttaaacctcctagaattccctcccatctgttctctgctctccttgctcatcccctcgggcagcatcaccccttctccagctacccagtgcatccttggcctccatgctggcaatctctgtaaaccacagctctgactgtgccacttccctgcttaaaatctggctttgctgtcagagctaagctccaccttcttagcctgttatttggggcccttagggacatgctgactcctttttcatctccagtttcctctcctgccattg

SEQ ID NO: 112183 - DNA, 601 bp, Human
tttttacagcaaaaaatgttaacagtcattacctctgggtggtggaatttctggtgatttcgtattttattatttgtatatttctgcattttacagaattttttcctaacttttatatttttagtagagatgaggtctcactatattgctcaggctgatcttgaactcctgagctcaagtgatcctcctgcctcggcctcccaaagtgctgggattacaggcatgagcctccacacccggcccttttacacaatttctacgatgaacactcattacatttataacccccaaactcacaccmtatgttattctagagcatgttgttgcttatttttctaattatcatagccagtacgttgtctatttgctaaacctaagaatctcactagaagagacattcctttctgtatgaaatgtatcactgcaagccctcacatcataatctgtctcctttgagggccacagagatgcccgcccgagtcagtgcctttcatgggaaagcttactcaggtgtccaaactctttctctccctccacttacatatctttttttccaaaaacaacaacaacaaaaacaaacaaacaaacaaaaaacacagca

SEQ ID NO: 112184 - DNA, 601 bp, Human
gaaagaagcaagaagtacaagtgtgctaaaatttttttctttcatagggtgatatcaacagatgacatttcattcttgacagtgataactagagaaaataagtatactttcccctcaaatttaaattaactgctaatagaaaaaataggaattataccttctaaatcacttgagaaaaaaagtgaagaatatatacttcataatgtaaaagatcaaaacaaaatccaacaataataactaacaaaaaggaaaagtaaggcagtacgaaatgtgatgaaaaataacagcaaacataacctgmtaataaatataaacggatcaaattcctccactaaaacatgaggaccactggattataacagcataaaactttacgtgacttaaacttccacaactggagaatggttaagtaagttatgttacctctgtaaatggaatattatggagctatttaagcttatattttcaaaaaatattacatgattttggaaatgataaaaataaggttaattttgaaaaagcaaaaataccaagtcaacatataaaaatatggttctaattttttacagcaaaaaatgttaacagtcattacctctgggtg

SEQ ID NO: 112185 - DNA, 601 bp, Human
ccatattttttgctaggggagatccatactggctcttggtgataccctgtttccaaaaaaaaaaaaaatgataaaaaagaaaaagaaagctatcccacagctcagaagaaaaggataaagagatggagattacaagaagagaagagacatggacagcaaacccaagcgctactctatgtctaataagcgttactcagtttcagcagttgtgcctgcagaaagaacactgcagacacaactggtagaaaagtacaatcacaaattctacaagtcattttcccagttgtgtacattgaaagcrctcactagtcctaggttaacttgatgaaaacatttaatacttagacatatagcctgtgatctttcagaaattataagattcacataataccatataaatttatgtaatattctaggtccatgatacctaataactaataaaaaataaaattggctgcagagttctcctttgcagaaatgaaaatctgaaaacaacagaaaagcatctatagatttttgagtaaaaaacattgtagctaactcatgtggctacaaaggacagatgttctcagacatgctgagaaagcgaaccacctattta

SEQ ID NO: 112186 - DNA, 601 bp, Human
agtttgttctcagattgtgacacacctgccttttccatccctagcctctcacctggtcaaatcttccttggctcctccttccacctggaatcaaacccatactccctcccttgacctctgaggcttggggaacagggctcccaccttcccttccctgccgctggcctctctccatccactgcagtcacactggccttcctgctggtctggcctcagcaccttggttcttgctgttcctcctgcccaggatgctttctctcttctttcagtgctctgcccagacttggcttccccagagccrccttctctgtccaccctcactagaacagccttcttgccatcttggactccttaccctgcttgatttaccttctgaacatttccctatgtgaataatgctataattttctttgtttacttggtgtctgcctctctactagcaaggaagctctcctcttgttctctgctctgcttagaacagcactgggcagagagccagagtccattgaatatttgttgaatgcaggaaagaatccttagggtctcactggatcttccagatgcatcacttcctccaagtgtcaccagatcactcaaaact

SEQ ID NO: 112187 - DNA, 601 bp, Human
ttcaagtggtttgttatgaataaataggtaactgaggcacacattgagccctgtggtaatgtctctgccactgtgagtccatattaccccagatgagtgggacgcttacagtcacagaattattggaagatgtagactcagctcagcctggtgaatccttactcatcaccacctccctggcacccactgtcacatctccactgcaccgccctccaggcaggtctttgtgattccaccctccagtcccctccctgcagtttgttctcagattgtgacacacctgccttttccatccctagcytctcacctggtcaaatcttccttggctcctccttccacctggaatcaaacccatactccctcccttgacctctgaggcttggggaacagggctcccaccttcccttccctgccgctggcctctctccatccactgcagtcacactggccttcctgctggtctggcctcagcaccttggttcttgctgttcctcctgcccaggatgctttctctcttctttcagtgctctgcccagacttggcttccccagagccgccttctctgtccaccctcactagaacagccttcttgccatcttgg

SEQ ID NO: 112188 - DNA, 601 bp, Human
tcctcctctttctactcatccttcatccttctttcattccacattttcatccatccctcttgctgccattcctctcatctatctatctactattcattcacccactttctatccatccttccatccaaccatccattcatccatccgttcttctgtctatctttccatccttccatctatccaccctacatccatccatccttccttccttccatccatctatatttccaaccttccattcatccatccgtatttccatatttccatccatccatccatccatccatccatccatccatccaaccatccatccatccttccatccattcatctgtccatccttccatgcatccttacatccatcctttcatctttttatcttcctactcagccacctgtctgttcgtccatccatctgtggatgacatgcagccatgtcagttgttgaactctttaaattcatcctcgctgggaggcaaactgccactgtcccaagctgcttgaatgcctttctcaatgcctccactgtcccagcccttctgccaaaccccacattccatcttctatttcagcaactaatagttgatcagggccaagacaa

SEQ ID NO: 112189 - DNA, 601 bp, Human; identical to SEQ ID NO: 39137

SEQ ID NO: 112190 - DNA, 601 bp, Human; identical to SEQ ID NO: 39138

SEQ ID NO: 112191 - DNA, 601 bp, Human; identical to SEQ ID NO: 39139

SEQ ID NO: 112192 - DNA, 601 bp, Human; identical to SEQ ID NO: 39140

SEQ ID NO: 112193 - DNA, 601 bp, Human; identical to SEQ ID NO: 39141

SEQ ID NO: 112194 - DNA, 601 bp, Human; identical to SEQ ID NO: 39142

SEQ ID NO: 112195 - DNA, 601 bp, Human; identical to SEQ ID NO: 39143

SEQ ID NO: 112196 - DNA, 601 bp, Human; identical to SEQ ID NO: 39144

SEQ ID NO: 112197 - DNA, 601 bp, Human; identical to SEQ ID NO: 39145

SEQ ID NO: 112198 - DNA, 601 bp, Human; identical to SEQ ID NO: 39146

SEQ ID NO: 112199 - DNA, 601 bp, Human; identical to SEQ ID NO: 39147

SEQ ID NO: 112200 - DNA, 601 bp, Human; identical to SEQ ID NO: 39148

SEQ ID NO: 112201 - DNA, 601 bp, Human; identical to SEQ ID NO: 39149

SEQ ID NO: 112202 - DNA, 601 bp, Human; identical to SEQ ID NO: 39150

SEQ ID NO: 112203 - DNA, 601 bp, Human; identical to SEQ ID NO: 39151

SEQ ID NO: 112204 - DNA, 601 bp, Human; identical to SEQ ID NO: 39152

SEQ ID NO: 112205 - DNA, 601 bp, Human; identical to SEQ ID NO: 39153

SEQ ID NO: 112206 - DNA, 601 bp, Human; identical to SEQ ID NO: 39154

SEQ ID NO: 112207 - DNA, 601 bp, Human; identical to SEQ ID NO: 39155

SEQ ID NO: 112208 - DNA, 601 bp, Human; identical to SEQ ID NO: 39156

SEQ ID NO: 112209 - DNA, 601 bp, Human; identical to SEQ ID NO: 39157

SEQ ID NO: 112210 - DNA, 601 bp, Human; identical to SEQ ID NO: 39158

SEQ ID NO: 112211 - DNA, 601 bp, Human; identical to SEQ ID NO: 39159

SEQ ID NO: 112212 - DNA, 601 bp, Human; identical to SEQ ID NO: 39160

SEQ ID NO: 112213 - DNA, 601 bp, Human; identical to SEQ ID NO: 39161

SEQ ID NO: 112214 - DNA, 601 bp, Human; identical to SEQ ID NO: 39162

SEQ ID NO: 112215 - DNA, 601 bp, Human; identical to SEQ ID NO: 39163

SEQ ID NO: 112216 - DNA, 601 bp, Human; identical to SEQ ID NO: 39164

SEQ ID NO: 112217 - DNA, 601 bp, Human; identical to SEQ ID NO: 39165

SEQ ID NO: 112218 - DNA, 601 bp, Human; identical to SEQ ID NO: 39136

SEQ ID NO: 112219 - DNA, 601 bp, Human; identical to SEQ ID NO: 112178

SEQ ID NO: 112220 - DNA, 601 bp, Human; identical to SEQ ID NO: 112179

SEQ ID NO: 112221 - DNA, 601 bp, Human; identical to SEQ ID NO: 112180

SEQ ID NO: 112222 - DNA, 601 bp, Human; identical to SEQ ID NO: 112181

SEQ ID NO: 112223 - DNA, 601 bp, Human; identical to SEQ ID NO: 112182

SEQ ID NO: 112224 - DNA, 601 bp, Human; identical to SEQ ID NO: 112183

SEQ ID NO: 112225 - DNA, 601 bp, Human; identical to SEQ ID NO: 112184

SEQ ID NO: 112226 - DNA, 601 bp, Human; identical to SEQ ID NO: 112185

SEQ ID NO: 112227 - DNA, 601 bp, Human; identical to SEQ ID NO: 112186

SEQ ID NO: 112228 - DNA, 601 bp, Human; identical to SEQ ID NO: 112187

SEQ ID NO: 112229 - DNA, 601 bp, Human; identical to SEQ ID NO: 112188

SEQ ID NO: 112230 - DNA, 601 bp, Human; identical to SEQ ID NO: 39137

SEQ ID NO: 112231 - DNA, 601 bp, Human; identical to SEQ ID NO: 39138

SEQ ID NO: 112232 - DNA, 601 bp, Human; identical to SEQ ID NO: 39139

SEQ ID NO: 112233 - DNA, 601 bp, Human; identical to SEQ ID NO: 39140

SEQ ID NO: 112234 - DNA, 601 bp, Human; identical to SEQ ID NO: 39141

SEQ ID NO: 112235 - DNA, 601 bp, Human; identical to SEQ ID NO: 39142

SEQ ID NO: 112236 - DNA, 601 bp, Human; identical to SEQ ID NO: 39143

SEQ ID NO: 112237 - DNA, 601 bp, Human; identical to SEQ ID NO: 39144

SEQ ID NO: 112238 - DNA, 601 bp, Human; identical to SEQ ID NO: 39145

SEQ ID NO: 112239 - DNA, 601 bp, Human; identical to SEQ ID NO: 39146

SEQ ID NO: 112240 - DNA, 601 bp, Human; identical to SEQ ID NO: 39147

SEQ ID NO: 112241 - DNA, 601 bp, Human; identical to SEQ ID NO: 39148

SEQ ID NO: 112242 - DNA, 601 bp, Human; identical to SEQ ID NO: 39149

SEQ ID NO: 112243 - DNA, 601 bp, Human; identical to SEQ ID NO: 39150

SEQ ID NO: 112244 - DNA, 601 bp, Human; identical to SEQ ID NO: 39151

SEQ ID NO: 112245 - DNA, 601 bp, Human; identical to SEQ ID NO: 39152

SEQ ID NO: 112246 - DNA, 601 bp, Human; identical to SEQ ID NO: 39153

SEQ ID NO: 112247 - DNA, 601 bp, Human; identical to SEQ ID NO: 39154

SEQ ID NO: 112248 - DNA, 601 bp, Human; identical to SEQ ID NO: 39155

SEQ ID NO: 112249 - DNA, 601 bp, Human; identical to SEQ ID NO: 39156

SEQ ID NO: 112250 - DNA, 601 bp, Human; identical to SEQ ID NO: 39157

SEQ ID NO: 112251 - DNA, 601 bp, Human; identical to SEQ ID NO: 39158

SEQ ID NO: 112252 - DNA, 601 bp, Human; identical to SEQ ID NO: 39159

SEQ ID NO: 112253 - DNA, 601 bp, Human; identical to SEQ ID NO: 39160

SEQ ID NO: 112254 - DNA, 601 bp, Human; identical to SEQ ID NO: 39161

SEQ ID NO: 112255 - DNA, 601 bp, Human; identical to SEQ ID NO: 39162

SEQ ID NO: 112256 - DNA, 601 bp, Human; identical to SEQ ID NO: 39163

SEQ ID NO: 112257 - DNA, 601 bp, Human; identical to SEQ ID NO: 39164

SEQ ID NO: 112258 - DNA, 601 bp, Human; identical to SEQ ID NO: 39165

SEQ ID NO: 112259 - DNA, 601 bp, Human
aaatgatcacagtttggacaagtttaaatccagtatgtgatttcttttggatatgattatttgatctcatacagtgatttcatacaagattgtacttgtcccagtgtttgataatgtaacattcacacagaggtaattacagagctcttacagcttattgattgtttaaaagcctgagatcatttagctttagataatactattcttgttattccattgtggtattttgtcataatcagaagcaaaacaatgtctaaaacattttttattcatactcctgtagtttctatcaagtctattyttttttcttttcaaaactcaaaaatcattgtagacaaaagtagatatggagctggcaattttcattatcttaggacagttttactaatgaaaatattatacagatatattttagatttattttaccaaagccaagtatgtgagcagtaaagtgatctgtatttacccataagttttagaaagacatccaattgaaaggtatatatgttgagcttatatgcttcctagggaagtttttgctactttaaattaaattatctcaataacaaagcacttcaagttctccaaaactttagatttg

SEQ ID NO: 112260 - DNA, 601 bp, Human
gtgatttcatacaagattgtacttgtcccagtgtttgataatgtaacattcacacagaggtaattacagagctcttacagcttattgattgtttaaaagcctgagatcatttagctttagataatactattcttgttattccattgtggtattttgtcataatcagaagcaaaacaatgtctaaaacattttttattcatactcctgtagtttctatcaagtctattcttttttcttttcaaaactcaaaaatcattgtagacaaaagtagatatggagctggcaattttcattatcttargacagttttactaatgaaaatattatacagatatattttagatttattttaccaaagccaagtatgtgagcagtaaagtgatctgtatttacccataagttttagaaagacatccaattgaaaggtatatatgttgagcttatatgcttcctagggaagtttttgctactttaaattaaattatctcaataacaaagcacttcaagttctccaaaactttagatttgtgtgtttgtgttttttgcttggctttttggttcaaagtatctaaaaaacaacacctgtactgttagttgtatg

SEQ ID NO: 112261 - DNA, 601 bp, Human
gagcagtaaagtgatctgtatttacccataagttttagaaagacatccaattgaaaggtatatatgttgagcttatatgcttcctagggaagtttttgctactttaaattaaattatctcaataacaaagcacttcaagttctccaaaactttagatttgtgtgtttgtgttttttgcttggctttttggttcaaagtatctaaaaaacaacacctgtactgttagttgtatggtagttgaagaaatcacccaacctcttagcttcagcttttcagggttatcatgaagattagaaaaaargcgcaataaaaatgaccatgttcagtgcctggaaaataatacctagttgttatttccctcttatattggcccttcagaagactctaggatctcaattttagattctgttaattcttacgttattaggtgaatgtagtatataaatattatgttcagtttcatttatgcaacaggtactttaattctttgtagtttaccttctgccactcataatctttatggccactgttttattggcttaactaataactacatgttgaagataattttgcttagaattttagcagatggattaaagaa

SEQ ID NO: 112262 - DNA, 601 bp, Human
ttgatcaccattatgtcctttgctatctagtataggcctgacacagtagaccctcaatcgatacatattgaataataggcctaattctttacatattaatgtggtacaaaagaatcttacctaccttatatctgttgtctagattctctaaagaatgtttggcagagaaattgccctgttttgcgtatgtggtgtttaagacccaaaagaactaaatgacctgtccaaaatcatagacatgcagagctagcattggaaattggggcaggcattactgagtctcagttggcattcatttcartatcctacagtttaatactgcataagctcttgttattttggtgactttttttttcttttttaaatactcatgacaaatgtttttatatccattgaatataaaatagaaaagatttaggctgcagagttctagtgtatggatgtatctcttcctagtagaaaaatgttcaaaaaattaagaataagaaagtttcttatacatggaatcttagttttttgtatttcctctgccatcccctgtccatatcttccaaaagtatgatataaatttttaaatgtaatatgggttgtactttccagt

SEQ ID NO: 112263 - DNA, 601 bp, Human
agaatcttacctaccttatatctgttgtctagattctctaaagaatgtttggcagagaaattgccctgttttgcgtatgtggtgtttaagacccaaaagaactaaatgacctgtccaaaatcatagacatgcagagctagcattggaaattggggcaggcattactgagtctcagttggcattcatttcaatatcctacagtttaatactgcataagctcttgttattttggtgactttttttttcttttttaaatactcatgacaaatgtttttatatccattgaatataaaatagaaargatttaggctgcagagttctagtgtatggatgtatctcttcctagtagaaaaatgttcaaaaaattaagaataagaaagtttcttatacatggaatcttagttttttgtatttcctctgccatcccctgtccatatcttccaaaagtatgatataaatttttaaatgtaatatgggttgtactttccagtaactcgtaacttgtggctgttaaatttaactttaaattaacattgtgttaaaaattcagttcttcagttacttgagtcacattttaagtacttaataaccacatttggct

SEQ ID NO: 112264 - DNA, 601 bp, Human
tttggtcttcagtctcaggagtaggtgggtttttttagaaggtcctggagtaacagtctcattttgcaaggctgtagtttgtcttcaagataatacctggtagggcagaatctttttgaaaccaggtctcggtatcccaatttttttcttttggaccagtgattccaaaatttctaaaagaaccacctggggaaaaatggctgtttcccatttcccaaagaatatgtgcagtgttttgtttttataaacaggcaaagtatgttttattcaacctcttagagcaagtttgaccaccttacarcctgcgggccacatgtggcccaggacagctttgaatgtggcccaacacaaatttgtaaactttcttaaaacattatgaaattttttttgcaattaaaaaaaaaactcattagctattattaatgttagtgtattttatgtgtggcctaagccaattcttccagtatggccaagggaagtcaaaagattggatactcctgtcttagagtatttgtggtttttagagttttcctggtgattcttagagaggctggtttgagaattggtgacctagaccatgttgagtctttgattaccatat

SEQ ID NO: 112265 - DNA, 601 bp, Human
agcagtctgtaataaccctttagatataagaacaggacctgaatttcaatcattataacatcttcatctagcataaatgctaaggaaattaacaatgttttaaatctcaatacaaaaaaagagtcagtgaactatacaattttggaaaatttcagtctcaagccttcctagaatattagattttaagagtctgaggattaacctttttgaaaaccaacactttaaaattttattcaaagagtttcattgtactttgcttatttcaaatgtttattgtttcatgaggaagagaaagtaataaaagtttgagaaatagggaaggtaacttaaatatctcaaacccttaacctttttgcatttctgtgcatttttaaactaaaattttatgtcctactttctctatctagcattaagtaacattagtaaataatcagtttccaatgctgcctatagaatattcatatagttataatactttaaagtatatgtaccataacttgccatttcatgctctttgtatactttttagtccatttacatttattgtgatttggttgtaattaggcctgacattgtgttgttttctattacctgttttttg

SEQ ID NO: 112266 - DNA, 601 bp, Human
ttttggaaaatttcagtctcaagccttcctagaatattagattttaagagtctgaggattaacctttttgaaaaccaacactttaaaattttattcaaagagtttcattgtactttgcttatttcaaatgtttattgtttcatgaggaagagaaagtaatataagtttgagaaatagggaaggtaacttaaatatctcaaacccttaacctttttgcatttctgtgcatttttaaactaaaattttatgtcctactttctctatctagcattaagtaacattagtaaataatcagtttccwatgctgcctatagaatattcatatagttataatactttaaagtatatgtaccataacttgccatttcatgctctttgtatactttttagtccatttacatttattgtgatttggttgtaattaggcctgacattgtgttgttttctattacctgttttttgtttctcgaattattctttcctgccattttttgtgctaagattttttagcatttaatttaattcttctgttgaatttctagttatatatctttgcattattttttagtggttactttgaatatcattgaatttcttcagc

SEQ ID NO: 112267 - DNA, 601 bp, Human
tttatattcattcttttttgtttatcagattgcttcccttccttgggcacttcttgtaatggaggtcagttggcaacaagttctcttagtttttttttatctaaacatgtctttattttactggagttttgaaggatagttttgctggatatagaattcttagttgacagctttcttctttcagccttttcagtatgccatttcaatgtcttctggcctttggtgtttctggtaggaagtcagccaactgtgtaagatgttatttttctcattgctttccagattttctctttacctttgrctttcagcagtttgtgcttcaagagtttctctatttgtgtatcctttgtcagtttgttaagtttcttgaatctgtacgttgatgtttttcactcttccttcttctgccatttccattctgctattaagtccacctagggaatttttcatttcaaaatttttttcatgaatttctgtaaaaatttattccaggtctagaatttctaacttttaaaatatagttttcatttctctattagattccatctctgttactcattgatatatttacctttgcttttgtttaacatatttattgcag

SEQ ID NO: 112268 - DNA, 601 bp, Human
atattttcacccaaaaactttagacagctgttcatggcagcattattcataatagccaaaaagtagaaccagcccaaatgtccaactgatgaattaaaaaaaagtggcatatccatactatggaatattatctggcaataaaaaggagtgaagtactgatacatgttataacatgaatgaaccctgaaaacatgctaagtgaaagaagccacacataaagcccacatcttgtgtgagtccatttatatgaaatgtcagaataggcaaattcatagagacagaaaatggttggtgattggcrggggctgaaggaagggggaattgaggtatttcttttcggggtgataaaaatattccacagttgattgtagtgatgctgggaataagagtacaactttgtagatatacgaaaaatcattaacttgtacactttaaactagtgagttttgtgatttgtgagttatatctcaatatagcttaataaagtttaaaaacaattgcaaatttggggtaattttaaatttttatggggttggttagttccattttccataagcctgggggcatcctttttatagtacagtaaaataatcattggttg

SEQ ID NO: 112269 - DNA, 601 bp, Human
ccctgcatgcctgccctgcatgccaggcagcacgctttggagtcgctgtgattggccggtgtgcccctgccgaagcctcggctgcttctgtccacgtcttacacttcttcatttatccatggatcatttcgagagtccgtcttgtaaatgtttagcattttgctgctttattgcttctttctggggacagttccagcacttgctgggtggagaaaggcagctgagtccggagaagagcaaaatatggggacccaggttaaaagcagacatcgtccttcctacccagtatttctatattcakacagtggatacatcagggaatagcttcacatcttctccaggcgaaaaagtcttccaggtgaaagtcccagcaccagaggagcaattcactagagttggagtccaggttttagactaaaaggatgggtccttcatggtaagatacagaatgtgtgcaggctacaaaaatctgaagatgggagttaaattccaaggtcaagatgtggccaaatccccatgtattttaaaagagccagtgtgccatgagaattgtgactggcctttgcaagatagtgcagcctggctacgggggatgaactgc

SEQ ID NO: 112270 - DNA, 601 bp, Human
aggtcaagatgtggccaaatccccatgtattttaaaagagccagtgtgccatgagaattgtgactggcctttgcaagatagtgcagcctggctacgggggatgaactgcccaactggaaaccattgctcagattcagagagatctggcacatttccctactgtggatccagaaaagattgcagtagaaatcccaaaaagacttggacagaggcagagcctgtgtcactacaccttaaaagataacaaagtttatatcaagtctcatggtgaacatgtaggttttagaattttcatggatgycatactactttctttgactagaaaggtgaagatgccagatgtagagttctttgttaatttggcagactggcctttgctttggaaaaaaagaaatccaattcaaacatccatccgaccttttcctggtgtggctccacagattccaaggatatcgtgatgcctacctacgacttgactgactgttttagaaaccatgggctgggtaagtctggatatgatgtctgtgcaagctaacacgggtcctccctgggaaagcaaaaactccacagctgtcttgagagggcaagacagccgcaaagg

SEQ ID NO: 112271 - DNA, 601 bp, Human
tttccactttacctgcatcaagtatttgggtgtgggagggatagagacagagaaccagattgagcttttcatttttcaccattgtctttatatgttttagacaccagaggatccaaatcactgtgacccttggaggctggtatcttgtatcaatatgattatgactatgctgagcattcatcactgttgactgaagttttatgcttctgttagcctggattgagctatattgggatatacagtgtggatatgttcagcagagttagtcagataatgttgagagattctttttggcttctcrtgaactgggtactccatgcttcatttctctctgccacaactggggaatgaaagtgggaagagaaatgggctgggatgctgtgtatttgtaggggatcagcaaatcatcaaagaatttctccttttcctcagaccttagaatctaggctgtgagcctcaaaaggaatggggcatgaagccactggcaacattaacttcatgcttttcccccatttgaatcagatttttggaaggtagagattttgcaagattgtgaccaaaaagccatttcatttttcaataataccatttgtagtttaca

SEQ ID NO: 112272 - DNA, 601 bp, Human
cccaaaaactattgaaataatttttttttaattccaacttctgtaaagcttttacttgataagaatacctgtgaagtattgtttcccaacaaattaaatctgaatcacattatgccaatatctccaggaaacattttatagaatatccagaggagagaggaactttttaaatgacagcatagggtgatgacagaaaattccagactgggaatctctatggagcaaggaacccttcttattcaaggctcgaaaaaagatggagaggagagttaatggtttaaaacaaacttgggattcaatrtgtaggtatgagttttgtttgccattttagctataaactataaactatacttcttggtggtaccaagaatccctgagttggatttcctacagctcaactgctaagatttgattttgactgcctaccttgtaagggctacttagagaggacggtaatagagctagaattatccagaggactggtgtcttaaaaggaaatggaaaaatgctgtgggaagagtgatgtctggtgaacccatctgaactttttgtagactgaaagttgactattaagggaattaatgaggaaataaattttctt

SEQ ID NO: 112273 - DNA, 601 bp, Human
ggtatgagttttgtttgccattttagctataaactataaactatacttcttggtggtaccaagaatccctgagttggatttcctacagctcaactgctaagatttgattttgactgcctaccttgtaagggctacttagagaggacggtaatagagctagaattatccagaggactggtgtcttaaaaggaaatggaaaaatgctgtgggaagagtgatgtctggtgaacccatctgaactttttgtagactgaaagttgactattaagggaattaatgaggaaataaattttcttaaaayactattcaaaggttggggaacattatgtttattgtttagtaattttaattcaaagagccccattttaaacttgatgcatagtttttaaaaattaatgttaactagtttcagctttctacatgtggctatccagttttcccagcaccatttattaaatagggaatcctttccccattgcttgtttttctcaggtttctcaaagatcagatacttgtagatatgcagcattatttctgagggctctgttctgttccattgatctatatctctgttttggtaccagtaccatgctgttttggt

SEQ ID NO: 112274 - DNA, 601 bp, Human
tatccattgtgtaactattagttcctaccattatcaagcaaggagttctaagttagaattcagctccatagttcctttttttaatagctagtttctttgaaattataacttttcagatcaatgaaatgtttgaagcagctgtaaaacacagttgtattatgaggtttattaaatttaacataactttatgttttcagttcagtaaaacactatttgtattctacaaatagctcagatacgaatctggcaagtaatagaattttcagcatgggttttttctttactcattggtgacctttcrgttttgccagtttatgcagtttattattaatacttcagcttggttccaaaattgtttgctgcagaattagggttatatgtctttgcctcttgtatcttaaaatttaattgaattattctggtgatcattcacaataagataacacctaatcctggttggaagattccatgtttgtcacctcacctttccctatttgataaaataatggcaataaaatagagaaaatttgccaaacattaagaggcaaactccttatttttatttgtaaaccaggatactggaatgtatttcattattgtc

SEQ ID NO: 112275 - DNA, 601 bp, Human
gtctatttctagactctgtgccattccattcatcttggcaaaagcccttgtgactcttaacaccattcatgaagttctgcacattaggtaatagcaatactactaggatctgtttcttgttttacacacttctgactccaaatgtgtgggttttccccacacaaaccaattccccaactttctggacactaattgggtatccaacaatttgattaaaatttgacactaatttcccagagttgttgcagaccctataggttaagagctgcatctcacaagactactcccacttcaaatgccrgttgcaattccaggcctcctgtacctctgaccaactggctatatattgggggtttccacagccccttcctcaggtttgataatttgctaaaatggctcctagaacttaagaaaacagcttactatcatcagtttataataaaggctacaacacagaaagagccaaataaaagagttgagtaaaggatggtatgggagaagggatgcagagcttccatgacctctccaagtgccatcctcctggcacctctgtgttcaccagcctgagttctctaaacccctttgtttatagttttccatt

SEQ ID NO: 112276 - DNA, 601 bp, Human
ttacctcaatatatgatgaaataatactgaaaaagtgcttcagaaagtaaaaatctttaaagtataaggaatggtaattaccattagttgtgcattacacgttactctgaataataaattgcttgtttcaaggtcacttttaaaatattttattatggaagttttcaattttatggaaaagtagggaggattttcaaattagctcaataattattacccagcttcaaaaaagttagcaaaaatattagtacatggttaatcttgtttcatctatacccaagtcactctgctctatgggttmtttttaagcaaatcttagataccatgtgttttcttctttttaggataatcatatttgagacagagatttaaatataattataattcattaacattcaaattattttccctcacagaagagtggtattacctgaagtctgatttttagccacattcaagtataaaatatttggagtataggaaaacatcactgccatttggaactctttcagtacagtgttttcatatttacttaaggacatcttaaccaaataggctaggaaatagtttgctagtataccattttccacaactctttaca

SEQ ID NO: 112277 - DNA, 601 bp, Human
aaatgtttgaacatgtacacagagaaagcaatataatatacctagtatctacattacccagctttatcagttatcaatgcatggttaattttgtttcatgtgtaactcttcctatcccagattatttagagcaaaaccctagactttatatcatatcttttcgctggaaatatttccacatttagctctagaagataaaaggttagaaaaaaataaccacaatactatcttaacataagaaacagccttcctaatagaagtacatgatggcacttacacagtattcttgccaaaacttgtrcctcattttgattaactgtctagatagaaccagtttactagaattatagaaatgagaagaggttaagcaatacaatgatgatgaagtcagaaaaatccagagtatgagatctccatgggagaaatgatagaaaaataataaaaggaaaaggaaatgtgaacctgttgattgaaaaagactgaagagacgcataaaccaaatataatgtgtaacctttttttttttttttttggatcctgatttgaacagactatttttaaaagataagaaaggacaatttagggaatttgaatgctgact

SEQ ID NO: 112278 - DNA, 601 bp, Human
aaattgttactttttaaaaaaactagtttttcagtctttagctgatttctattttagttctaagaacatcattatgatatagtttacctgtaagaaaatggttttaacacgatgagttctgtaaaattctgaaaaggaattttaaaattttaattttaaaaaaggaacaaaagcattgttccttttaaagatttgaaagtctgagaacagggaacatataaagtatgagaactttggacacaaacattctaacatcaggtttttactttaaatgtataaattctattgaaattattttttwaaaataattttggctttggaactacctaccaatgaaaattgaaaaacatggtcttcaacattttttaaagtgggcttccttcataaatacttcactaaatgggaagatatgtgtttctgtagtcagctcttagtttttctagcaagttgattatgtttttaatgatttttatgaacattttgtttgaaatgttttatatattcattagactatggatatgggtcatcctagaaccagaaaataaagcctagttactactaaggattcaatttgaaacctttctctttaaaaccttctata

SEQ ID NO: 112279 - DNA, 601 bp, Human
atttttgggcatgttggtgcatgcctgcaatcccatcactttgggaggctgaggcgggaggatcacttgagcctaggagttggagaccagcagtttgagaccaggctaggcaacatagtgagatcttgtctttaccaaaaatttacaaaatagccaagtatgatggtgcatacctgtggtcgggagactgaggctggaggactgctagagccaaggagtgtctaggctatagtgagccatgattgtaccactacatgctagcctgggcaacagcgagaccctgtctcaaaaaaaaaaaaaagttatcccagtttggctttttaatttttattagaattatacgtgagtattgtgtaaagaggaaaagctagtctgcaaggtttgtcatgaaaatcaatagttgcctgctcctcatatccctctttctctcacaactacaggtaaccatgttatttacttcataaatagcatgcttgtcttgctgcagagtagtcccctgttatccacaggggttgtgttccaggaccctcggtggatagctggaactgcagagagtactgaatttgattgtcatgagtcagaacacctttttgttgttgtt

SEQ ID NO: 112280 - DNA, 601 bp, Human
tgtatatttgtatttccttttccctttaaattttttgtaaggcaatagccacctgattgtcaactcaattttaaaccttcatatttaaatagcaaaactaaatacgtttttttggtcagcaaattttggcttaagatgcacagaaaacattgttaaagatttgaagaaataacacagtgggaatgtttgaaattcgtgcaataagcttcagatgactgcattttgctaaatagatttcaattatgtaatccatgaagaactcatttccgatcacttagtaaagaagtatgttccagagaaracatattttcagtagctaattactccactgataaacatattgttatttggacactgaaaacataacctttgactgaatagctactttgattggaatttgcaaaggatttagggatgagagtgatagatgtgaagtttcagtcattcaagggaaagttattgcagtaacaaaattgaaaatgtaagtatacagagtacagcaagttgttattgttaactttataaaaataaaaccttttaattattataggattgtaacaaatttctgtgagtgaccctgacagtattttgcaccattaag

SEQ ID NO: 112281 - DNA, 601 bp, Human
tttattcacaatagccaaaagataaaaacaaaagcgtctcccaacagatgaatggataaacaaatgtgtgtgtgtgtgtgtgtgtttgtgtgtgtgtatgaaatggaatattattcagccataaaaaggaatgaagttctacaacatggattaaccttgaagacattatgtcaagaatatatactgttgtttcactcatgcaatatctagaataggcagattcatagagacggaagtacatattaccaagggttggagggagaaggggatgggtgattattaagggttatagaatttctgyttggggtgatgaaaaatgtttagaaatagatagtagtgttgcttatataacattgtgaatataattaatactattgaattgtacacttaaaaatggttaaaatgacaattttttttatttatcttttgctacaataaaatactaaaacttgtgtgtgcacacaatcttggaaatagaattttctaatgtgtttaaaaatcttagattgagtgaattttgggggatactttggccctctgtgtctgcaggttccacatctaaagattcaaccaaccatggcttgaaattatttgaaaaaat

SEQ ID NO: 112282 - DNA, 601 bp, Human
atcattagacattttcatatttatgaaagtatgctttgtacagagtcatattgatagaagcctaaagtttgtcataacgttttctatcttcagcagacctaataaattttttaaaaacattttttaatttaaaaatatttatagattcacaagaagttgcaaaaaatagtagagaggtcctctgtacccttcatccagtttcccccaatgataacatcttgccttatcctaaggtactatatccaagccaggaaattgacattagaacaatccacagacctttttcagatttcagcagtttacaaagacttgtatgtggttgtgtagttgtgtgccacttatgtgttcatttgtgtaaccaccattgcaataaagatacagaactgttctgtcactacagaggtctccctatgtgttccccctttctacttcccactatgtactttgtctccaatcattactgtataattttgacatgtcaagaatggtatgtaaataataatatagtgtgtaacttttaaagcatttttgaaagtgaagattaaagcctaagtaaggtataattactacttttgccaactttataaaaactatggctggg

SEQ ID NO: 112283 - DNA, 601 bp, Human
ccactatctttaggatccattgatgtttctgcctgaatgtattgttattgttgtggttgccaaatgatgattctcctattccatcatttcttcctcatttattagttggcattttattgtaaggaagagctctttatttctgtcagtgtggactcattgattcctattttattgatattcagtgggatatgtattagactgttcttgtgttgctttgaaggaatacctgagactgggtagtttctaaagaaaagaggtttaatctgctgatgattctgcagaccacacaagcatggtcctracatcactcagcttctagagaagcctcagggagcttttacttatggcagaaggcaaagcaggaacaggcacatcacatgatgaaagcaagagtgagagagtcatagagaggagacagagatgccacacacttttaaatcacccggtctcatgagaactatcacaaagacaagcaccaaaccttgagggactgacccccatgatccaaacacctcccactaagctccacctccagcactggggattaattacagttcaccgtgagatttgggtaggggctgatatccgaactattccagga

SEQ ID NO: 112284 - DNA, 601 bp, Human
gggactgacccccatgatccaaacacctcccactaagctccacctccagcactggggattaattacagttcaccgtgagatttgggtaggggctgatatccgaactattccaggatataatttgttactttcatttgttttgatgttccaattgtcctatatttcgccagcagaatcctccttaggctcatttgtttccatttatcatgtcccaatcgttcctttttttttttttttttttttttttttttttttttttttgcgactgagtctttttctgccacccaggctggagtacagkggcgcaatctcggcccactgaaagctccgcctcccgggttcacaccattctcctgcctcagcctcccgagtagctgggactacaggcacctgccaccatgcccagctaattttttagtatttttagtagagatggggtttcatcgtgttagccaggatggtctcgatctcctgacctcgtgatccacccacctcggcctcccaaagtgctgggattacaggtgtgagccaccacgcccagcccattcttttgggttattttctaatacaagaagatgttccaggctcagttttattgttt

SEQ ID NO: 112285 - DNA, 601 bp, Human; identical to SEQ ID NO: 29875

SEQ ID NO: 112286 - DNA, 601 bp, Human
tatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaayttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaat

SEQ ID NO: 112287 - DNA, 601 bp, Human
gtagtgtagatatggaaaaaaatcatgaggatgatttaggaaatttccctggggtttctacttagtggagtcaccgtggctttactttagtgtcatttgcatttccagggtcctcacttgttgtcaacctatttcttcctcaagagaggtactatagtaatattataactcctcaaaccctgaatctcatcattagaaacatggaactggaaaaagctgttgatttaattgatatgcatatgttgaacctgaaaaggttctaattattgccatttttttccttttttttttttttgagackgagttgcccaggctggagtgcaatggcgcgatctcggctcactacagactctgtgtcccgggttcaagtgattctcctgcctcagcctcctgagtaggtgggattacaggcacgtgccaccatgcccagctaattttgtatttttagtagagatggggtttctccatgttgatcaggctggtctcaaactccttacctcaggtcatccacccgcctcggcctcccaaagtgctgggattataggcatgagccaccgcacccggcctattcccatctttttctttctggagttgtgtgcct

SEQ ID NO: 112288 - DNA, 601 bp, Human
gatagtattattatagtaaaaattaaataaataataacaggggtagtgtagtgtagatatggaaaaaaatcatgaggatgatttaggaaatttccctggggtttctacttagtggagtcaccgtggctttactttagtgtcatttgcatttccagggtcctcacttgttgtcaacctatttcttcctcaagagaggtactatagtaatattataactcctcaaaccctgaatctcatcattagaaacatggaactggaaaaagctgttgatttaattgatatgcatatgttgaacctgaaraggttctaattattgccatttttttccttttttttttttttgagacggagttgcccaggctggagtgcaatggcgcgatctcggctcactacagactctgtgtcccgggttcaagtgattctcctgcctcagcctcctgagtaggtgggattacaggcacgtgccaccatgcccagctaattttgtatttttagtagagatggggtttctccatgttgatcaggctggtctcaaactccttacctcaggtcatccacccgcctcggcctcccaaagtgctgggattataggcatgagcca

SEQ ID NO: 112289 - DNA, 601 bp, Human
ccaggctggagtgcagtggtgcgatctcggctcactgcaagctcagcctctggggttcacgccgttctcctgcctcagcctcccaactagctgggactacaggcgctcaccaccacgcccggctaattttttttttttttgtatttttagtaaagatggggtttcaccatgttagccaggatggtcttgatctcctgacctcgtgatccgcctgcctcggcctcccaaagtgctgggattacaggcgtgagccaccacacccggccatataaggtattattaatgaacaattacattactrtattatgatgatagtattattatagtaaaaattaaataaataataacaggggtagtgtagtgtagatatggaaaaaaatcatgaggatgatttaggaaatttccctggggtttctacttagtggagtcaccgtggctttactttagtgtcatttgcatttccagggtcctcacttgttgtcaacctatttcttcctcaagagaggtactatagtaatattataactcctcaaaccctgaatctcatcattagaaacatggaactggaaaaagctgttgatttaattgatatgcatatgtt

SEQ ID NO: 112290 - DNA, 601 bp, Human
gttttcaggcttagaaggatttttaagcaagtttatcaggcaggagtagatatagtaagttgccaaaatgtgtgatgctacagaaccccatatgggccacttcagggggacctggtgaaggaatctcacatttattctaggagtctgggttattgtagaagagtttttttttttaatcctccttaggttctgaatccctttatgaatctgatggaagctaaggatcctctctttggaaaaatgcctgtaagcactacatacatttttgtgcataattccagagggcttggaaaacctttgyaatccggtcgtggaccccatttaagaaccctcctcgagggtagcattttccaagtgcaggacacatatcactcatagtgtctgagatcagtttaacaatgcaaaaacaaatgttttatattctaatatttatattttatagttaccttctatttatggccaatgagactggctttccatttatggtaatgatataaatttgtcttttaaaagcatacttattaggccgggtgcgatggctcacgcctgtaatcccaaaacttagggaggccaaggcaggcggatcacttgagctcaggag

SEQ ID NO: 112291 - DNA, 601 bp, Human
tagttataatttcctgtggcaagaatgaaaaatgcaggttttcaggcttagaaggatttttaagcaagtttatcaggcaggagtagatatagtaagttgccaaaatgtgtgatgctacagaaccccatatgggccacttcagggggacctggtgaaggaatctcacatttattctaggagtctgggttattgtagaagagtttttttttttaatcctccttaggttctgaatccctttatgaatctgatggaagctaaggatcctctctttggaaaaatgcctgtaagcactacatacatktttgtgcataattccagagggcttggaaaacctttgcaatccggtcgtggaccccatttaagaaccctcctcgagggtagcattttccaagtgcaggacacatatcactcatagtgtctgagatcagtttaacaatgcaaaaacaaatgttttatattctaatatttatattttatagttaccttctatttatggccaatgagactggctttccatttatggtaatgatataaatttgtcttttaaaagcatacttattaggccgggtgcgatggctcacgcctgtaatcccaaaactta

SEQ ID NO: 112292 - DNA, 601 bp, Human
cattactctgttcggaggcatcaactccctttgtttaggtgttgctcggaggttccatctaccatgtgggactgtagagtcagaccaggattcacatcccagctctgtcactttctgtcactgactttaggcaagagacttcatctctttgaacctcattttcttcatctgtataataaagagacgaacagttcttaccttgtagaattgttatgagaagccaatgagataatgtgtctaaatgtctggtacatggtaaggtctcaatatacagtggcaatagctactatttattataccrtggctaggtctctagatgcattatttaatataatccctgccaccaacctataacgaagatgtgatctccatttaaaaatcaggaacctacgaggtgggtggatcacctgaagtctggagttcgagaccagcctggccaacatggtgaaaccctgtctctactaaaatacaaagattagccaggtgtagtggcaaacgcctgtaatcccagctactcgggaggctgaggcaggagaatcgcttgaacccaggagggtgaagttgcagtgagctgagatcgcactactgcactccagcctgg

SEQ ID NO: 112293 - DNA, 601 bp, Human
ggatggggtcttcaatcaactctgggacctgcaaggtcacctcacacttcctttcagataagggagggttagagctgctagggtggtcacaggactcatggttcaagaaagtactcaaggttccagaaagctagacaagtgattgctggactgggctgggaacagagtgatcctggggcagtagtgaggaacaggccacggtcctacttgtggatgaggtgaggagagctgcagaccccgtaaggaatccctcagcctgcctgtgagtaacaactctgaagggctttctgagggccctggraaagtctgatgaccggagctgaaaggtgattctgtccaaggaagatcacgatggccaagaaccaatgtagggtcaagtttcaggtgtctgttgcggaggaatcaaggctgaagtactctgaactatccatcctttcttccatccatccaacacatatttagggagctcctgccaggggccgacgatgcttagtgtctccagcgacattactctgttcggaggcatcaactccctttgtttaggtgttgctcggaggttccatctaccatgtgggactgtagagtcagaccaggattcaca

SEQ ID NO: 112294 - DNA, 601 bp, Human
ttaatgtcacatggcttagtagggacagatgcacacccaaggctgcctggcctcaaagtctgttcctttaatgtctattctgtgttgctctgccctctgactgagagctgagggggcctgttagtcctctctggttgtgtcttcatctgctgcccctgtggacaggagagtgttggtctactcaggcggtgcttgactattagccagaagggaggttttctttccctgagttgtctcagcctttctggcctcactctccctgcactgcagtacagtccttggctccaaagctcagctccamtgccagccccaggctggtgccagcccttctccatggggtggaagcttccggattcagacctaggccttgcaatctctcccacagggtgccttctttctggatggggtcttcaatcaactctgggacctgcaaggtcacctcacacttcctttcagataagggagggttagagctgctagggtggtcacaggactcatggttcaagaaagtactcaaggttccagaaagctagacaagtgattgctggactgggctgggaacagagtgatcctggggcagtagtgaggaacaggccacggt

SEQ ID NO: 112295 - DNA, 601 bp, Human
cagcgatgcttggttctcttagtctacttttttaaatttttttgaggtggagtctctctctgtcacccagactggagtgcagtggcgcgatctcagctcactgcaacctctgcctcccaggttcaagcaattctcctgcctcagcctcccaagtagctgggactacaggtgcacgctgccacgcccagctaattttttgtattttagtagagacggggtttcaccgtgttgcccaggctggtcccgaactcctgagctcaggcaatctgcccgccttggcctcccaaagtgctaggattayaggcgtaagccaccgtgcctggcctattctactttatttttatccattgcccttatcagagataaatatttttgcttgtttttatctttattctcctgctataagttccataaaaaggaaactttgcctattttgttctcttgtgcatctccagcacctggaacagggcctgacacctagctctcgctcagaaatctccccagagtcataaatgaagggctaaatgaactctgaaagagttttggagagtcagattttctcccagtcaatgaatcaggatcttgatgccagaaatcagat

SEQ ID NO: 112296 - DNA, 601 bp, Human
aaaactctttaaaacaagacccctcacccagcgatgcttggttctcttagtctacttttttaaatttttttgaggtggagtctctctctgtcacccagactggagtgcagtggcgcgatctcagctcactgcaacctctgcctcccaggttcaagcaattctcctgcctcagcctcccaagtagctgggactacaggtgcacgctgccacgcccagctaattttttgtattttagtagagacggggtttcaccgtgttgcccaggctggtcccgaactcctgagctcaggcaatctgcccrccttggcctcccaaagtgctaggattacaggcgtaagccaccgtgcctggcctattctactttatttttatccattgcccttatcagagataaatatttttgcttgtttttatctttattctcctgctataagttccataaaaaggaaactttgcctattttgttctcttgtgcatctccagcacctggaacagggcctgacacctagctctcgctcagaaatctccccagagtcataaatgaagggctaaatgaactctgaaagagttttggagagtcagattttctcccagtcaatga

SEQ ID NO: 112297 - DNA, 601 bp, Human
ccggtaatcccacctactgaggaggctgagacaggaggattgcttgaacccaggaggcggaggttgtggtgagccaagatcatgccattgcactccagcctgggcaacaagaacgaaactctgtctcaaaaaaagaaaaaagagaaaaaaaggactaagtgactaaaagacagggtaggaactcaaggctcatcctctacatggccaaagcacttaggcaggaaaattaagtaagtaatagagcttctctggggcaggtgccaaaggaagtccatctctgtacctagcacctagctccggkcctggcccatagtaaacgctcagagaatattgctagctgaataagcattacttccatctacacgtactccgccctcagtggtgatctcatccagtcccattgctttaaatgtcacctataagctgatgactctccaaattatagctcaaggctggccctcttcccagaactcatatatccaactgcatatttgacatctccacttggaatatctaataggcatctcaaacttaacatggccaaagcagaacttcttgtttcctctgccagacttccccatctcaatctattcttctcatt

SEQ ID NO: 112298 - DNA, 601 bp, Human
gtttttgtatttttagtagagacggggtttcaccgtgttagtcaggatggtctcaatctaaaacaggagaatcatttattgagtgcactcaggcccagctgactcaacgtccaaaagactgggcccggaagaaagacagcacttgacttctatacacacttcacaaaagggggtgggctagcttgaagcaagcttacagtggcatgaaagcagggatatagaggcaggacaaactcaggattgcacgtgaccgttgccaagcaacccagatgtccgttatctaggtttgcccaggcacagrcttatcccataaccttcactatggcgcccaggtggccgtaactcaggccagctcagaggctcatgaccttcactccactgcttagataaaacaatacttgaagtcactggttacagagaataggaatctataaactcattccataaaacaaaggaaaatttgtttttcttctccctatgttgagggagtactgggagaatctccagagcacattagataatattatgaagaattttcctgggtctggcctgtgcctattgctgcctctgggacaagtcaccctcatacagaaaaacttat

SEQ ID NO: 112299 - DNA, 601 bp, Human
tttactgggttcacaccattctcctgcctcagcctcccgagtagctgggactacaggcgcccaccaccacacccggctaattttgtttttgtatttttagtagagacggggtttcaccgtgttagtcaggatggtctcaatctaaaacaggagaatcatttattgagtgcactcaggcccagctgactcaacgtccaaaagactgggcccggaagaaagacagcacttgacttctatacacacttcacaaaagggggtgggctagcttgaagcaagcttacagtggcatgaaagcagggayatagaggcaggacaaactcaggattgcacgtgaccgttgccaagcaacccagatgtccgttatctaggtttgcccaggcacagacttatcccataaccttcactatggcgcccaggtggccgtaactcaggccagctcagaggctcatgaccttcactccactgcttagataaaacaatacttgaagtcactggttacagagaataggaatctataaactcattccataaaacaaaggaaaatttgtttttcttctccctatgttgagggagtactgggagaatctccagagcacattag

SEQ ID NO: 112300 - DNA, 601 bp, Human
ctgagtagctggaactaccggcacaccccactatactagctaattttttatttttatttttggtagagatggggtcttgctatattgcccaggctggtctccatctcctgggtaaggcatcctcctgccttagcctcccaaagcgctaggattataggcatgagacactgcacctggagtgcaaacagatgtttaaaatggagaaaccaagagcctgaagcaaagaggcaacaatcaataacttcctcactggtgtcctggctgccctactaacctgcccacttcagtggccctctgatcrtatgaatccctacccactacctttcagtgttgtgggattcaggaggatgagagagagacctcgggttaaaacaggagaatcttttttttttttttttttgagatgcagtctcgctctgtcgcccaggctggagtgcaatggcgccatctcggctcactgcaagctctgcctcccaggttcacaccattgtcctgcttcagcctccctagtagctgggactacaggcgcccgccaccacacccggctaattttttgtatttttagtagagacagggtttcactgtgttagccaggatggtc

SEQ ID NO: 112301 - DNA, 601 bp, Human
gaggggcagtcggatcccttgagcctgggagtttgaggctgtagtgaggtacgatcgcaccactacaccctagcctatttgacagagtaagtccctgtctaaaaaaaaaaaaaaaaaaaaaaagatacatacagtgtgataggtattatatgatatgaatatgttcttatctgtagactggatgtatttaagacaaaatattgacaatggttatctctgtacagttaacatttataattcattccttgtgttcttctgtatctactaccatgtgcatttattatttttgtaatttttaatraaaaacgggtgtcaggaaagaaaattgattaaaacccctgtaaatatttcacatgtgtaatggctgtgacattgagtttgagaacagctgcagttggctgcactaattacattattttactttatagctttgtagtaaaggttgatttatatgagccgaaatggaaaatggtcacagagaaaagagttgcagaggccctggccaaaaccacctggcaccctgctaatgaaataatacctttggagtttcttgggggaagtggctcctggaagaaacagattattatgtacagccttaagc

SEQ ID NO: 112302 - DNA, 601 bp, Human
agtgcaatagcgcaatctcggatcactgcaacctccgctttgcttcctgggttcaagcgattctcctgcctcagcctcctaagtagcctacaggcacgcaacactacacctggctaattttttatatttttagtagagatggggtttcaccatattggccaggctggtctcgaacttctgaccgcaagtgatccaaccacctgggcctcccaaagtgctgggattacaggcgtgagccaccgcccctggccgcatgggctataaagaagctattaaaattgggctgggtgcagtagctcaygcttgtaatcccagcactttgggaggtgaaggcaggatgcctgcttgagcccaggagtttgaggctgcagtgagctaggattgcaccactgtactccagcctgggtgagagtgggaccccatctttaaaaatacataagtaaatagttatgttgtagaaggcttttttttttttttttttttgagatggagtcttgctctgtcgcccaggctggagtgcagtggcacgatctcggctcactgcaacctccacctcctaggttcaagcaattctctgcctcaccctcccaagtagctgaga

SEQ ID NO: 112303 - DNA, 601 bp, Human
gattctaaatttctacagtgtttcacttttatacaatgagtacctattacttctgaaagtagaattaaaaagattatttttatctttgaaagatattcatcagaacaaagcactgttacaatactgaaaaactggaagcaacttaagtgtccactgataagtgattgtttcaagaagttatgcatggacttttttttttttttttgagacggagtctcactgtgacacccaggctggagtgcaatagcgcaatctcggatcactgcaacctccgctttgcttcctgggttcaagcgattctcctgcctcagcctcctaagtagcctacaggcacgcaacactacacctggctaattttttatatttttagtagagatggggtttcaccatattggccaggctggtctcgaacttctgaccgcaagtgatccaaccacctgggcctcccaaagtgctgggattacaggcgtgagccaccgcccctggccgcatgggctataaagaagctattaaaattgggctgggtgcagtagctcatgcttgtaatcccagcactttgggaggtgaaggcaggatgcctgcttgagcccaggagtttgag

SEQ ID NO: 112304 - DNA, 601 bp, Human
gaggacccagaggaagagagcaactgtgacatgtatggccatgaagggcactgagaattggccactgtgtttagcagcatggtggtcaccggtgaccaccacatttgagctgtgtgggtgcagtggattaaagagagaatgggaggtgaggaatcggggacagggagtacagacaactcttggaggaaagccgagatgggatggtagctacaggagaatgtgtaggcaagggaagcatttttaaaagaatatgacagcatgtttgcacgctggtgggaataatccagtagacaggggaaaytgatgatgcaggagagggagaagagacaatcacaggaatgagaggagatggacccagtgccagggagatggccttagataggagcatgaacagttcatacagggtaacggcaagggaggcagaatgtgtgtatacagatgtgggtgggtgggtggggacaggtggtggaaatgcatggaagtttatgaaaggaataaagtagatttatatatcgtgacagggaactcagaatcatcccattttggtaaaaaggaaaaaagcctgttatatgccgggaaaaaatcaaattttaacattatc

SEQ ID NO: 112305 - DNA, 601 bp, Human
ggccaggcacggtggcttacacctgtaatcccagcactttgggagtctgaggcgggtggatcacaaggtcaggagtttgagaccagcctgaccaatgtggtgaaaccccgtctctactaaaaatacaaaaattatctgggtgtggtggtgcacacctgtaaccccagctacaagggaggctgaggcaggagaattgcttgaacttgggaggtggaggctgcagtgagctgagattgtgctactgtactctagcctggatgacagagagaagctctgtatcaaaaaaaaaaaaaaaggtcaraagaagagcgaaggtggtgagatatattttcaagattgagcttaaagaatttaagctcattaatgtgcttaaattagatgtgaggtgtgaggaatatacacaagtcaaggaaaacttctagatctctctcctgagcacctggaagaatgcagtggctatttacagtgataaggaagcctgcaggataagcaggcaggtttgggagtagaataggtctgttgtggatgtgttaggtttgagacagatgcctgttagacatcctagagctatttcaaataggacttagagatatgggatggg

SEQ ID NO: 112306 - DNA, 601 bp, Human
agacatgggctttgggaggctgaggcaggaggattgcttgagtccatgagttcgagaccagcctgggcaagatggcgagacctccatctctacaaaaaagtaaaaatttagccaggcatcggtggctcgtgcctgtggtcccagctactcgagaggctgacgcaggaggatccctcaagcccaggatccagcctggaaaacagagcaagacctcatctcttaaagaaaaaaaaaggccaggcacggtggcttacacctgtaatcccagcactttgggagtctgaggcgggtggatcacaasgtcaggagtttgagaccagcctgaccaatgtggtgaaaccccgtctctactaaaaatacaaaaattatctgggtgtggtggtgcacacctgtaaccccagctacaagggaggctgaggcaggagaattgcttgaacttgggaggtggaggctgcagtgagctgagattgtgctactgtactctagcctggatgacagagagaagctctgtatcaaaaaaaaaaaaaaaggtcaaaagaagagcgaaggtggtgagatatattttcaagattgagcttaaagaatttaagctcattaatgt

SEQ ID NO: 112307 - DNA, 601 bp, Human
tccgcctgcctcggcctcccaaagtgctgggattacaggcgtgagccaccatgcccggcctagccaaaacaatttttttacagagaaaggcaaaggtactagattagccaaaacaattctgaaaaaaaaaatagtcagaggactcacatactcacattacccaacttcaagactcactataaagttacagtattcaaagtagggtggtatcagcaaaaagataaacacatagagcagtgagacagaatagacagcccaggccagacatgggctttgggaggctgaggcaggaggattgctkgagtccatgagttcgagaccagcctgggcaagatggcgagacctccatctctacaaaaaagtaaaaatttagccaggcatcggtggctcgtgcctgtggtcccagctactcgagaggctgacgcaggaggatccctcaagcccaggatccagcctggaaaacagagcaagacctcatctcttaaagaaaaaaaaaggccaggcacggtggcttacacctgtaatcccagcactttgggagtctgaggcgggtggatcacaaggtcaggagtttgagaccagcctgaccaatgtggtgaaa

SEQ ID NO: 112308 - DNA, 601 bp, Human
ttctcttgttaatatatctttcgtctgtttaattcacaggtccccaaagactaaacctgagggtagataaaaagtttttcctcccagacactgtctacaaactgattctaaaatttacagagaagccagggcactgtgttttgcacctgtagtctcagttgcacacttgggagctacttgggagctgagacaggaagatcgctggaggccaggagtttgaggctataatacaccatgatcatgcctgtgagtagccaatgcactccagcctgggcaacatagaaaggcaaaggtactagayttgccaaaacaattttttttttttttgagatggagtcgcgctctatcgcccaggctgtagtgcagtggcgccatctcggctcgctgcaagctccacctcccgggttcacgccattctcctgcctcagcctctcaggtagctgggactacaggcgcctgccaccgtgcccggctaattttttgtatttttagtggagatggggtttcacagtgttagccaagatggtttcaatctcctgaccttgtgatccgcctgcctcggcctcccaaagtgctgggattacaggcgtgagccaccatg

SEQ ID NO: 112309 - DNA, 601 bp, Human
tttgagtttatacctctgaaaggccttgttgtctcccattatgccttttgttccacctcaaagcatttttctttttttttttttttgagacggagtctcgctctgttgcccaggctggagtcgtggctccatcttggctcactgcaagctccgcctcccgggttcacgtcattctcctgcctcagcctcccgagtagctgggactacaggcgcccgccaccatgcccagctaattttttgcatttttagtagacatggggtttcaccatgttcgccaggatggtctcgatctcctgacctygtgatctgcccaccttggcctcccaaagtgctgggattacaggcgtgagccaccatgcccggctcacatatttcttaatttcttttttcctatttgtagtttatgattcttatatttattgaagtctgtatgtataacactgtgctaataccagtgacttcctgtgatgtcttatctttgacactatttctgacaccaaatgtgtggtgcggtctttatctctggcaccagatacgtgtcatttttccacatcaattgttcaattatctgagatcaactggacctctgaaaattctattc

SEQ ID NO: 112310 - DNA, 601 bp, Human
ctaaactgagacctgaagaaccagatggtgctaggcaggtaaatgagaggagaagaaaagcattccagacagaaagaaagcactgcaaagaaagctgggaggacagaggcaagcttggggctttcgggaagctaaatagttcagcacagttagagcatggggtggaggtgagggctgttcttccttgcactagtgccacaagctacttacagtgagatgccctaatgtaaatcagagcctggctgggttagattacacatgtcagtcctaagtatttcagatgttcactggcaatcagtaygagttgcctttaccatacaaatgtttattgtatatccctgaataggatgattgtaaaggggtggcatgatcagtctgggggaaggggccttgaggggagtatggtctcacagtgtccaaaggagagctgtgaatagcaaaaggatgcttgtttggaagacagaaggacagcagaaggggacaaagcaaaaatccaatcatccctccttgtgtgaggaagatggggctcagggggagcggaattcaaaatgtgaggatgtttattaaaacctatggttcccccaaaattagaggggacctc

SEQ ID NO: 112311 - DNA, 601 bp, Human
cctgtaatcccagcactctgggaactcgcttgagcccaggagttccagaccagcctaggaaacctagtagatcccgtctctacaaaaaaaataaataaataaaaataaataaataaataaaaaaagctgggtgtgatggtgtgcacctgtagtcccagctactctggaggtagaagcgggaggatggcttgaggccaggagttggaggctgctttgaactagggtctcgccactgtactccagcctgggtgacagagcaagaccccgtctctgaaaaataaagtaaaaatatatatatatwtttttttctgagacagagtttcgctcttgttgcccaggctggagtgcaatggtgcgatgtcagctcactgcagcctccgcctcctgggttcaagtgattctcctgcctcagtagctgagattacaggcatacgccaccatgcctggctaatttttttttgtatttttagtagggacagggttaagccatgttggccaggctggtttcaaactcttagcctcaggtgatccacccatgtcggcctcccaaagtgctgggattacaggcttgagccactgcacccggccaaaagtttttttt

SEQ ID NO: 112312 - DNA, 601 bp, Human
gtggtggctcatgcctgtaatcccagcactctgggaactcgcttgagcccaggagttccagaccagcctaggaaacctagtagatcccgtctctacaaaaaaaataaataaataaaaataaataaataaataaaaaaagctgggtgtgatggtgtgcacctgtagtcccagctactctggaggtagaagcgggaggatggcttgaggccaggagttggaggctgctttgaactagggtctcgccactgtactccagcctgggtgacagagcaagaccccgtctctgaaaaataaagtaaatatatatatatatttttttttctgagacagagtttcgctcttgttgcccaggctggagtgcaatggtgcgatgtcagctcactgcagcctccgcctcctgggttcaagtgattctcctgcctcagtagctgagattacaggcatacgccaccatgcctggctaatttttttttgtatttttagtagggacagggttaagccatgttggccaggctggtttcaaactcttagcctcaggtgatccacccatgtcggcctcccaaagtgctgggattacaggcttgagccactgcacccggcc

SEQ ID NO: 112313 - DNA, 601 bp, Human
tgaggtacaaaatggcaaatgagctcatcaggttcaccaaatttcatttcctaagctctaaattccttaccctcaacccagaactttttccaaaacattttccactgtaacaaaccttgaaaactttcttcacagcagagtaaatcagaaacacaagcaaagggtaggggggtgtgaaaagattaataacagtactaagaatgtttttcaatgcaacaaaaaaggatgcatttatttagtagaatcctaatttttttagacccaagtcagttttatactaagcagatttttaatgaactgygtcaatataattcagtaatggcacctccaaggcaaatacattccttaaaggtaaaaaacaagtatgggaattatctggagttttttttttttaagttaaaaaaaaataataataactgaaagccaggaagcttctaggctacacatcccccatgctaacacatgcccagtggctgaacttccttctgtctgcctgaggctggctctccccctcagccagcacatgtgcagggcttctgtgaatgtcacattgacagacattccttgctaggcagctggggaccagtttcttttgtaattc

SEQ ID NO: 112314 - DNA, 601 bp, Human
agaaacactgagaccaatcacttccctttacagccctatggtactggcacatagtaagtgcttagtaaacacctgttgattttattaactagtatataaagaacagttattctagctccagaaaagtggaactgaggtacaaaatggcaaatgagctcatcaggttcaccaaatttcatttcctaagctctaaattccttaccctcaacccagaactttttccaaaacattttccactgtaacaaaccttgaaaactttcttcacagcagagtaaatcagaaacacaagcaaagggtaggrgggtgtgaaaagattaataacagtactaagaatgtttttcaatgcaacaaaaaaggatgcatttatttagtagaatcctaatttttttagacccaagtcagttttatactaagcagatttttaatgaactgcgtcaatataattcagtaatggcacctccaaggcaaatacattccttaaaggtaaaaaacaagtatgggaattatctggagttttttttttttaagttaaaaaaaaataataataactgaaagccaggaagcttctaggctacacatcccccatgctaacacatgccca

SEQ ID NO: 112315 - DNA, 601 bp, Human
ctttaattgtgcaatgtcctgcagcatacaatctccaaaggagttcagttacccagcagaaaatgtagggatgtggttagtacaggcttcttggattagatagagcacagctaaatccttaggaggcatttatgatcatccatgaaaccccctttattcctgtactgacctttgcagttagaacacaaatgagaccacaattatgacttcatgttcaaagggttcataggttccattctctgctaaggccagagactctaggcagggacaccttttaaactttttgttcatctagatattyaacattatttatgatttaggtcctgtatgaggcccagggcatgcaataatacagctctgtccttgagttgtgtatataggttgctattcggtcatgtagagtacagttgtgataaggataagctgcttgagactacatcggagggtcacctaccacagtcttagagattctaaggaaggcttctgggaggagatgtttagagtcttgaagaaccagtaggagttaaccagggggaagagggaagggcatttcagacaaaaatgagggcatgactgctgagtgcagtggcagtaatcccag

SEQ ID NO: 112316 - DNA, 601 bp, Human
tgtattaataccattctctgagtcctaccactcctatgtgattgttgcctggaaagacaaaaaaggaaaaaaaagtgctgttggagacaattgggcagtctcctagggagagagaaatagagtcagctaagtgactcaataggactgtaggtggaaaactgcttgcaaataataataattcagctttaattgtgcaatgtcctgcagcatacaatctccaaaggagttcagttacccagcagaaaatgtagggatgtggttagtacaggcttcttggattagatagagcacagctaaatcmttaggaggcatttatgatcatccatgaaaccccctttattcctgtactgacctttgcagttagaacacaaatgagaccacaattatgacttcatgttcaaagggttcataggttccattctctgctaaggccagagactctaggcagggacaccttttaaactttttgttcatctagatattcaacattatttatgatttaggtcctgtatgaggcccagggcatgcaataatacagctctgtccttgagttgtgtatataggttgctattcggtcatgtagagtacagttgtgataagg

SEQ ID NO: 112317 - DNA, 601 bp, Human
ggagattctaatcacacctgtgtgatctggccctggggcccttagctggtggggactggatatttgggaaaatttccactagaactcaggtctccaagatctatgcccacgtcctcctgcatttaatacaggggggctcctggaagggccagaggatgggccaggctccctgtagcgggggctggctccttggcttggtgtgggcaggcgggcccccatgggtggggactctgcttcctttgacccaaacttcatgggaacaatagacttcagaggagtcaccaggggcaggaaatgggarctgtgcagagccaggggtgaccctcctgggggatgggattgcatatccggtagagggttgggggcagtgcagagggcgctggggaggggctgatgacacatagggtgggcctctggggtggggccctcctccaaagggggccgttgactcagtgtgaagctagagctccgtgccggttctgtgctgagctttcggctcttactagcacagggctcgtgtttgccagcctccgctcgtgccacgctcgcccctgccaggacttggtcttccccttcccctcaagcccctgagatgtctttg

SEQ ID NO: 112318 - DNA, 601 bp, Human
ggctcactccttgaactcctgggctcaagcaatcctcattgccttaacctgagtagctgggactacaggtatacgccaccacacctggctaatttgtaaagtttttttgtggaggtagggtctcgctttgttgtccaggcaggactcaaactcctgggctcaagcaatcctcctgccttggcctcgcaaagtgctagaactgcagatgtgagccatcataccctgccaatttaaaattttctagtagccaccttaaaaaaaaaaagtgaagttaatgttggtgttttcttaaaccctagtrttatcaaaaataatttcagtgtaataatttttttttgagacggagtctcgctctttcgcccaggctggagggcagtggggtgatcttggctcactgcaagctccgcctcccgggttcactccattctcctgcctcagcctccccagtagctgggactacaggcacccgccacctaatttttttgtattttttagtagagacggggtttcaccatgttagccaggatggtcttgatctctcgaccttgtgatccacccatctcggcctcccaaagtgctgggattacaggcgtgagccacc

SEQ ID NO: 112319 - DNA, 601 bp, Human
tagtagccaccttaaaaaaaaaaagtgaagttaatgttggtgttttcttaaaccctagtattatcaaaaataatttcagtgtaataatttttttttgagacggagtctcgctctttcgcccaggctggagggcagtggggtgatcttggctcactgcaagctccgcctcccgggttcactccattctcctgcctcagcctccccagtagctgggactacaggcacccgccacctaatttttttgtattttttagtagagacggggtttcaccatgttagccaggatggtcttgatctctckaccttgtgatccacccatctcggcctcccaaagtgctgggattacaggcgtgagccaccgcgcccggccataaatttttttaaattatcattattattattatcgtagacagtgtcttgctctgtcacccaggatggagtgcagtgatgcggtcatggcttatgcagccttgacctcccaggatcaagcaatcctcccacctcagcctcctcagtagctgggactgcaggtgtacacggttgcactcagcctaggttagatttttgaacaaaaatatgtggagagtgtgaaaatgaagtg

SEQ ID NO: 112320 - DNA, 601 bp, Human
taatttttttgtattttttagtagagacggggtttcaccatgttagccaggatggtcttgatctctcgaccttgtgatccacccatctcggcctcccaaagtgctgggattacaggcgtgagccaccgcgcccggccataaatttttttaaattatcattattattattatcgtagacagtgtcttgctctgtcacccaggatggagtgcagtgatgcggtcatggcttatgcagccttgacctcccaggatcaagcaatcctcccacctcagcctcctcagtagctgggactgcaggtgyacacggttgcactcagcctaggttagatttttgaacaaaaatatgtggagagtgtgaaaatgaagtgagatacctagtagccaacctgggttcactctaccaagtcttggagaaaacaactctaacttgggtggaggaatgttcagtaagccttttcagtctaatgatcttcttggtacaagagaaagcagtgtggtctggctgatacagcagggagatggatgtgtgactgcttgacccactacgctggatgctgactcctaactcctgagcttgtgttactgtgaagaggtccccgtg

SEQ ID NO: 112321 - DNA, 601 bp, Human
ctttttctttctttttttttttttgagatgggtcttgctctgtcaccaggctggagtgcagtggcgtgatcttggctcactgcaacctctgcctcctgggttcaagcaattctcatgcctcagcctcccaagtagctgggattacaagcacacgccaccatgcccagctaatttttttgtatttttagtagaaacagggtttcaccatattggtcagactggtttcgaactcctgaccttgtgatctgcccgccttgacctcccagagtgttggtattacaggtgtgagccaccatgcccrgcgtatttcttttttttgagatggagtctcgccctattgcctaggccggagtacagtggtgcgatctcggctcactgcaacctccgcctcctgggttcaagcgattctcctgcctcagcttcctgagtagctgggattacaggcacctgccaccacgcctggctaatttttgtatttttagtagaaatgtggtttcaccatgctggccaggctggtcttgaactcccgacctcaggcgatccacctgccttggcctcccaaagtgctgggattacaggagtgaaccaccgcacctgaccc

SEQ ID NO: 112322 - DNA, 601 bp, Human
tgatacataatactataattcggggggctggtatttcggtgaatgtccttccaaatttgtgttcatgcaaatctatatattttaacataattgcaattatactctatcccgtttttttccctactgaatgctatctaatgggtaatagtgcatgtcataaaaaatacttaaaaccataattttaaggatccaagtaacattgcattctatgactatactatatttaactatgccctactgactttaaaacattgtttttagtttttagcttttaaaaattacttgacattgagcaatgttraacatatacttatctcaagaagaaatgtaataggtctaagtgtaacatcctgcatttaagttcaaagcatcaattatgtaagtctagaatagagtgggacttactcttcattcatgttgagggaaaaggcttggggttttgggctgaaaaacgaaggaagagggaaatgaacattttaatgcctgttaggtgctagaccattattctagacatttctgccttcatcatctcatttcatcctctcagccctgtgagaaaggtttggtttgtttttgttttgtttttcaacctctactttac

SEQ ID NO: 112323 - DNA, 601 bp, Human
gtttttttccctactgaatgctatctaatgggtaatagtgcatgtcataaaaaatacttaaaaccataattttaaggatccaagtaacattgcattctatgactatactatatttaactatgccctactgactttaaaacattgtttttagtttttagcttttaaaaattacttgacattgagcaatgttgaacatatacttatctcaagaagaaatgtaataggtctaagtgtaacatcctgcatttaagttcaaagcatcaattatgtaagtctagaatagagtgggacttactcttcmttcatgttgagggaaaaggcttggggttttgggctgaaaaacgaaggaagagggaaatgaacattttaatgcctgttaggtgctagaccattattctagacatttctgccttcatcatctcatttcatcctctcagccctgtgagaaaggtttggtttgtttttgttttgtttttcaacctctactttacagaggggacactgtagaagttatactgcagttggagtttggacccaggtcaatctgactctcaaactgccccattaaaccataagcctgtgtgggccagtgctgtggtaa

SEQ ID NO: 112324 - DNA, 601 bp, Human
tgtaacatcctgcatttaagttcaaagcatcaattatgtaagtctagaatagagtgggacttactcttcattcatgttgagggaaaaggcttggggttttgggctgaaaaacgaaggaagagggaaatgaacattttaatgcctgttaggtgctagaccattattctagacatttctgccttcatcatctcatttcatcctctcagccctgtgagaaaggtttggtttgtttttgttttgtttttcaacctctactttacagaggggacactgtagaagttatactgcagttggagtttgkacccaggtcaatctgactctcaaactgccccattaaaccataagcctgtgtgggccagtgctgtggtaaggtctgtgtcaagggaaacctttactcactaagctctgtgaccctctggccacattggaagccacatctggttttggaaagtttatatatcctgagctgttaagtattgagctcgccatttttatgggtcttcctctaccccccaccagtgatctgatctcaaacatgtgggtcttttttttttttttttttttgagacggagtttcgctcttgttgctcaggttggagtg

SEQ ID NO: 112325 - DNA, 601 bp, Human
ttcatcctctcagccctgtgagaaaggtttggtttgtttttgttttgtttttcaacctctactttacagaggggacactgtagaagttatactgcagttggagtttggacccaggtcaatctgactctcaaactgccccattaaaccataagcctgtgtgggccagtgctgtggtaaggtctgtgtcaagggaaacctttactcactaagctctgtgaccctctggccacattggaagccacatctggttttggaaagtttatatatcctgagctgttaagtattgagctcgccatttttrtgggtcttcctctaccccccaccagtgatctgatctcaaacatgtgggtcttttttttttttttttttttgagacggagtttcgctcttgttgctcaggttggagtgcaatggcgtgatctcgactcaccgcagcctccaccttccgggttcaagcgattctcctgccacagcctcctgagtagctggaattacgggcatttgccaccatgcctggctaattttgtatttttagtaaagatagggtttttccatgttggccaggctggtctcgaactcccgacctcaggtgatctgccca

SEQ ID NO: 112326 - DNA, 601 bp, Human
agaaaggtttggtttgtttttgttttgtttttcaacctctactttacagaggggacactgtagaagttatactgcagttggagtttggacccaggtcaatctgactctcaaactgccccattaaaccataagcctgtgtgggccagtgctgtggtaaggtctgtgtcaagggaaacctttactcactaagctctgtgaccctctggccacattggaagccacatctggttttggaaagtttatatatcctgagctgttaagtattgagctcgccatttttatgggtcttcctctacccccmaccagtgatctgatctcaaacatgtgggtcttttttttttttttttttttgagacggagtttcgctcttgttgctcaggttggagtgcaatggcgtgatctcgactcaccgcagcctccaccttccgggttcaagcgattctcctgccacagcctcctgagtagctggaattacgggcatttgccaccatgcctggctaattttgtatttttagtaaagatagggtttttccatgttggccaggctggtctcgaactcccgacctcaggtgatctgcccacctcggcctcccaaggtgct

SEQ ID NO: 112327 - DNA, 601 bp, Human
gcttcctcgaagattttgtggtcctgggcctcagtttctccacatatcagcatgcggggattccactagatgaaacacttcgggattcctgctacagggaggtagtacagcgaagctgcacctggagttggaggcaaggcttgggacgagggtgcagtgtctgagcagtcagaggaagcagaatggggagatgagggaattattgcgtggctgccatcgtctttgtccaaacaagcacggtgttaggaacaggcggaatctgggtcttgccctgaggctggagggtggggaagatgacccyccacaaccccagagagcagtggctatcagtgcagactccagagtggtgctgtccaatagaaataatatgtaagcctaggagttacatttaaaaagtaaaaagagctgggtgtggtggcttttgcccatggtcccagttactcaggaggctgaggcgggagagttgcttgagcccaggggtttgagaccagcctgggcaacatagcgagaaccctgcctctaaaaaaaagaaaggaaaacttaactggtaaaatgcattgtaataatatattctttaacctatgactacaatattatcatt

SEQ ID NO: 112328 - DNA, 601 bp, Human
ctagatgaaacacttcgggattcctgctacagggaggtagtacagcgaagctgcacctggagttggaggcaaggcttgggacgagggtgcagtgtctgagcagtcagaggaagcagaatggggagatgagggaattattgcgtggctgccatcgtctttgtccaaacaagcacggtgttaggaacaggcggaatctgggtcttgccctgaggctggagggtggggaagatgaccctccacaaccccagagagcagtggctatcagtgcagactccagagtggtgctgtccaatagaaatamtatgtaagcctaggagttacatttaaaaagtaaaaagagctgggtgtggtggcttttgcccatggtcccagttactcaggaggctgaggcgggagagttgcttgagcccaggggtttgagaccagcctgggcaacatagcgagaaccctgcctctaaaaaaaagaaaggaaaacttaactggtaaaatgcattgtaataatatattctttaacctatgactacaatattatcattttaacgtaatcaatagtaaaaagtatcaatgagatagtttaccttctttccacacaaagcgctag

SEQ ID NO: 112329 - DNA, 601 bp, Human
tggaacggaagccctggttcctgtcctcatggaacttgcagggaaatggactgtgaagctagcagtaacatactgcaagacgaaagaacgtgcacaagcagggtctgtggcagtgcctggtaaaggatgattgattctgtcccaagaggaggaggcagttgagctggctttgagagtgggtggggttctgacaagcgtgtatatgtgtaagagagagggaagcagacagagaggaagagaaacagaactatccttgagaagacagagaaaatgtgatttgagggctattgtcatgaagtgrtgagaggaggggaggtaagtgggttttgttttttgcgggttttatttttatttttattttattttattttatcttatttatttttttgacagagtctcgctctgtcgcccaggctggagtgctgtggtgcgatctcggctcactgcaagctccgcctcccgggttcatgccattctcccgcctcagcctcctgagtagctgggactacaggcaccccccaccacacctggctaattttttgtatttttagtagagacggggtttcaccatgttagccaggatggtctcgatctcctgacc

SEQ ID NO: 112330 - DNA, 601 bp, Human
gcatcccctggccacgctgatctgttcattcctataattttgcctttcaagaatgtctcacaaatggaatcatgcagttacatagctctttgggtctttgcttctttcactcagcaaggtcatagctcactgcagccttgaccacccaggctcaagtgtccctcccacctcagcctcttgagtagtggagaccacaggcacacgccaccacgcccggctcatttttgtactttttgtagagatgaggtttcgccatgttgcctaggctggtcttgaactcctggctcaagcagtccacccrcctcgcctcccacagttgtgggtgtgtgccaccatgcccagctgttgttctgagagttctttcatattctggatacaggttctttgtcaggacagtcagatatgtgatttacagatgtttggaggaaattagtttatggagaaaatcttcacaagatgatgggagtgaggaactctgaaagtgaggtgagagtttggtgtcctgagctgtggcctttctcacagtgcaagatgggaccaggaatgaggagtggggtacacctagagaatgacatgaaaaagaggagtcacggggccttcc

SEQ ID NO: 112331 - DNA, 601 bp, Human
tccaaaccggatgatcgtgccttctggaatgggaggcgcggtaactggcaggcctgcaggagtaaggtgctgggtgtgtggctggtgcaagacagaatcagtgggggtgagttttctgggtcagggtgggtcctctgggatggtaacctcagcctagggtctgagtgaaggcttccagctattgttttttcttttttcttttttctgagacggagtctcactctgtcgcccagaccggagtgtagtgtcacgatcttggctcactgcagcctctgtctcccaggttttcaaggtgccttakcctcccgagtagctggaattacaggcttgagccaccacgcctggctaatttttgtatttttagtagagatgggagtctcgccatgttggccaggttggtctcgaactgttgacctcaggtgatccacctgcctcggcctcccaaagtgctgggattacaggcgtaagccaccgtgcccggccagctttgagctgttaacagaatgtctgaaacatcataatcttccttcctatccctgaccaggcagggtggctctgggacagaagacttacatgaaaaatgaccaaggccaggatggat

SEQ ID NO: 112332 - DNA, 601 bp, Human
tgttggccaggttggtctcgaactgttgacctcaggtgatccacctgcctcggcctcccaaagtgctgggattacaggcgtaagccaccgtgcccggccagctttgagctgttaacagaatgtctgaaacatcataatcttccttcctatccctgaccaggcagggtggctctgggacagaagacttacatgaaaaatgaccaaggccaggatggatgccgcctcccacctcttgtccaagctcattctaaccccgcctgctcctatgtcctcagagccatggcccagtccagaggctcgrgtcttcattcttccccctgggggtgcagatgcttttccggaggtgcttagggcgtagggctggagagtagggcagagctggagtcctactttcccggagctcctagtgccccactgcctccaggatgtcctgtggctccctgaggctctgggtcctggaaggcattccccggtgtggagactccctcttctgcctggctcctccttctcccagggcagggcgtgcaccgaggccccaccccagatgcccgtgctgcttggacacctggtttgggctgacccccgggttctgacagggtgg

SEQ ID NO: 112333 - DNA, 601 bp, Human
gcccagtccagaggctcgggtcttcattcttccccctgggggtgcagatgcttttccggaggtgcttagggcgtagggctggagagtagggcagagctggagtcctactttcccggagctcctagtgccccactgcctccaggatgtcctgtggctccctgaggctctgggtcctggaaggcattccccggtgtggagactccctcttctgcctggctcctccttctcccagggcagggcgtgcaccgaggccccaccccagatgcccgtgctgcttggacacctggtttgggctgacccycgggttctgacagggtgggatcctcctgcctgactttgagagcagctgattgagggcaaacccacccccgaggctgaggaaacaagtgtgctggctttgacggaattccagggcaagtgcttctgttagtcactcccgggctaaatctattaatattttcagatctgcattttcctaggacacgcctccttaaagtgaagccaattggtttggttgagtacttttgcctctcaagtactgtattttcataatttttgctttttgctttatttcacttttaaaattttgtatttatttatt

SEQ ID NO: 112334 - DNA, 601 bp, Human
caaacccacccccgaggctgaggaaacaagtgtgctggctttgacggaattccagggcaagtgcttctgttagtcactcccgggctaaatctattaatattttcagatctgcattttcctaggacacgcctccttaaagtgaagccaattggtttggttgagtacttttgcctctcaagtactgtattttcataatttttgctttttgctttatttcacttttaaaattttgtatttatttattttttagtatccctgtcatggcaacttttgctttattctagaaccctgaagaaaggcsccgaggagaaaaagtctctcaacccttaaaacaaaaaacaaaaaaagactataattttgagtagtttggggtttatagaaaacttgagcagaaagtagacttcccgtagatacattcttgccccgcccccagtcagtttctcctagtcttaacatcttgcatttgttgcaattgatgtacatttgttgcaattaatgagtcaatatcggcacattattattattattattattattattattactagagacggagtcttgctcttgttgcccaggctggggtgcaatggtgtgatctcgg

SEQ ID NO: 112335 - DNA, 601 bp, Human
tgctggctttgacggaattccagggcaagtgcttctgttagtcactcccgggctaaatctattaatattttcagatctgcattttcctaggacacgcctccttaaagtgaagccaattggtttggttgagtacttttgcctctcaagtactgtattttcataatttttgctttttgctttatttcacttttaaaattttgtatttatttattttttagtatccctgtcatggcaacttttgctttattctagaaccctgaagaaaggccccgaggagaaaaagtctctcaacccttaaaamaaaaaacaaaaaaagactataattttgagtagtttggggtttatagaaaacttgagcagaaagtagacttcccgtagatacattcttgccccgcccccagtcagtttctcctagtcttaacatcttgcatttgttgcaattgatgtacatttgttgcaattaatgagtcaatatcggcacattattattattattattattattattattactagagacggagtcttgctcttgttgcccaggctggggtgcaatggtgtgatctcggctcatggcaacctctgcctcccagattcaagc

SEQ ID NO: 112336 - DNA, 601 bp, Human
ggctttgacggaattccagggcaagtgcttctgttagtcactcccgggctaaatctattaatattttcagatctgcattttcctaggacacgcctccttaaagtgaagccaattggtttggttgagtacttttgcctctcaagtactgtattttcataatttttgctttttgctttatttcacttttaaaattttgtatttatttattttttagtatccctgtcatggcaacttttgctttattctagaaccctgaagaaaggccccgaggagaaaaagtctctcaacccttaaaacaaacaacaaaaaaagactataattttgagtagtttggggtttatagaaaacttgagcagaaagtagacttcccgtagatacattcttgccccgcccccagtcagtttctcctagtcttaacatcttgcatttgttgcaattgatgtacatttgttgcaattaatgagtcaatatcggcacattattattattattattattattattattactagagacggagtcttgctcttgttgcccaggctggggtgcaatggtgtgatctcggctcatggcaacctctgcctcccagattcaagcaatt

SEQ ID NO: 112337 - DNA, 601 bp, Human
tttgacggaattccagggcaagtgcttctgttagtcactcccgggctaaatctattaatattttcagatctgcattttcctaggacacgcctccttaaagtgaagccaattggtttggttgagtacttttgcctctcaagtactgtattttcataatttttgctttttgctttatttcacttttaaaattttgtatttatttattttttagtatccctgtcatggcaacttttgctttattctagaaccctgaagaaaggccccgaggagaaaaagtctctcaacccttaaaacaaaaaacaaaaaaagactataattttgagtagtttggggtttatagaaaacttgagcagaaagtagacttcccgtagatacattcttgccccgcccccagtcagtttctcctagtcttaacatcttgcatttgttgcaattgatgtacatttgttgcaattaatgagtcaatatcggcacattattattattattattattattattattactagagacggagtcttgctcttgttgcccaggctggggtgcaatggtgtgatctcggctcatggcaacctctgcctcccagattcaagcaattttc

SEQ ID NO: 112338 - DNA, 601 bp, Human
acggaattccagggcaagtgcttctgttagtcactcccgggctaaatctattaatattttcagatctgcattttcctaggacacgcctccttaaagtgaagccaattggtttggttgagtacttttgcctctcaagtactgtattttcataatttttgctttttgctttatttcacttttaaaattttgtatttatttattttttagtatccctgtcatggcaacttttgctttattctagaaccctgaagaaaggccccgaggagaaaaagtctctcaacccttaaaacaaaaaacaaamaaagactataattttgagtagtttggggtttatagaaaacttgagcagaaagtagacttcccgtagatacattcttgccccgcccccagtcagtttctcctagtcttaacatcttgcatttgttgcaattgatgtacatttgttgcaattaatgagtcaatatcggcacattattattattattattattattattattactagagacggagtcttgctcttgttgcccaggctggggtgcaatggtgtgatctcggctcatggcaacctctgcctcccagattcaagcaattttcctgc

SEQ ID NO: 112339 - DNA, 601 bp, Human
ctttatttcacttttaaaattttgtatttatttattttttagtatccctgtcatggcaacttttgctttattctagaaccctgaagaaaggccccgaggagaaaaagtctctcaacccttaaaacaaaaaacaaaaaaagactataattttgagtagtttggggtttatagaaaacttgagcagaaagtagacttcccgtagatacattcttgccccgcccccagtcagtttctcctagtcttaacatcttgcatttgttgcaattgatgtacatttgttgcaattaatgagtcaatatcrgcacattattattattattattattattattattactagagacggagtcttgctcttgttgcccaggctggggtgcaatggtgtgatctcggctcatggcaacctctgcctcccagattcaagcaattttcctgcctcagcctctcaagtagctgggattacaggcatgcgccaccacacccagctaattttgtatttttagtagagacagggtttccccatgttggtcaggctggtcttgaactcctgacctcaggtgatctgcccacctcggcctcccaaagtgctgggattacaggc

SEQ ID NO: 112340 - DNA, 601 bp, Human
atccctgtcatggcaacttttgctttattctagaaccctgaagaaaggccccgaggagaaaaagtctctcaacccttaaaacaaaaaacaaaaaaagactataattttgagtagtttggggtttatagaaaacttgagcagaaagtagacttcccgtagatacattcttgccccgcccccagtcagtttctcctagtcttaacatcttgcatttgttgcaattgatgtacatttgttgcaattaatgagtcaatatcggcacattattattattattattattattattattactagagayggagtcttgctcttgttgcccaggctggggtgcaatggtgtgatctcggctcatggcaacctctgcctcccagattcaagcaattttcctgcctcagcctctcaagtagctgggattacaggcatgcgccaccacacccagctaattttgtatttttagtagagacagggtttccccatgttggtcaggctggtcttgaactcctgacctcaggtgatctgcccacctcggcctcccaaagtgctgggattacaggcatgagccaccgtgcccagccagcacattattagagtccatagt

SEQ ID NO: 112341 - DNA, 601 bp, Human
tataattttgagtagtttggggtttatagaaaacttgagcagaaagtagacttcccgtagatacattcttgccccgcccccagtcagtttctcctagtcttaacatcttgcatttgttgcaattgatgtacatttgttgcaattaatgagtcaatatcggcacattattattattattattattattattattactagagacggagtcttgctcttgttgcccaggctggggtgcaatggtgtgatctcggctcatggcaacctctgcctcccagattcaagcaattttcctgcctcagcmtctcaagtagctgggattacaggcatgcgccaccacacccagctaattttgtatttttagtagagacagggtttccccatgttggtcaggctggtcttgaactcctgacctcaggtgatctgcccacctcggcctcccaaagtgctgggattacaggcatgagccaccgtgcccagccagcacattattagagtccatagttcacattagggtcccttcttggtgttgtccactctgggttttggcacatgggtaataatgtgtacccaccattacagtatcatgcagaatagcatcacc

SEQ ID NO: 112342 - DNA, 601 bp, Human
gaaaacttgagcagaaagtagacttcccgtagatacattcttgccccgcccccagtcagtttctcctagtcttaacatcttgcatttgttgcaattgatgtacatttgttgcaattaatgagtcaatatcggcacattattattattattattattattattattactagagacggagtcttgctcttgttgcccaggctggggtgcaatggtgtgatctcggctcatggcaacctctgcctcccagattcaagcaattttcctgcctcagcctctcaagtagctgggattacaggcatgygccaccacacccagctaattttgtatttttagtagagacagggtttccccatgttggtcaggctggtcttgaactcctgacctcaggtgatctgcccacctcggcctcccaaagtgctgggattacaggcatgagccaccgtgcccagccagcacattattagagtccatagttcacattagggtcccttcttggtgttgtccactctgggttttggcacatgggtaataatgtgtacccaccattacagtatcatgcagaatagcatcaccgttccccaaatcctccaggttccgttta

SEQ ID NO: 112343 - DNA, 601 bp, Human
tatggttggaatcatacactatgtggccttttcagattggcgtctctcactaagtaatacgcatttgagtttcctccatgtcttttcatagctcattttttttttttgagacaaagtcttgctctgtcacccaggctggagtgcagtggcatgatcttggctcactgcaacttctgcctcctgggttcaagtgattctcctgcctcagcctcccgagtagctgggactacaggcacgtgccaccatgcccggctaatttttatattgttagtagacacaccattttgtgtttcaccaagaygccgggctggtcttgaattcctgacctcagatgatctgcccacctcggcctcccagagtgctgggattacaggcgtgaacctccacacctggccagctcatttctttttttttttttctgaatagtattacaccctgccccaccccccaaccttttgtttttgcaaatggaggcactgaggcccagagaggggaagtgactggctcaagaggcaccacgaacctgtggcaaagctgcgcttggaggctaatttgccttcctctgggtacctgtttccaggggcctctgggccgggcgctg

SEQ ID NO: 112344 - DNA, 601 bp, Human
tgcattgccttgcaggggctttacttgcttttctcaatcctcagtggctctgcaggcaggaatgctcatccccatttgacaggtgatgaaacagaagctttggggaggttcagtaagttgctgaacagctgtgcaacgtagctggtgagaggcaggtttcactcaggtcataggactctgaggcgtctttaacatgtcccggacttcacgtggcctttcccgagaacttgttgcatttcaggagaggaaggggcactgctcagcaagaggaaggcactccagtggtgggagctcaggcccygggacacctaggttttcttggtcttgttttctgagaagggcccttttttggcctccggcaggccctggcccttccgaaatcacaatgggatctgtttgtttctaactgagtacacagcctggcccggcccagcccaaccaaatccatttctctgctgggttctttccttctccaccaatccctttccttccatccctcgggactcacctgcctgtgacctggggactctcctgtccttctcttttcttttccagctgtaaccaggccctttcctttgctcctgtatttcgggcccaggtc

SEQ ID NO: 112345 - DNA, 601 bp, Human
tgacaggtgatgaaacagaagctttggggaggttcagtaagttgctgaacagctgtgcaacgtagctggtgagaggcaggtttcactcaggtcataggactctgaggcgtctttaacatgtcccggacttcacgtggcctttcccgagaacttgttgcatttcaggagaggaaggggcactgctcagcaagaggaaggcactccagtggtgggagctcaggccccgggacacctaggttttcttggtcttgttttctgagaagggcccttttttggcctccggcaggccctggcccttccraaatcacaatgggatctgtttgtttctaactgagtacacagcctggcccggcccagcccaaccaaatccatttctctgctgggttctttccttctccaccaatccctttccttccatccctcgggactcacctgcctgtgacctggggactctcctgtccttctcttttcttttccagctgtaaccaggccctttcctttgctcctgtatttcgggcccaggtcccctgcagaccctcttttccttctctgccctcttctttttgtcttctatctcctggtgcgctttaaacaatttttt

SEQ ID NO: 112346 - DNA, 601 bp, Human
ctttcctttgctcctgtatttcgggcccaggtcccctgcagaccctcttttccttctctgccctcttctttttgtcttctatctcctggtgcgctttaaacaatttttttggtgaaatatatgtaacataaaatttgccatttgaactccaagtgtgcagtttggtggcattaaggacattcacaattgtgctgcagtctcctgcttccatctccagaactttttcatcttccgaaactgaaacgctgtacccgttaaacagtaagtgcctgttttttttttgtctttttgtttttttttkttttgttttgttttgagagggagtctcactttactcactttattgcccaggctggagtgcagtggtgcgatcttggctcgctgcctccggggttcaagtgatttttgtgcctcagcctcctaagtagctgggactataggcctgcgccaccgcccctggctaatttttgtattttttagtagagacaggtttcaccatgttggccaggctggtctcgaactcctgacctcaggtgatccacctgcctcggcctcccagagtgctgggattacgggtgtgaaccactgcgcctgacaatga

SEQ ID NO: 112347 - DNA, 601 bp, Human
cccatccccaacccctgatagtctctcttcggctgtctctatggatttgcatattctcagtacttcatggaagtgaaataacatgagatttgtcctttcatgactggcttgtttcacttagtgcaatgtccttaaggttcatccatgttgtagcctatgtcagaatttcatgccttttttgtttgtttgttttggagatggagtctcactctgttgcccaggctggagtgcagtagtgtgatctcagctcactgcaacctccgcctccctggttcaagcgattcttgtgcctcaacctccygagtagctgggattacaggcacctgccaccatgcccggctaatttttgtatttttagtagagacagggtttcacattgttggccaggctggtctcgagctcccgacctcaggtgatctgcctgcctcggcctcccaaagtgctgggattacaggcgtgagccaccgcgcccggtctcattcctttttaaggtcgaatcatcctccattacctggatgcaccacattttgtttatccattcctctattgatggacatttgggctgcttccccttttgactatcctggtgccttttgacatt

SEQ ID NO: 112348 - DNA, 601 bp, Human
ggacatttgggctgcttccccttttgactatcctggtgccttttgacattctgtgctcaggaacagcagacagcacttccgcactatgcttgggaccacttgaggcagcaaaagcacctgcaaaagtgcagaagtcacagcactaaatagacccagaacaagacacctgcaggagagctgacccaggtagacgaagtgcggcgttgccgacctcagctgggagcgtgcgcgtcaggcagtgagaatttgtggctgctcagtgcacgcatgtgtccacaaatgactgtgaagatactgggartagtgatttgggggttagaaattttagcaagttggcaaacttgcaagtacaaaatctgtgactattctgtgattaatgaggattgactgtacttgcatcttcatagatgactctccctccttccctcctgagatgacagcattaatccattcagcaaggcccaatcacatcttaaaggctccatctcccaacattcttgtgttggggattaagtttttaacccacgaactttgaggggcacgttcataccagagcagcgcccaatgcctgtcatatagtacatgcccagtgaacagtgag

SEQ ID NO: 112349 - DNA, 601 bp, Human
ttgtgtggcagaaaagtgcaggcctgagatgtagttctagtcccagttttaacaggttttgtggtctttggcaagtcacttcacctctcagggccttagtctcctcacttatacattggagggcagttttctcccccgagattctttccacacaaaccctgggaaccctgcctctctccgctgggaccttcactggaggccgtaggaacagtggggtccatgcaacgaaagagaccaagaggtcttcgtgtctgcagagatgaacttctctagctcccttagcctgccaatccaggctacscctccctccaactctgcacatctaacttgcatccctcatgctgcagagtcagatcatcccccttcctattgtcaacagaagcgtttgcaaaataggctggatgtggtggcttacgcctgtaatcccagcactttgggaggccgagacgggcggatcacttgaggacaggagctcgagaccagtctggccaacatggtgaaaccccacctctactaaaaaaacaaaaattagctgggcatggtggtgcacgcctgtaattccagctactcaggaggctgaggcaggagaatctcttgaacc

SEQ ID NO: 112350 - DNA, 601 bp, Human
agtcccagttttaacaggttttgtggtctttggcaagtcacttcacctctcagggccttagtctcctcacttatacattggagggcagttttctcccccgagattctttccacacaaaccctgggaaccctgcctctctccgctgggaccttcactggaggccgtaggaacagtggggtccatgcaacgaaagagaccaagaggtcttcgtgtctgcagagatgaacttctctagctcccttagcctgccaatccaggctacccctccctccaactctgcacatctaacttgcatccctcrtgctgcagagtcagatcatcccccttcctattgtcaacagaagcgtttgcaaaataggctggatgtggtggcttacgcctgtaatcccagcactttgggaggccgagacgggcggatcacttgaggacaggagctcgagaccagtctggccaacatggtgaaaccccacctctactaaaaaaacaaaaattagctgggcatggtggtgcacgcctgtaattccagctactcaggaggctgaggcaggagaatctcttgaacctaggaggctgagattgcagtgagtccatatcgctccac

SEQ ID NO: 112351 - DNA, 601 bp, Human
acctctcagggccttagtctcctcacttatacattggagggcagttttctcccccgagattctttccacacaaaccctgggaaccctgcctctctccgctgggaccttcactggaggccgtaggaacagtggggtccatgcaacgaaagagaccaagaggtcttcgtgtctgcagagatgaacttctctagctcccttagcctgccaatccaggctacccctccctccaactctgcacatctaacttgcatccctcatgctgcagagtcagatcatcccccttcctattgtcaacagaagygtttgcaaaataggctggatgtggtggcttacgcctgtaatcccagcactttgggaggccgagacgggcggatcacttgaggacaggagctcgagaccagtctggccaacatggtgaaaccccacctctactaaaaaaacaaaaattagctgggcatggtggtgcacgcctgtaattccagctactcaggaggctgaggcaggagaatctcttgaacctaggaggctgagattgcagtgagtccatatcgctccactgtactccagcctgggtgacagagcaagactctgtctcaattaa

SEQ ID NO: 112352 - DNA, 601 bp, Human
gaccttcactggaggccgtaggaacagtggggtccatgcaacgaaagagaccaagaggtcttcgtgtctgcagagatgaacttctctagctcccttagcctgccaatccaggctacccctccctccaactctgcacatctaacttgcatccctcatgctgcagagtcagatcatcccccttcctattgtcaacagaagcgtttgcaaaataggctggatgtggtggcttacgcctgtaatcccagcactttgggaggccgagacgggcggatcacttgaggacaggagctcgagaccagtstggccaacatggtgaaaccccacctctactaaaaaaacaaaaattagctgggcatggtggtgcacgcctgtaattccagctactcaggaggctgaggcaggagaatctcttgaacctaggaggctgagattgcagtgagtccatatcgctccactgtactccagcctgggtgacagagcaagactctgtctcaattaaaaaaaaaaaaagttggcaaaataggtcaaagaagcatcatggccaggcgcagtgactcacgcctgtaatcccagcagtttgggagggcgaggcgggcagatg

SEQ ID NO: 112353 - DNA, 601 bp, Human
ttcaaagaaggaagtacagagggtggtgcctgtgtgcggaaggtatggccggagagcagggatcagcagatggaagcgctagaaaatcccatcatggagtgtgtagtgttatcttaagaacaaagaaaaggcattgaaaatttttaggtagcagaatcatgtgatcaggtttgcattttagaaaaatcactggctggggtgaagagattatggagcctgaatggggttgcaccaggtcatccagatgtgcatcgctggaagcttggattagggctgtgagatagagtagattcaggagacrtgtaggcgacagaaagacaggatgtggtcattagttagatgtgggagatattaataagagggaaaagtcaaaacagtcatgtgctgcttcacgaaggggatgcctcctgagaaatgtgtctcttggcgatttcatccttgtgcaaccataatagagggtccttacacaaacctagatggtatagcctacgacacacccaggctgtgtggtacaacctattgcttctgggctataaatctgtacagcatgtgactatactcagttctataggcaactataacacagtggtaactctaagtg

SEQ ID NO: 112354 - DNA, 483 bp, Human
gtgaaaccctgtctctactaaaaatacaaaaaaactagccagtcgtggtggcaggcacctgtagtcccagctgctcaggaggctgaggcaggagaatggcatgagcctgggaggtggagcttgcagtgagccgagattgcgccactgtactccagcctgggtgacagagcaagactctgtctcaaaaaaaacaaaaaacaaaaaacaaaacccaaaaacgcaaacacatcgtacagctgtacaaaaatattttcttaatttatatctttattctataagccttcttctgtttacaaaatcttttttttttttttttttttgagacggagtctcattctgtcccccaggctggagtgtagtggcacgatctcggctcactgcaacctccgcctcccgggtttaagcggttctcctggcctcagcctccctagtagctgggattataggtgcgcaccatcatgcctggctaatttttgtattttt

SEQ ID NO: 112355 - DNA, 601 bp, Human
cctttgtgagatcctttagaataagctggtaaaggtagatagtgtttctctgagttctgtgagctactatggcaggttaattgatcctaaggagagggttctaggaaccccacctatagctggtgggtcagaagcacaggtaaaacaacccagggcatgggattggcatgggaagtcgggaggcagtcctgtggaaccgagcccccaccctgtgggatctcctggcttcaagcaaccctcctgcctctcggcctcccaaagtgctgagattataggtatgagccaccatgcccagccctgwttttctcaatgaggctctttgattggtaaattctctattatttttgtctaaaaatgcctctatttaatcttcactcttgaatgattttttgtttgggttttaaattcaagattaacagatagtttcttttaacaatttggtgatgttatattgagtcttctagtgttactgttacgaagtttgctatcagtttgttgttattattgtttttgagacagaatctccttctgtcgcccaggctggagtgcaatggtgcaatatgggctcaccgcaacctctacctcctgggttcaagtgatt

SEQ ID NO: 112356 - DNA, 601 bp, Human
aaaaaatacatctgggtaatttcctcagctctgtcttccagattgttacttctttatctagctgtatctaagttgttaatcccaaccattgagtttttaatttcagtgactaaaatgtttatttttaaatgtttgatgtagttctttttccagcctactttgtagttttgataatatcttattctttcccatatttacaattccttatttaggtcaataatcatttaaacataatctcttcagagattttcagcctgggaccactgtttatttttaagaattggctagaggttactaagcratataaaattcaaatttcaaatccattaaagggtaggcccttggttacaaattcttttttttaagaattattttttatatctagaatttaggctaagacagataatctttttttttttttttttttttttttttgagatggagtctctgttgcctaggctggagtgcagtggcgtgatctcagctcactgcaactctgcctcccaggtacaagtcattctcttgcttcagcctcccgagtggctgggattacaggcgtgtgccaccatgccaagctaatttgtgtatttttagtagagaa

SEQ ID NO: 112357 - DNA, 601 bp, Human
aaccattaaaacccagttgtgaccaggcatggtggctcactccatgggaggccaaggagggagaattgcttgaggctggaagttcaagaccagcctaggcaacctagtgagacctctgcagtaaatacataatctctacagtaaataaataattagccgggcatggtggtgcgtgactagagtcccagctactcaggaggttgaggcaggaggatctcttgaacccatgagttcagtgctgtactaagctatgatcttgccagtgcacttcagcctgggcaacagagcaagacactgtctstaaaaaataaaaaataataaaaatttaaagtgatgaaaaataaaaaaccagcttcctcattactaagggagctttgctcagtcgtttctaaatttatttatagagtgagagttttaaaatcatcttatctactatattgccagaaattaaagttggcaactcttttaagtagtttgtttcaggctgggcatgatggctcacgcctgtgatttcagcactttgggaggccgaggtggatggatcacctgaggtcaggaatttgagaccagcctggccaacgtggcgaaaccccgtctctac

SEQ ID NO: 112358 - DNA, 601 bp, Human
gaataagctagtttattcccaaaaaagcgactctgcccccaaactctcatgaaaacttactttaacagccacagagacaacaggcaacacttgttacactaaaaaggccagtgactctgaagggctgagaacaagaccttgacctgcaccttggcctcactgcgcgaccttgggcttgtccttaggcctctgggcctcagtgcccttttcagcaagctgaaggagctgcttaggtttcctgtggtgggggttggggggggcggttcctgctttttttttttttttttgaggcggagtctcrctctgtcgcccaggctggaatgtagtggcaccatcttggcccactgcaacctctgcctcccgggttcaagtgattctctggcctcagcctcctgagtagctgggattacaggcacccgccaccatgcccggctaatttttttatttttagtagaggcggggtttcgccatgttggccagggtggtctcgaactcctgacctcaggggatccacccgcctcggcctcccaaagtgctgggattacaggtgtgagccactgcgcccggctggttcctgctttacgtgtcagtggctctaacc

SEQ ID NO: 112359 - DNA, 601 bp, Human
atcctgccgttgctccagtgtgtgaggagctgccaagactgtttctttcagaaagagcctgagttgggaagggaacaggagaatagtgacctacattatattgtatatgcgtttttaaaaatttttcattgtggtaaaaaagaccacaaaatgtaccatcctaaccctcttgaagtatccaggttggtagtgttacgtatattcacaatgctgcgcagcaggtctccagaacttcttcatcgtgcaaaaccgaaactctgtacctgtcaagtcacaactctgtgtctttctcccacgagcycctggtaaccaccattctactctgtttctatttgtttgaccacttaagaacattttgtaaaaaaaatttttagtagagatgaagtcttgctaactcctggactcaaatgatcctcctgcctcagcctccctaagtgctgggattacaggtgtgagcctctgcaccctgccgactactttatttttattttattgtattcatttattttgagacagagccttgctctgtcacccaggctggagtgcagtggcgcaatcatggctaactgcagccttgacttcccaggctcaagtgattctc

SEQ ID NO: 112360 - DNA, 601 bp, Human
gccgttgctccagtgtgtgaggagctgccaagactgtttctttcagaaagagcctgagttgggaagggaacaggagaatagtgacctacattatattgtatatgcgtttttaaaaatttttcattgtggtaaaaaagaccacaaaatgtaccatcctaaccctcttgaagtatccaggttggtagtgttacgtatattcacaatgctgcgcagcaggtctccagaacttcttcatcgtgcaaaaccgaaactctgtacctgtcaagtcacaactctgtgtctttctcccacgagctcctgstaaccaccattctactctgtttctatttgtttgaccacttaagaacattttgtaaaaaaaatttttagtagagatgaagtcttgctaactcctggactcaaatgatcctcctgcctcagcctccctaagtgctgggattacaggtgtgagcctctgcaccctgccgactactttatttttattttattgtattcatttattttgagacagagccttgctctgtcacccaggctggagtgcagtggcgcaatcatggctaactgcagccttgacttcccaggctcaagtgattctctgccc

SEQ ID NO: 112361 - DNA, 601 bp, Human
gtacctgtcaagtcacaactctgtgtctttctcccacgagctcctggtaaccaccattctactctgtttctatttgtttgaccacttaagaacattttgtaaaaaaaatttttagtagagatgaagtcttgctaactcctggactcaaatgatcctcctgcctcagcctccctaagtgctgggattacaggtgtgagcctctgcaccctgccgactactttatttttattttattgtattcatttattttgagacagagccttgctctgtcacccaggctggagtgcagtggcgcaatcayggctaactgcagccttgacttcccaggctcaagtgattctctgccctcaccctccagagtagctgggactataggtgcgagccagcacacctggctaattttttttaaattaattttttgtagagatggggtctcccgatattgcctagactggtctgaaactcctgggctcaagggatcctcctgcctcagcctcccaaagtgctgggagtataggcatgagccactgtgcctggcctaatgtgactgcttagatacctcgtcagcggaatcatgcagtgtttgggttgttttgtaact

SEQ ID NO: 112362 - DNA, 601 bp, Human
tgcagtgtttgggttgttttgtaactggcgtgtttcactcagcataatgtcctaaaggtccgtctgtgctgcagcacgtgtcccggttgccttcctttttaaagctcctatttcgctgtaggtatacaccacattttgttcatccattcatccattgatggacacttggtttgcttctaccttttgactcttgtgaataatgctgccgcgagcatgagtgtacatatatatctttgagaccctgctttcagtttgtttgggtatatacccaggtattgggtcatatggtcttgctctgtcrcccaggctggagtgtagtggcgggatctcggctcactgcaacctctgcttctcggattcaagcgattctccttgtctgagcctcccgagtagctgtgattacaggtgcccgccaccacacctggctaatttttgtatttttagtagaaacggggtttcaccatgttggccaggctggtctcgagttcctgacctcaagtgatctgcctgcctcagcctcccagagtgctgggattacaggcgtgagccacagcgcccggcctgtaccattttgcattcccaccaacagtacccaggattt

SEQ ID NO: 112363 - DNA, 601 bp, Human
aggccctcgccatctacccgccctgtggcaggcgcaaaatcatcctgtcggacgagggcaagatgtatggtaaggagcccgtcgggttcagccctgtacctgaggctgaggcaaggggccgacaccagaaccttggggttcctgccgggccacagaaggggatgaccacttggggctttgtcgggtggacactgctttcttccctcctgggctcccaagggatgggggcatctgaggagaagcctgtgagggggtgtggagggtggggcccctggcggtgagcagagatgggagtgggaawcttggaaaaggcgaatctgggtggggtagaacatccccccagagcaggtggggagcaccccacaagctgtaccccagcaggtgcctgaccagcaggctgcccaccttggctgtgaaggatgctcactcatcccctctttccctcactcattcatgcaacaaacagatgccgagccttctgtgtgcctggtgtgggttagacgggtctagtcccagcctgtcatctggggtgagggtaatgtgagctcacagatacctgctctgcaaggcagcctggagagttcctaggagaggcagagtg

SEQ ID NO: 112364 - DNA, 601 bp, Human
ccccacaagctgtaccccagcaggtgcctgaccagcaggctgcccaccttggctgtgaaggatgctcactcatcccctctttccctcactcattcatgcaacaaacagatgccgagccttctgtgtgcctggtgtgggttagacgggtctagtcccagcctgtcatctggggtgagggtaatgtgagctcacagatacctgctctgcaaggcagcctggagagttcctaggagaggcagagtgctggagaccactcccctaggaaaggccccccccaacccagcagagggtcaccagaaayggcttgatctttgtgagtggctggggttgcagaacacagctgaaactgttcagcgatgcatgggaaggaccaagcagttggcatggggccacgatgacttttggatggaagagggggcatctggaaaaatgaagcaggggctgggcatggtggctcactcaagcctgtgattccagcactttgggaggccaaggtgggaggatcacttgaggccagcagtttgaaaccagcctgggcaacaaagcgagacaccatctggagtaaaaataaaaaaaattacccaggtttggtggtgccagc

SEQ ID NO: 112365 - DNA, 601 bp, Human
taggaaaggccccccccaacccagcagagggtcaccagaaatggcttgatctttgtgagtggctggggttgcagaacacagctgaaactgttcagcgatgcatgggaaggaccaagcagttggcatggggccacgatgacttttggatggaagagggggcatctggaaaaatgaagcaggggctgggcatggtggctcactcaagcctgtgattccagcactttgggaggccaaggtgggaggatcacttgaggccagcagtttgaaaccagcctgggcaacaaagcgagacaccatctgkagtaaaaataaaaaaaattacccaggtttggtggtgccagcctgcagtcccagctactggggaggctgaggcagaaagatctcttgaggccaagaggtcaaggctgcattgagccatgagtgcactgttgcactcctgcctgggtgccagagtgaggccctgtttcaaaaaaaaaaaaaaaatgaagcaagaataaaaactgaatggctgttggaaggcccagataaggcttctgttcctgttggaaagtcctctaggaatcctagctcaaaacagtggtcttggggcaggagtgagagc

SEQ ID NO: 112366 - DNA, 601 bp, Human
cccccaacccagcagagggtcaccagaaatggcttgatctttgtgagtggctggggttgcagaacacagctgaaactgttcagcgatgcatgggaaggaccaagcagttggcatggggccacgatgacttttggatggaagagggggcatctggaaaaatgaagcaggggctgggcatggtggctcactcaagcctgtgattccagcactttgggaggccaaggtgggaggatcacttgaggccagcagtttgaaaccagcctgggcaacaaagcgagacaccatctggagtaaaaataaraaaaattacccaggtttggtggtgccagcctgcagtcccagctactggggaggctgaggcagaaagatctcttgaggccaagaggtcaaggctgcattgagccatgagtgcactgttgcactcctgcctgggtgccagagtgaggccctgtttcaaaaaaaaaaaaaaaatgaagcaagaataaaaactgaatggctgttggaaggcccagataaggcttctgttcctgttggaaagtcctctaggaatcctagctcaaaacagtggtcttggggcaggagtgagagccctgagtgggtc

SEQ ID NO: 112367 - DNA, 601 bp, Human
cgggttcaagcgattctcccacctcagcctgccgagtaagcttggattacaggcacgtgccaccactcctggctaattttgtatttttagtagagacagggtttttccatgttggtcaggctggtcttgaactccagacctcaggtgatccgcccaccttggcctcccaaagtgatgggattacaggtgtgagccaccgcacccagcttttcttttcttttcttttgtttttgagacagagtcttgctctgtcgcccaggctggagtgcagtggagcaatctcggctcactgcagcctccrccccgtgggttaaagtgattcttctgcttcaccctcccgagtagttgggtctacaggcgtgcgccaccacgctcggctgattttacaggtgtgagccaccatgcccggccttgcatctgtatttctaaataaaatacttgaatgtgtttgtggcagttaagataaaatttgtctttaacagatcccaaataacagtggcttacataagggaaatttccttctctctcctataaatgtctggagggtaggtagtccagggaaggtgtggcagctctgctccatgaagctctcagggaccca

SEQ ID NO: 112368 - DNA, 601 bp, Human
aagttctgcttcttacttttagcgcctggggaagcgtcatgggggagacagctgtgtgtggagcacctgggggtgcctggtgtggtgttcggtgctttgcagaggttgttgccatttagccaggagggacgcagcctctgggaccccccgggctctgctttggtggaggaggggatgggtatagattgtagcttaggtgtgaaatgagaaagggcagggggagtgtagggaagggcaggtggcttggctggggagctgtggtgtatgtcctggacccttcacagggcaggtctgtgtgctytagagacagaggtgggccggaaaacgaaagtgtgcatgaggcatccagcaaggggcaagggcggagggcgctgtgggtgtctgggagggccccgtggagatgctagaatgcactaaatcaacagacatttgtggagttgagcacccctggggaccaagggctttgaggacttgctttttcggggggggggtgtgtgtgtgttaaaaaatacgtaacattttccattttaatcattatagtttttcagtttataatttgatggcattaaatatattcacattgatgtacagccattactac

SEQ ID NO: 112369 - DNA, 601 bp, Human
tagattgtagcttaggtgtgaaatgagaaagggcagggggagtgtagggaagggcaggtggcttggctggggagctgtggtgtatgtcctggacccttcacagggcaggtctgtgtgctctagagacagaggtgggccggaaaacgaaagtgtgcatgaggcatccagcaaggggcaagggcggagggcgctgtgggtgtctgggagggccccgtggagatgctagaatgcactaaatcaacagacatttgtggagttgagcacccctggggaccaagggctttgaggacttgctttttcggggggggggtgtgtgtgtgttaaaaaatacgtaacattttccattttaatcattatagtttttcagtttataatttgatggcattaaatatattcacattgatgtacagccattactaccacccatcgccagaaatatttcatttcaaagtgaaattctttaccttttaaacaataattccccattctcgccatcctccccgccctccagccctggcaactgccattctgctttctgtctttatgggtctgactcctttagttacctcatgtaagtggaatcatacaacatttgcccttt

SEQ ID NO: 112370 - DNA, 601 bp, Human
ttgttataggtagatatttctgtccctgcttcacatataaagatactggggttaagagaccgtgaccaaccctggggaagcgccgggctgtggatctctggcaggacttgggttggaattctctttggcaggagggaagccactgactcagggaagcagactgaaaatggtttggcaaactgtcctggccgtgttggcatctcggatgctgctcctcccctgtgctgagacccagggaggggcatgggatggggacgctcgggagggcctggaggaagagtgaggagaggcagaggtgctkcttcactgtgcttcataacacgtcagcgctcccagcatcctgggcatctgtgatctttcggtcctttcaagggtcccttcaaggagggaggaatggcacctctgcttgcagatgcagaaatggaaattcagggaagccaagagtttctcccagtctctcaagttggaagtggagagtggggctttaacccagttctcctgcctccgagcttggcgttcctctgtcagctgaatggccttgctcctccactgcctggccctggctccaggtgggtcaggccctgggcagggccctggaggc

SEQ ID NO: 112371 - DNA, 601 bp, Human
tccccagagctctggtcttttctcccccctcacttccctgcatccaaaggccaccagcccctttccaagtgggccggcccggtggggtatggggtggggctaagaggatgattcccgacctggggacccggccttagctgtttgaggacaggggttaggcctgctccgagctccgcccacggaacatccagcataggacacgctgaccaaggccaggcagacatgcagatgacatgcaaagcagcacggcagattaacacctgctatttctgagctgagtctcccacgcttgttggctccrgccctccccttgagcacctcttaccctcctgggccggctcccgagcccggggtgcttgccttctcctgctcacggccgctttcatttctgccctgtcactgtgtgaccctccccctggcacagccaacgctggccaccctgacctcctttggccaggctcacagtcggcctagcctagcgtgcaggtggtgggattcgaacaacttctcgcccccttctgcctgctccccgccttccccgctcctcacactcagtgctggccgggtgggctcgtgtcccgcctcctgctctctggagggc

SEQ ID NO: 112372 - DNA, 601 bp, Human
gctgtcggacacatgtgctctgacagatggacagatgggcccacagtctggcaggggtgtccttcccatccccacccaggccggccctggggttggccgaggccacctgccacgttgcaatgcgcagctgcctgactggcctcctccttccccagcctgtgttctcagccaccagagggagaagcctgtggttatgcagctaggggcagagctgggacaaggacaaggacaagcccctcccaccgccaccacctcagctgggtgctttacaagtttctcactgccatggcccttctttgcyggccttcactgtggttcccacgctctacctgtaggcccacgctccctactcccttcccctcttgcccctgactctgggggccttctggtgtctacatgatccaggatacgctggctcccaccagctgtgggtaccactgtccatgagtggtgggcaggacctcaggtccaagtagttggatctccctccgggaccttacctcatgcagagacttaggaatcggggggattgatccaaagggaaggagcagcatcgtcccttgcggaggaagctcagccctgtcgggggagcatatcctgg

SEQ ID NO: 112373 - DNA, 601 bp, Human
acagatggacagatgggcccacagtctggcaggggtgtccttcccatccccacccaggccggccctggggttggccgaggccacctgccacgttgcaatgcgcagctgcctgactggcctcctccttccccagcctgtgttctcagccaccagagggagaagcctgtggttatgcagctaggggcagagctgggacaaggacaaggacaagcccctcccaccgccaccacctcagctgggtgctttacaagtttctcactgccatggcccttctttgccggccttcactgtggttcccacrctctacctgtaggcccacgctccctactcccttcccctcttgcccctgactctgggggccttctggtgtctacatgatccaggatacgctggctcccaccagctgtgggtaccactgtccatgagtggtgggcaggacctcaggtccaagtagttggatctccctccgggaccttacctcatgcagagacttaggaatcggggggattgatccaaagggaaggagcagcatcgtcccttgcggaggaagctcagccctgtcgggggagcatatcctggggggaaatagccagcatgtaat

SEQ ID NO: 112374 - DNA, 601 bp, Human
gtgaatgcagataaagctgtcacaggatacatatctgtatccgcacagatacttgtactgatgaggtatgcagcaagtgttcattgtcatcaagattttcacaggagtgacaggccacggcagctccctctgtgtgtaaagcctggattagatgccagctggcctggaggcagggagatggctgcgttgacctctagagcacccctggtggcaggaaggaagctgcttgggtccccttggctcacacacccacagacaccccacacttcactccctcacggggggttctcaactgccggcrtcacccctgaccagcacaacgaggctggagggtctgagatgagccagcaagggagaggaggaggaagctccacagacagccagggaaaagcacaactttaacaaatacaaacctggaggacagtatgccaagtgaaatataccagacgcagaaggacaaatgccgagagggctcacttagaggtggaatctaaaacagtggtgctcacagcagcagagagtagaatggtggttactggaggctggggcgggcatgacggggagatgttggtcaaagaatatagtttcagttagatgggga

SEQ ID NO: 112375 - DNA, 601 bp, Human
ccgttttgtttgttttagacaaggtcttactctccctccctggcagaagtgcagtggtgtgatcacagctcactgcagcctcaatctcctggactcaagtgaccctcctgcctcagcttcctgagtagttgggactacaggcatgtgctaccacgcctggctaattttttatttttatttttattatttttatttattttgtttgtttatttttttttgagacagagtctcgctctatcgcccaggctggagtgcaatggtgcaatctcggctcactgcaagctctgcctcctgggttcawgccattctcctgcctcagcctcccgagtagctgggactacaggcgcccgccaccatgcccggctatattttttttgtatttttagtagagacggggtttcattgtgttagccaagatggtctcaatctcctgacctcgtgatccgcctgccttgcccacccaaagtgctggaattataggcgtgagccaccgcacccagacttatttttatttttttgtagagatggagtgggtttcactatgttgcccaggctgatcttgaattcctgggcttgggcgatcttcctgcctcaggctccc

SEQ ID NO: 112376 - DNA, 601 bp, Human
acaaggtcttactctccctccctggcagaagtgcagtggtgtgatcacagctcactgcagcctcaatctcctggactcaagtgaccctcctgcctcagcttcctgagtagttgggactacaggcatgtgctaccacgcctggctaattttttatttttatttttattatttttatttattttgtttgtttatttttttttgagacagagtctcgctctatcgcccaggctggagtgcaatggtgcaatctcggctcactgcaagctctgcctcctgggttcaagccattctcctgcctcakcctcccgagtagctgggactacaggcgcccgccaccatgcccggctatattttttttgtatttttagtagagacggggtttcattgtgttagccaagatggtctcaatctcctgacctcgtgatccgcctgccttgcccacccaaagtgctggaattataggcgtgagccaccgcacccagacttatttttatttttttgtagagatggagtgggtttcactatgttgcccaggctgatcttgaattcctgggcttgggcgatcttcctgcctcaggctcccaaagtgctggggttatag

SEQ ID NO: 112377 - DNA, 601 bp, Human
ggtcttactctccctccctggcagaagtgcagtggtgtgatcacagctcactgcagcctcaatctcctggactcaagtgaccctcctgcctcagcttcctgagtagttgggactacaggcatgtgctaccacgcctggctaattttttatttttatttttattatttttatttattttgtttgtttatttttttttgagacagagtctcgctctatcgcccaggctggagtgcaatggtgcaatctcggctcactgcaagctctgcctcctgggttcaagccattctcctgcctcagcctcccgagtagctgggactacaggcgcccgccaccatgcccggctatattttttttgtatttttagtagagacggggtttcattgtgttagccaagatggtctcaatctcctgacctcgtgatccgcctgccttgcccacccaaagtgctggaattataggcgtgagccaccgcacccagacttatttttatttttttgtagagatggagtgggtttcactatgttgcccaggctgatcttgaattcctgggcttgggcgatcttcctgcctcaggctcccaaagtgctggggttataggtgt

SEQ ID NO: 112378 - DNA, 601 bp, Human
gaggtcaggagttcgagaccagcctggccaacatggtaaaacctgtctctactaaaaataacaaaaattagccaggtgtggtggtgtgcgcctgtaatcccagctacttgggaggctgaggtgggagaatcactggaacccgggaggtggaggttgcggtaagccgagatcacaccagctgcacttcagcctgggcgacagcgagactccctctcaaaacaaaacaaaaaagaagacggctgagcttgccttagaccccttggtgtggctcctgtcccgccccattactagcctctcgccsggggctgagacggcctttctagcagcagagccctggaaccttgtggcagagggtgagggtagttgtggggtggtgggcaggggctccttgcagaggctgagtcctctgtgatgtttggggttagggtctcagctgatgggggccaaggcctccctactgcttctcaccacaggctgcagaggaagcagcactgttacggggcagtcctgcctgatgagaggaggttccattaactaagcatcctcgcttggccaggcctcgggccatattcaagcacctgagccaagagtcacacctggg

SEQ ID NO: 112379 - DNA, 601 bp, Human
ctaatcagaagtaaaaggttatttgcatgtatttaacttactcctttgtcttagaaggctaaaacagttacgggacatctgaccagcatcttagcattcattccctcatcattcaggcagcaagtatttattgagcgcctacaatgtgcaggcagttttctaggtggtgggtataaataagtgaataaatagaccaaaaatccctattcgcatggactgtggttctgacgggggtgagggcacagacagtactgaaataagttagattatgtattatgctagaaggtgctgtggaggaaastaaaggcagtgggtgccagggtgggcgggtaggagtatgatttcagccctcagtggggtggtcagggaagagacagtggcacccaaggggtgcaggtggtgtgggactctggggcagagtgttccctggaggagaaacaggaagcacaaggaccatagtggggcaggtgtgggcctggtgtgtttcaggacagcaagaagtttaggatggatcgggtagactagatcagagaggtgactgaactggggtggccagatcctgcaggggtttccaggccgttgtaaggacttggacactgtt

SEQ ID NO: 112380 - DNA, 601 bp, Human
tgagagtctaacaaggaaagacagacatggataactgatgagcacacgatatcctgtgtgcaagggacgggccagaggagcaaccaagaaccgtatcccagatggtctgccatccccatccctcctgctacaccgtcacccacttcgcagctcttgggaacctctcttcttccctcatgcttttccttgcccgtagactagtctctgagctgggttacttacttgggcctagagcatgttcattttaccgaaaaggatactgagccacagagtgttctcactgagccagcgttgaggtctrtttcctacatctgtagaaatttggaagaatctgcgggaaaaaccttaaaggaactagatttaagaagagacggctgggctgggtgcagtggctcacgcctgtaatcccagcactttgggaggctgatgcgggtggatcacttgaggtcaggagttcgagaccagcctggccaacatggtgaaactctgcctctacttaaaatacaaaaaaattagctgggcatggtggtacgcacctgtaatcccagctacttgggaggctgaggcaggagaatcgcttgaacccgggaggcggaggttg

SEQ ID NO: 112381 - DNA, 601 bp, Human
agcatgttcattttaccgaaaaggatactgagccacagagtgttctcactgagccagcgttgaggtctgtttcctacatctgtagaaatttggaagaatctgcgggaaaaaccttaaaggaactagatttaagaagagacggctgggctgggtgcagtggctcacgcctgtaatcccagcactttgggaggctgatgcgggtggatcacttgaggtcaggagttcgagaccagcctggccaacatggtgaaactctgcctctacttaaaatacaaaaaaattagctgggcatggtggtacrcacctgtaatcccagctacttgggaggctgaggcaggagaatcgcttgaacccgggaggcggaggttgcagtgagccgagatcgtgccattgcacgccagcctgggggacaagagcgagacttcgtctaaaaaaaataaaaaataaaaataaagaagaagagaaggctgagtgaaagtccttaaagggaagagacttaccgtgctcccaaagctcattggtggagctgccaggctctagcctggctcaccagctcccaggtctgtggccctacttcattcacccaccggtgatgacttag

SEQ ID NO: 112382 - DNA, 601 bp, Human
caccccctcactgcttccagccttttgtccttctctccactgagaggctgctggtgtctctgcaggtcggaacgagctgattgcccgctacatcaagctccggacagggaagacccgcaccaggaagcaggtgggcctcaagagacgggtaggggtcccgggggtggtaccccagcaccagtctgctcccaaggtgggccaggccctcccaggaccagacgcaggcttttgaggggcggcagctctggatgagttatccctgttgggcgtgtcacaggtggtccagttttctttttctttyttttttctgagacggggtttcactcatgttgcccagactggagtgcaatgacgtgatctcggctcaccgcaaccttctcctcctgggttcaagtgattctcctgcctcagcctaccgagtagctggggttatagtcacccgccacaatgcccggctaattttttgtatttttagtagagacggggtttcaccacattggccaggctggtctcgaattcctgacctcatgtaatccacccgccttggcctcccaaagtggtaggattataggcgtgagccaccacccccggccgggtggtc

SEQ ID NO: 112383 - DNA, 601 bp, Human
acggggtttcaccacattggccaggctggtctcgaattcctgacctcatgtaatccacccgccttggcctcccaaagtggtaggattataggcgtgagccaccacccccggccgggtggtccagttttcttggggtccctgctgccatcacttaggaggaaacccctcgcctctctggaaagtcatcagcccccatctcatccttctccaggacactaggacagacagtaaaacattggcactacttttcttttttgttgttgttgagacagagtcctgctctgttgcccaggctggagtkcagtggcgcaatctcaactcactgcaacctccgcttcccaggttcaagcgattctcctacctcagccttccgagtagctggaattacaggcatgcgccaccacacccagctaatttttgtatttttagtagaaatggagtttcactgtgttggccaggctggtctcgaactcctgacctcaagtgatccacctgccttggcctcccaaagtgttgggattacaggtgtgagccactgctccctgccggcactgcacttttgaaatactgccggtttctggattagctgggcaaggcagga

SEQ ID NO: 112384 - DNA, 601 bp, Human
taatccacccgccttggcctcccaaagtggtaggattataggcgtgagccaccacccccggccgggtggtccagttttcttggggtccctgctgccatcacttaggaggaaacccctcgcctctctggaaagtcatcagcccccatctcatccttctccaggacactaggacagacagtaaaacattggcactacttttcttttttgttgttgttgagacagagtcctgctctgttgcccaggctggagtgcagtggcgcaatctcaactcactgcaacctccgcttcccaggttcaagcrattctcctacctcagccttccgagtagctggaattacaggcatgcgccaccacacccagctaatttttgtatttttagtagaaatggagtttcactgtgttggccaggctggtctcgaactcctgacctcaagtgatccacctgccttggcctcccaaagtgttgggattacaggtgtgagccactgctccctgccggcactgcacttttgaaatactgccggtttctggattagctgggcaaggcaggactgagggcccaccagttgaccctttcattcattcattcatttggtccaca

SEQ ID NO: 112385 - DNA, 601 bp, Human
tctcccatccgcacaagagggccaagtgtgtggatgcctggctccccacaccctgggagctacaggccaggctcctgctgggatccccccttgctggctcctgcttagaggggctcacacggctcagagcagccggatcacccaccagccctcatttcttgagggcccctcagtgccctcgaccagagcatgcggagtggcaggggcatgggggggtgcctgctgtgggggtgggggtggcgtttatggtactgtgggagctggcaaattccttcctgcttcctgtcctgtgggactgggkgttccttcccttccctgggtcagccccgtcttgcagggcctctgctgataggtgatggctctggggggcctgatgttgctggcattcccctcggggtagccctgctccccacaggagtcaggcctctgggaccctggaaccaggggcctttgggtgaacactgggagggagtgagctctccatcagggaggtgatgacgacagaggctacacagcaagttggtgggaagatctgacatttgaggcattaagtctagaccatttataaacatttttatttatttatttttagagacaggat

SEQ ID NO: 112386 - DNA, 601 bp, Human
tgatggctctggggggcctgatgttgctggcattcccctcggggtagccctgctccccacaggagtcaggcctctgggaccctggaaccaggggcctttgggtgaacactgggagggagtgagctctccatcagggaggtgatgacgacagaggctacacagcaagttggtgggaagatctgacatttgaggcattaagtctagaccatttataaacatttttatttatttatttttagagacaggatctgtctctgtcacccacgctcagtgcagtgacgcagtcatagctcactgcagyctcgacctcataagctccaatcacactcccacctcagcctcctgagtatctgggaccacaggcaagtgccactgcacggccatttttttctatttttttatagagatgaggtctccctattttgcctgagcgggtcataaacccctgggctcaagagatcttcctgccttggcctctcaaagtgctgaaattataggcatgagccactgggcctggcctggaaacatttttttttttttttttttagcaatgtagccccttttcttttcttcccccaacaaaatatcaccctgatgtgtt

SEQ ID NO: 112387 - DNA, 601 bp, Human
actgggagggagtgagctctccatcagggaggtgatgacgacagaggctacacagcaagttggtgggaagatctgacatttgaggcattaagtctagaccatttataaacatttttatttatttatttttagagacaggatctgtctctgtcacccacgctcagtgcagtgacgcagtcatagctcactgcagtctcgacctcataagctccaatcacactcccacctcagcctcctgagtatctgggaccacaggcaagtgccactgcacggccatttttttctatttttttatagagaygaggtctccctattttgcctgagcgggtcataaacccctgggctcaagagatcttcctgccttggcctctcaaagtgctgaaattataggcatgagccactgggcctggcctggaaacatttttttttttttttttttagcaatgtagccccttttcttttcttcccccaacaaaatatcaccctgatgtgttatcagaggagccgttctggtcaaagctaggttggcaaagctcctctcctcccgcgcatcctttcccaccccatggaacttgaactctaggggacctcagaatccagt

SEQ ID NO: 112388 - DNA, 601 bp, Human
attaagtctagaccatttataaacatttttatttatttatttttagagacaggatctgtctctgtcacccacgctcagtgcagtgacgcagtcatagctcactgcagtctcgacctcataagctccaatcacactcccacctcagcctcctgagtatctgggaccacaggcaagtgccactgcacggccatttttttctatttttttatagagatgaggtctccctattttgcctgagcgggtcataaacccctgggctcaagagatcttcctgccttggcctctcaaagtgctgaaattrtaggcatgagccactgggcctggcctggaaacatttttttttttttttttttagcaatgtagccccttttcttttcttcccccaacaaaatatcaccctgatgtgttatcagaggagccgttctggtcaaagctaggttggcaaagctcctctcctcccgcgcatcctttcccaccccatggaacttgaactctaggggacctcagaatccagtttaaaagctactgggaggccaggcgcggtggctcacgcctgtaagcactttgggaggccgagttgggcggatcacttgaggtcagg

SEQ ID NO: 112389 - DNA, 601 bp, Human
tctagaccatttataaacatttttatttatttatttttagagacaggatctgtctctgtcacccacgctcagtgcagtgacgcagtcatagctcactgcagtctcgacctcataagctccaatcacactcccacctcagcctcctgagtatctgggaccacaggcaagtgccactgcacggccatttttttctatttttttatagagatgaggtctccctattttgcctgagcgggtcataaacccctgggctcaagagatcttcctgccttggcctctcaaagtgctgaaattataggcrtgagccactgggcctggcctggaaacatttttttttttttttttttagcaatgtagccccttttcttttcttcccccaacaaaatatcaccctgatgtgttatcagaggagccgttctggtcaaagctaggttggcaaagctcctctcctcccgcgcatcctttcccaccccatggaacttgaactctaggggacctcagaatccagtttaaaagctactgggaggccaggcgcggtggctcacgcctgtaagcactttgggaggccgagttgggcggatcacttgaggtcaggagttca

SEQ ID NO: 112390 - DNA, 601 bp, Human
acttgaggtcaggagttcaagaccagcctggccaacatggtgaaaccctgtctctactaaaaatataaaaattagccaggtgtggtggcacacagctgtaatcccagctactcgggaggctgaggcaggagaatcacttgaacctgggaagtggaggttgcagtgagccaagatagtgccactgcacaccagtctgggcaacagagtgagactccatctcaaaaaaagccactgggctagctgggcatgcacgcctgtaatcccaggtacttggaggttgaggccaggagttggaggctgyggtgggctgtgattgcacctgtgactggccacttcagcctgggcaacattgtgagaccccatctctgaaaatattttttatattaaagaaaagccactgaattagatgaccttgaaagtcccttctggccctggcagttcatgatcctgacactggaatctcagaacgagtgggtgggaaccacagacctttctgcctcctaggaagccacaccccactgcccactcagttccattcctcctgccatcagcccagctgttccccaagccccacagctgtggcctggcacctcgctccttt

SEQ ID NO: 112391 - DNA, 601 bp, Human
ctgggcaacattgtgagaccccatctctgaaaatattttttatattaaagaaaagccactgaattagatgaccttgaaagtcccttctggccctggcagttcatgatcctgacactggaatctcagaacgagtgggtgggaaccacagacctttctgcctcctaggaagccacaccccactgcccactcagttccattcctcctgccatcagcccagctgttccccaagccccacagctgtggcctggcacctcgctcctttttccctgggacagctgaccagccctcagctgttgctccygcctctcagcctcagcttccacagccatggaacccagccctgctccctgtttcccctctttcgtctgcctctgactcaccgggaccctgcagatgaccacggtgaacagacttcccactactgggtttagggcaatcccttgggggccggctgtgtggcccacatttgcttcagggaattgtacttgtccttgtccacaggttctgacctggggcccaaggacagccttcagtggatggctggacagacaccaaggggagccataaactccttaaaatatgcaaattttcatgtatatgt

SEQ ID NO: 112392 - DNA, 601 bp, Human
aattgtacttgtccttgtccacaggttctgacctggggcccaaggacagccttcagtggatggctggacagacaccaaggggagccataaactccttaaaatatgcaaattttcatgtatatgtgagttgccttggagagattgctgtgaggattttgtcatattctcaaaggatctagaacccaaagtgattaagctctgggttggacagtgatccaatagaaatccctgagtgagaggctgggtcctaggcctggctctgccccgtggccgtgagtgcttgggcagagtcactgggacmtcctggagctccagtttcctcatctgtaaagtgacaggcgagcaaggtgacatccaagttcccctcccggccccggttagtggctccctggctccattgcccggctactgctgtcactccccatcgggtccttcccacttcctctgacccctgccccaccctgcccaggtggcggtttcctgagccccagccgtttgtttagatcgagtatccaggaaggcaggcactgagtagatgcagccccggcctcgtgatggagttgttaagtgccgaggtcttcgggctcgcaggggtgcgcct

SEQ ID NO: 112393 - DNA, 601 bp, Human
aggatctagaacccaaagtgattaagctctgggttggacagtgatccaatagaaatccctgagtgagaggctgggtcctaggcctggctctgccccgtggccgtgagtgcttgggcagagtcactgggacctcctggagctccagtttcctcatctgtaaagtgacaggcgagcaaggtgacatccaagttcccctcccggccccggttagtggctccctggctccattgcccggctactgctgtcactccccatcgggtccttcccacttcctctgacccctgccccaccctgcccaggyggcggtttcctgagccccagccgtttgtttagatcgagtatccaggaaggcaggcactgagtagatgcagccccggcctcgtgatggagttgttaagtgccgaggtcttcgggctcgcaggggtgcgcctgccaagtccctcatgccctcctgcggggagaggtcgggggctggcctgggcactttcctcctgaaaattccaagtgtcctgggaggagacacacacttagacttactagttagctccctctttggttatcagagacagcctctgagagcaaagcccaagtttggccccaa

SEQ ID NO: 112394 - DNA, 601 bp, Human
ggatctagaacccaaagtgattaagctctgggttggacagtgatccaatagaaatccctgagtgagaggctgggtcctaggcctggctctgccccgtggccgtgagtgcttgggcagagtcactgggacctcctggagctccagtttcctcatctgtaaagtgacaggcgagcaaggtgacatccaagttcccctcccggccccggttagtggctccctggctccattgcccggctactgctgtcactccccatcgggtccttcccacttcctctgacccctgccccaccctgcccaggtsgcggtttcctgagccccagccgtttgtttagatcgagtatccaggaaggcaggcactgagtagatgcagccccggcctcgtgatggagttgttaagtgccgaggtcttcgggctcgcaggggtgcgcctgccaagtccctcatgccctcctgcggggagaggtcgggggctggcctgggcactttcctcctgaaaattccaagtgtcctgggaggagacacacacttagacttactagttagctccctctttggttatcagagacagcctctgagagcaaagcccaagtttggccccaaa

SEQ ID NO: 112395 - DNA, 601 bp, Human
tcactgggacctcctggagctccagtttcctcatctgtaaagtgacaggcgagcaaggtgacatccaagttcccctcccggccccggttagtggctccctggctccattgcccggctactgctgtcactccccatcgggtccttcccacttcctctgacccctgccccaccctgcccaggtggcggtttcctgagccccagccgtttgtttagatcgagtatccaggaaggcaggcactgagtagatgcagccccggcctcgtgatggagttgttaagtgccgaggtcttcgggctcgcargggtgcgcctgccaagtccctcatgccctcctgcggggagaggtcgggggctggcctgggcactttcctcctgaaaattccaagtgtcctgggaggagacacacacttagacttactagttagctccctctttggttatcagagacagcctctgagagcaaagcccaagtttggccccaaaaggacagtggggagggggccaaggggggccagggacaaacctcatctatttcactgctttgtccacatcgacaatgacccactactcggaacagttccctactccccaccgccctctat

SEQ ID NO: 112396 - DNA, 601 bp, Human
ctgtaaagtgacaggcgagcaaggtgacatccaagttcccctcccggccccggttagtggctccctggctccattgcccggctactgctgtcactccccatcgggtccttcccacttcctctgacccctgccccaccctgcccaggtggcggtttcctgagccccagccgtttgtttagatcgagtatccaggaaggcaggcactgagtagatgcagccccggcctcgtgatggagttgttaagtgccgaggtcttcgggctcgcaggggtgcgcctgccaagtccctcatgccctcctgyggggagaggtcgggggctggcctgggcactttcctcctgaaaattccaagtgtcctgggaggagacacacacttagacttactagttagctccctctttggttatcagagacagcctctgagagcaaagcccaagtttggccccaaaaggacagtggggagggggccaaggggggccagggacaaacctcatctatttcactgctttgtccacatcgacaatgacccactactcggaacagttccctactccccaccgccctctatggtgcgtctcccccgaccccttggtttgcatggc

SEQ ID NO: 112397 - DNA, 601 bp, Human
aagttcccctcccggccccggttagtggctccctggctccattgcccggctactgctgtcactccccatcgggtccttcccacttcctctgacccctgccccaccctgcccaggtggcggtttcctgagccccagccgtttgtttagatcgagtatccaggaaggcaggcactgagtagatgcagccccggcctcgtgatggagttgttaagtgccgaggtcttcgggctcgcaggggtgcgcctgccaagtccctcatgccctcctgcggggagaggtcgggggctggcctgggcacttycctcctgaaaattccaagtgtcctgggaggagacacacacttagacttactagttagctccctctttggttatcagagacagcctctgagagcaaagcccaagtttggccccaaaaggacagtggggagggggccaaggggggccagggacaaacctcatctatttcactgctttgtccacatcgacaatgacccactactcggaacagttccctactccccaccgccctctatggtgcgtctcccccgaccccttggtttgcatggccccccgtgtgccagtctggtccaagctcacct

SEQ ID NO: 112398 - DNA, 601 bp, Human
ccccagccgtttgtttagatcgagtatccaggaaggcaggcactgagtagatgcagccccggcctcgtgatggagttgttaagtgccgaggtcttcgggctcgcaggggtgcgcctgccaagtccctcatgccctcctgcggggagaggtcgggggctggcctgggcactttcctcctgaaaattccaagtgtcctgggaggagacacacacttagacttactagttagctccctctttggttatcagagacagcctctgagagcaaagcccaagtttggccccaaaaggacagtggggagggggccaaggggggccagggacaaacctcatctatttcactgctttgtccacatcgacaatgacccactactcggaacagttccctactccccaccgccctctatggtgcgtctcccccgaccccttggtttgcatggccccccgtgtgccagtctggtccaagctcacctggtcaccatcaccactctcagcaccctagtcacccaaattctcagagcctcagtttcttcatcttaatgatcctacaagtcctgtcagtctcacaggactcagtgaggttgtgttcttgaaaaccttcc

SEQ ID NO: 112399 - DNA, 601 bp, Human
gccccggcctcgtgatggagttgttaagtgccgaggtcttcgggctcgcaggggtgcgcctgccaagtccctcatgccctcctgcggggagaggtcgggggctggcctgggcactttcctcctgaaaattccaagtgtcctgggaggagacacacacttagacttactagttagctccctctttggttatcagagacagcctctgagagcaaagcccaagtttggccccaaaaggacagtggggagggggccaaggggggccagggacaaacctcatctatttcactgctttgtccacatygacaatgacccactactcggaacagttccctactccccaccgccctctatggtgcgtctcccccgaccccttggtttgcatggccccccgtgtgccagtctggtccaagctcacctggtcaccatcaccactctcagcaccctagtcacccaaattctcagagcctcagtttcttcatcttaatgatcctacaagtcctgtcagtctcacaggactcagtgaggttgtgttcttgaaaaccttccgtgggctgcctcatgccacatgggtgaaatggtcaccttgagaggatgagtggaa

SEQ ID NO: 112400 - DNA, 601 bp, Human
agttgttaagtgccgaggtcttcgggctcgcaggggtgcgcctgccaagtccctcatgccctcctgcggggagaggtcgggggctggcctgggcactttcctcctgaaaattccaagtgtcctgggaggagacacacacttagacttactagttagctccctctttggttatcagagacagcctctgagagcaaagcccaagtttggccccaaaaggacagtggggagggggccaaggggggccagggacaaacctcatctatttcactgctttgtccacatcgacaatgacccactactyggaacagttccctactccccaccgccctctatggtgcgtctcccccgaccccttggtttgcatggccccccgtgtgccagtctggtccaagctcacctggtcaccatcaccactctcagcaccctagtcacccaaattctcagagcctcagtttcttcatcttaatgatcctacaagtcctgtcagtctcacaggactcagtgaggttgtgttcttgaaaaccttccgtgggctgcctcatgccacatgggtgaaatggtcaccttgagaggatgagtggaagggcctgctgtgttctgg

SEQ ID NO: 112401 - DNA, 601 bp, Human
cctgtgcgacagagtgagaccctgtctctggaaaaaaaaaaaaaaagaagaagaaaaagacacagtttccattaggcttcttgaaatagggaatgttgtgtcattggttttgaagacctttggaattcgggcactcaggatggaaaccactggcttatatgaatataacaaacgattactattgttacccgtgccatccaagtggctttccctgtgtgcttatttgttccgggcctattcagggtgaacccatcctctggggtcttggaacctttggagggcagacagtgggtatttacaytctgacacatgaaagatgggtgagtcccaggtgcctacagtgcccagggagatccttagggcaggactgaggcaggaggggccacaggaggtggtctcttgcctccagacagcccgtgtggccagggatgatgcttcctgtgcactcgaggagggatccagcagatattcatgcatcgttttcacaagacaggtgctgagctaggcacctgtggtagagaggtgagcaaggcatagaaggtggccccgtaattaataaaatgacagataatgtctctgtaagctctgatgaaagaagcag

SEQ ID NO: 112402 - DNA, 601 bp, Human
tggtcctgggagggccgaggggtgtctagctcaccagcctggagcccctcccgagaagagggacccttgtgggagaagacctggtggaggcagccagcggtgctgacaggagcccccaccccgccctctcactgacaggctctgctctgtcctcgtctctttctcaggaggggccctcaccacctcccactctgtaggacaagaccagctcctcactcttaaactgccctttctggtgtggagtctgcctgcccggccccttggctttccctgccaccaagagcagccctgctgccttctgtcccccaggtcctgaaggctgctttctctcgttcacacatcaaaacaaagtcacagcgtcaggtcccgtccaccctctgtctcatgccagtcttctgtccacactgaccatgtcttcactccaggcctgctggcttttgcctgcgttcctgcagcagcctctccaccggctcgctgtcccgtctcacctcctctcgtcaccctgtcactcaccagagcttcagtctcacggtgttgcttccaggtttatggtgccttcctggccccctggtgccttcaggacacgatctaaactacagta

SEQ ID NO: 112403 - DNA, 601 bp, Human
tcctccctccctgtcctgtgttcctcctcccctcctaacccaaccgacccttagtccaaggttgctctggtcccagccccacccctacactgtcccagcctctctctggttctgagaagcgggcaggaagctgaggagtctcctgtgtctgctccatatcctatgggataccagcctgtccccttcggtgtccagtgtcctgggtgaccagcgtcacctgcaaaggtcagagggggacctggaggaggccaaggtgacaggatgccagggcccttctcactctgacatcttcaaacttcttttttttttttttttttcttgagacagagcctcactctgtcacccaggctgggagtgcagtggcatgatctcagcttactgcaacttccacttcctgagttcaagcgactctcccgccttagcctccggagtagctgggattacaggtgcctgccaccacacctggctaatttttgtatttttagtagagactgggtttcaccatgttgtccaggctggtcttgaactcctgacctcaagtgatccacccacttcggcctcccaaagtgctgggattaccggtgtgagccgccgcgcccgg

SEQ ID NO: 112404 - DNA, 601 bp, Human
cttcttttttttttttttttttcttgagacagagcctcactctgtcacccaggctgggagtgcagtggcatgatctcagcttactgcaacttccacttcctgagttcaagcgactctcccgccttagcctccggagtagctgggattacaggtgcctgccaccacacctggctaatttttgtatttttagtagagactgggtttcaccatgttgtccaggctggtcttgaactcctgacctcaagtgatccacccacttcggcctcccaaagtgctgggattaccggtgtgagccgccgcrcccggctcagacttctttttagctgaggaacccatgaaccaaatagacctttacttagaagtccaggatgtaaaacaaaaggagtagacttttaccatctctattttactcatggggaaactatggcccagaaaggccaagcggcttgcaccaggtcacgtggtgggcgcgcagagccagggttgtctgtctgaccgtctggcctgtgctccgtctccctcagacccactctctccacagtacaacaagcacctgttcgtgcacattggccagtccagcccaagctacagcgacccctac

SEQ ID NO: 112405 - DNA, 601 bp, Human
tggtagtgaggacggggcgagagtgcccagagtgtgcccttgtcacagtagaaacttggggaggtggcaccagtgagaaggggagagtaagcccagcatggctatgggatggttggagctgagccgaggagcggggcggtgaccccagagagctggcctagtcgaacgaggccttgtctcacgggtggggatggcagctaagccgggctaacagtggagccctcaggaggtgaggaggtgtagttccagaaaaagacaaacgggaccctgcggggataagtgaagacatgactaggagcgyccttgtcacccaggtctttgaatgacaagtcctgcatgggtttccgggcctggagctggtccttcggtgctcgcgtccaaggcatgttgggctgaacagagcttggagaaggggagggtagtgttggatgggtcacccagctgactctgctccagggcgaggccaccccacaagaaacacccacccagcttctcagatagctcagcctgtagacttggcctctgctgccctcccacctcaccccgggcaggtattttgtgggtggaacctcctccattgaaacgtcttgtctgaggccgg

SEQ ID NO: 112406 - DNA, 601 bp, Human
tgagccgaggagcggggcggtgaccccagagagctggcctagtcgaacgaggccttgtctcacgggtggggatggcagctaagccgggctaacagtggagccctcaggaggtgaggaggtgtagttccagaaaaagacaaacgggaccctgcggggataagtgaagacatgactaggagcgcccttgtcacccaggtctttgaatgacaagtcctgcatgggtttccgggcctggagctggtccttcggtgctcgcgtccaaggcatgttgggctgaacagagcttggagaaggggagggwagtgttggatgggtcacccagctgactctgctccagggcgaggccaccccacaagaaacacccacccagcttctcagatagctcagcctgtagacttggcctctgctgccctcccacctcaccccgggcaggtattttgtgggtggaacctcctccattgaaacgtcttgtctgaggccgggaggtacagtagctgctctgggagcttagcttcctgggggcccagtgtgtgcagaaaaggggtgcgaggagagagtcagacaagtaagtgctaatgaagccagcggtgaggaagggcag

SEQ ID NO: 112407 - DNA, 601 bp, Human
tttttttttttttttgagacagagtcttactctgtcgcccaggctagagtgtagtggcgcgatctcggctcactacaacctgtacctccctggttcaagcaattcccctgcctcagcctcccgagtagctgggattacaggcacccaccatcatggctggctaatttttgtctttttgtagagacaaggtttcaccgtgttggccagcctggtcttgaactcctgacctcaggcgatctgcccacctcagcctcccagtgctgggattacaggtgtgagccactgcgcccggcctgagcawgttattctctaggcttgccctatagttgtcatcctgagcctcccctatattgatacaatttcctagctcttgcatttctctctttattggtataacccctttattttgtgggaacacatcctctagtaccttctaagaaaagatgcatggtacataaatgaccttgcttctttgaaatgtcattatttttattatatccttatacttgactgattggtattagtagtctggataaagaatctagatcatacatcattttccctagaaaatgatgacttttttttttttgagacagggtct

SEQ ID NO: 112408 - DNA, 601 bp, Human
cttactctgtcgcccaggctagagtgtagtggcgcgatctcggctcactacaacctgtacctccctggttcaagcaattcccctgcctcagcctcccgagtagctgggattacaggcacccaccatcatggctggctaatttttgtctttttgtagagacaaggtttcaccgtgttggccagcctggtcttgaactcctgacctcaggcgatctgcccacctcagcctcccagtgctgggattacaggtgtgagccactgcgcccggcctgagcatgttattctctaggcttgccctatarttgtcatcctgagcctcccctatattgatacaatttcctagctcttgcatttctctctttattggtataacccctttattttgtgggaacacatcctctagtaccttctaagaaaagatgcatggtacataaatgaccttgcttctttgaaatgtcattatttttattatatccttatacttgactgattggtattagtagtctggataaagaatctagatcatacatcattttccctagaaaatgatgacttttttttttttgagacagggtcttgtttcgagatggagtttcgctctg

SEQ ID NO: 112409 - DNA, 601 bp, Human
ttttttcctctggaagttgtaatgtttcttctttctccctaatggccagtttcacattggtgagctttgggatatgtgttgttttacttccccgtcttgagccaggtacttggtaggcacttttaactgtgagatgagtctttcagttttaggaaatttactcgtattatttctttgataatttatttccctctgttttctgttttcttttccaggaatctctgttatgatgttggaaccctctatgatgtttaccatttctttattttcttggacttatcctctacgatttttatcattygttttcaatcttggtctgttttcttagcgatttccttaattttgtattctgactcttttctgaattagttaaggttgtgtccaagtgcatatcacacaaaccccaaagaaacagtggcataaatagtttttctttcacatcaaggaagtctggaggtaaagactgtccagtgctggcccagtgctcctgacatcatgagggacctggcttctctctatctgctgtcctcagtgtatgacttctgtactcagggtcatgactgctggagttccagccactgtagccatcttccaaccatca

SEQ ID NO: 112410 - DNA, 601 bp, Human
tttttcctctggaagttgtaatgtttcttctttctccctaatggccagtttcacattggtgagctttgggatatgtgttgttttacttccccgtcttgagccaggtacttggtaggcacttttaactgtgagatgagtctttcagttttaggaaatttactcgtattatttctttgataatttatttccctctgttttctgttttcttttccaggaatctctgttatgatgttggaaccctctatgatgtttaccatttctttattttcttggacttatcctctacgatttttatcattcrttttcaatcttggtctgttttcttagcgatttccttaattttgtattctgactcttttctgaattagttaaggttgtgtccaagtgcatatcacacaaaccccaaagaaacagtggcataaatagtttttctttcacatcaaggaagtctggaggtaaagactgtccagtgctggcccagtgctcctgacatcatgagggacctggcttctctctatctgctgtcctcagtgtatgacttctgtactcagggtcatgactgctggagttccagccactgtagccatcttccaaccatcaa

SEQ ID NO: 112411 - DNA, 601 bp, Human
gttcagttgatgacattttgttttttctgggtagtttataaagtgtgcatcctacagttaagggtgaattagatgagtggaatacagcagcatctctgccacaccttctgttgaatatttaatttcggctctgacattttaattttccagagctccttcttgttctgtgattgcatcaagatgtttgatggatgtagtttttctcctctttttcttaaaggtatgaagtaagtgttacttcttaagttttctcctgctcctaaccctcccccaacccacgcccagactaagttttgctgtrttgcccaggttggagtgcagtggtgtgatctcggctcactgcaacctccgcctccctgttcaagcaattctcctgcctcagcctcccaagtagctgggattacaggtgcccgctaccacgcttggctaatttttgtatttttagtagagagaggggtttcgctatgttggccaggctggtctcgaactcctgacctcaagtgatagatttacaggcgtgagccaccacacccagcctcctgctcctttctttgtctttgtttctttttaattccgtttttctgtttgttttggtccttgt

SEQ ID NO: 112412 - DNA, 601 bp, Human
tccaagctactcaggtggctgagatgggaagatcgcttgagcctgggaggcagaggttgtagtaagctgagatcacaccactgcactgcagcctgggtgacagagcaagatcccatctcaaaaaataaagtatacaattccgagtttttaagtatattcacaaagttgtgcaaccatcaccacaatcaattttagaacattttcatcatcccgaaaataagccctgttccctttagctgtcactccccactcctaccccccagccctgtgcaataatctactttctgtctttgaagctttkcctattctggacattttgtataaaagggtttgtggaggatgtggtcttttgtgactggcttcttgaacttggcatagtgttttcaaggttcaaccatgttgtagcacgtacgttcctttttatggccaaatgtacggagagtccacattgtttatccattcatcagttcatgggcatttgggttgtctcctcttggctgttaggagtagtgctactgtgaacattacgtaccagtgtttgtgtggacattcattttcatttccatatgcttatgtctggaattactgggtcatatggcaa

SEQ ID NO: 112413 - DNA, 601 bp, Human
catggccacgtgcgtagccagggaaatatttgttagcccttctccttaagcgatgaggagtcatttaaggttttcgaacagggcaggacgtggccagggttgtgcttagttggttaactctggcacccagactggaagcaggtgtgagactcctgcagtggagaccaggcaagacgcacgtgcctcctgaggacctcggccgagaggctggcttcagggtgtggcgtgggaggcaggatgctgtccactttttctcaggaggggcttaaatcatctcccagtctcccgtccagccccggtkgtgggaattggaacctgtacagctggcagtggcgcttcccaaccctgctgtgagtctgagggggcccccagccccctggagaagccttcacccttgcttgagcactcaccgcccccggcctgtccaggctcagccctgactcagcggaaggagcttaggcgagctgatctgtggctctttcccggcatggctcaggaccctggggatacagttggggtcagagcggagacccagttggcagtggcaggaagcactcatgggaacactgccttggagcgggaggtggcatgtccgggaccc

SEQ ID NO: 112414 - DNA, 601 bp, Human
cttgtttcacaagtaggggaaactgaggcatggagtaagcagggcctggccctgagtcccccagccagggtgacctctgtcctgtgggcactcctgttggatacatgctgtgagatagatgggcccagatagactgagagagatgacagctgcactcttctcaccacgttacatacagtcacacgtctcatcctcaccacagccaagactggataacctcatctgcagaggggaaactgaggtacagacaggtagaatcacctgccaaaggttgcccagttcatagtaccagacccatacyagaccacgggtccatacctgagcagcctgaccccagggtgtgtgcttggagccaccatactaaacagtcctccttgcgaagtcactggctgccctccatgcagcatcctggagcttctcctgctcccactggagaaggctctgaattgtctaaaacagatccccagccccctgaggaacagcaggcagtggcagcgtggggagagcagacttagctctgtgcagtcaatgtagagccagccccttgggcttcttgggcgttctcgacctcagatatcccttccagaaaatagggcagtgg

SEQ ID NO: 112415 - DNA, 601 bp, Human
gtgtgccccccagcaaggcccttctgatgtgtcatggcagggcacggtgggcagcagttggccccagctggggcagagtctcagttctaccacttgagaactgtgtcctgggcaaatattggcttctctgtgcctctgcttctttgtgtgaatagtcagcagtttgatcttggggacctgccaggggctgtgtcgctgaagaccccgtgtatgtggccggctggtactgagtggggggctgtggcctgcccttgccccaccccttgcctgagccctctgagtgccagcggcctgggcaggatgagggagcgccggaggccagggcaccttggcggtcatctgctccctcctccgcatgtgtggggcgggcagaggcaccagaggaagacacatatgtgacggggaaaggtacatattcgtgtttgctgacaatgagactttgcgtcaatcgtgggtcctcacaggctgccccggctccccccgcatcgggaagctcctgtcttctgctccctggcctggtcccgccttccccctccatcagctggtgtgaacttggccacacacagttaggaaggaaaactgctcaggcaaggaaacggtg

SEQ ID NO: 112416 - DNA, 601 bp, Human
gtccgtctccagtccagcctccctgcctgtcccctgagttactgctcttactgagggcgctgtggtggtcattcatagactctcggactgctgggacacatttccagctagaagtggcatctgccagcctgaagggctgaggctgctagggctgtgcacagcctcagccctatctgctgagcgccacggggcccggagcgagggactgatgcgatgaagcccccttcctcccccagagccccgcaagtccagcagaggccacctgtctctggggccggtgagagggggcctttggtggccmttaacgccgctctgcccattggaaatgccaggcagagccgggctgcaccgtggaggcagcagagtaccccaggccttcctcccatctcagcctgctcttccctttcagtccctgacatttctcccaggcacataccagcacatgacaatgaatctgagcccctccaggcccccacacccgggctgcggctgtctctgctcatctgtcagtcacccgatcccccacacctgttccaggcacagctgcccacccgcacgcacagctatgaatagggcggagggagggttgcaagggggcact

SEQ ID NO: 112417 - DNA, 601 bp, Human
gcctccctgcctgtcccctgagttactgctcttactgagggcgctgtggtggtcattcatagactctcggactgctgggacacatttccagctagaagtggcatctgccagcctgaagggctgaggctgctagggctgtgcacagcctcagccctatctgctgagcgccacggggcccggagcgagggactgatgcgatgaagcccccttcctcccccagagccccgcaagtccagcagaggccacctgtctctggggccggtgagagggggcctttggtggcccttaacgccgctctgcmcattggaaatgccaggcagagccgggctgcaccgtggaggcagcagagtaccccaggccttcctcccatctcagcctgctcttccctttcagtccctgacatttctcccaggcacataccagcacatgacaatgaatctgagcccctccaggcccccacacccgggctgcggctgtctctgctcatctgtcagtcacccgatcccccacacctgttccaggcacagctgcccacccgcacgcacagctatgaatagggcggagggagggttgcaagggggcactcacagggcaggggacc

SEQ ID NO: 112418 - DNA, 601 bp, Human
ctgccagcctgaagggctgaggctgctagggctgtgcacagcctcagccctatctgctgagcgccacggggcccggagcgagggactgatgcgatgaagcccccttcctcccccagagccccgcaagtccagcagaggccacctgtctctggggccggtgagagggggcctttggtggcccttaacgccgctctgcccattggaaatgccaggcagagccgggctgcaccgtggaggcagcagagtaccccaggccttcctcccatctcagcctgctcttccctttcagtccctgacattwctcccaggcacataccagcacatgacaatgaatctgagcccctccaggcccccacacccgggctgcggctgtctctgctcatctgtcagtcacccgatcccccacacctgttccaggcacagctgcccacccgcacgcacagctatgaatagggcggagggagggttgcaagggggcactcacagggcaggggaccggggcagctctcattttttcttaggccaagaagcgtagcttgttttgggtgggtgctcagtgtggggggatatgagggtggacaggaaatgtcaggaaggagta

SEQ ID NO: 112419 - DNA, 601 bp, Human
ccattggaaatgccaggcagagccgggctgcaccgtggaggcagcagagtaccccaggccttcctcccatctcagcctgctcttccctttcagtccctgacatttctcccaggcacataccagcacatgacaatgaatctgagcccctccaggcccccacacccgggctgcggctgtctctgctcatctgtcagtcacccgatcccccacacctgttccaggcacagctgcccacccgcacgcacagctatgaatagggcggagggagggttgcaagggggcactcacagggcaggggacmggggcagctctcattttttcttaggccaagaagcgtagcttgttttgggtgggtgctcagtgtggggggatatgagggtggacaggaaatgtcaggaaggagtatagctgcaggagaaggggtgaggctgtaattagaaggatccaggcactgaggacgagtcgaggtgctctggggcggttcgtccgcgtcgccggctggtgtgttccgggtttatgcagtgtgaacatgagttctggggctgattgtgggatctctctttctccccctgacccattgctcaaccctagcacttgcatt

SEQ ID NO: 112420 - DNA, 601 bp, Human
aaggagtatagctgcaggagaaggggtgaggctgtaattagaaggatccaggcactgaggacgagtcgaggtgctctggggcggttcgtccgcgtcgccggctggtgtgttccgggtttatgcagtgtgaacatgagttctggggctgattgtgggatctctctttctccccctgacccattgctcaaccctagcacttgcattctatttgttctcccgattataaattccctgagagcagaaacaatgtctcaacctctctgggcccccctgcctctagcactgctggcctgggctggayaaatgggcacctgagcgatgggaagagccagggagtgggagctgatgacagaagagtgtatctgagatgggggtggagctggggcgcagaactctcagggtgagcaggacagggtaggttcctgcttgcgcctgagggaccttgctcttcccactggtgccacccggaggtgagagggtgaacagccgcctgcaaccttgattgaaggcccaccctactaaggccctgggagagcttagttcttgcctccagggagcatcgtatctggaagggggcaaggacatctggacagattatgac

SEQ ID NO: 112421 - DNA, 601 bp, Human
aagtagttgcccaggctcagtggctcattcttgtaatccccccactttgggaagctgaggcaggaggatcacttgagcccaggagttcgagaccagcctgggcaacatggcgaagccctatccctgtgttttaaaataactttatttgaaaatatggaaaatagttataggccagacgcggtggctcacgcctataatcccaacactttgggaggccgaggcaggtggatcacttgaggccaggagttcgtgaccagcctggccgatatggtgaaaccccacctctactaaaaaaaaaaaatacaaaaactagccgagcgtggtggtgggcacctgtaatctcagctactcaggaggctgaggcagaagaatcacttgaacccgggaggcgaaggttgcagtgagctgagattgcaccaccacactccagcccaggcgacagagcgagattccgtctcaaaaaataaaattaaaaaaaatagttatatagttattttcatatatattagaaagaatagaatccttgatttcatggatttattgcttagaatggaattaaggaataaaagtgagttgatttcaaagaatcaggatgtgtcgt

SEQ ID NO: 112422 - DNA, 601 bp, Human
cggtggctcacgcctataatcccaacactttgggaggccgaggcaggtggatcacttgaggccaggagttcgtgaccagcctggccgatatggtgaaaccccacctctactaaaaaaaaaaaatacaaaaactagccgagcgtggtggtgggcacctgtaatctcagctactcaggaggctgaggcagaagaatcacttgaacccgggaggcgaaggttgcagtgagctgagattgcaccaccacactccagcccaggcgacagagcgagattccgtctcaaaaaataaaattaaaaaaaatagttatatagttattttcatatatattagaaagaatagaatccttgatttcatggatttattgcttagaatggaattaaggaataaaagtgagttgatttcaaagaatcaggatgtgtcgtagatggcacatgaatgtggcattgatcagagggaccatgcgcggttaaaatctgagggtcaccaccattgatgcctggcctcacctcttggtgttccccaccatgtccagtgcatccttcccaggcagctgggcttcctgccagcggcatttcaggcattgttcacatttttgccctg

SEQ ID NO: 112423 - DNA, 601 bp, Human
aactgttccttccctgattttctgcttatgggtaccctggagaccctgctctaatggaagttacagaaaattcaggcctgccttttatggtttctcccactctgctaaacccccggccaagggcagtgcagggcagtggtgaggagcataagcgcaggtgaatccccacccagccaccctgctttccggtgcgtgtctggggggttgtgataaaatcctctgtattttggccctaaacaagggccaagttatcttcactgtccgtgacacggtctcctgcagcaccctgtgttctgggccygctgcgtagtggcagtgacaaggagctgggactgaaggcctccaacccaaagcacctgtggactctgagagtccggggccctgtgccgcccacacacttgttaaacctcctcaccgtgcaggccagtcttcgtccctctcctcaccccttccccagattggtctgaattaatgaagtcctactctcacagtctgtcagttattgatagccttcctcatgccaaatgcagccagatgcccggccagcaccagggaggagacattactccacacagtgcttctccgcctggctgcaccttgc

SEQ ID NO: 112424 - DNA, 601 bp, Human
attggtctgaattaatgaagtcctactctcacagtctgtcagttattgatagccttcctcatgccaaatgcagccagatgcccggccagcaccagggaggagacattactccacacagtgcttctccgcctggctgcaccttgcagtctcctgggagctttggaaacacaccagtgcctgaaacccattcatcacccctcagtctctagggtagagtccaggcattagtggtttttaaaaagttcctcaaattatttatttctaattaaacttgtaaaacttttgagataatggtggatcyacttgggctcataatcccatgtgcgctttacccagctcttgccctggccatatcttgcataactagagtgtaaagtggacaaccaggaaattgacgttgatgcagtccaccaagctggttcagatttcaccagttttatcggcactcctatgtgcgcttgcatgcgtgtgtgtagacagggaaatttgcatgatcaccaccagactcccaggggtccctgtgtgcccctcatggtgtcctcatgtacagccaggattgagaggctcctaccactgctcctgtgtctccttaagctcccct

SEQ ID NO: 112425 - DNA, 601 bp, Human
tcatcacccctcagtctctagggtagagtccaggcattagtggtttttaaaaagttcctcaaattatttatttctaattaaacttgtaaaacttttgagataatggtggatccacttgggctcataatcccatgtgcgctttacccagctcttgccctggccatatcttgcataactagagtgtaaagtggacaaccaggaaattgacgttgatgcagtccaccaagctggttcagatttcaccagttttatcggcactcctatgtgcgcttgcatgcgtgtgtgtagacagggaaatttrcatgatcaccaccagactcccaggggtccctgtgtgcccctcatggtgtcctcatgtacagccaggattgagaggctcctaccactgctcctgtgtctccttaagctcccctcctgccatccccggttcctgctggccacccatggagaaaggaggtcttgtttaatgtccaccaacctaagagggtgactttctttttgtctttttgtgagacagtctcactctgtcgcccaggctggaatgcagtggtacgatctcagctcactgcaacctccgcctcccgggttcaagcgattctcc

SEQ ID NO: 112426 - DNA, 601 bp, Human
attatttatttctaattaaacttgtaaaacttttgagataatggtggatccacttgggctcataatcccatgtgcgctttacccagctcttgccctggccatatcttgcataactagagtgtaaagtggacaaccaggaaattgacgttgatgcagtccaccaagctggttcagatttcaccagttttatcggcactcctatgtgcgcttgcatgcgtgtgtgtagacagggaaatttgcatgatcaccaccagactcccaggggtccctgtgtgcccctcatggtgtcctcatgtacagycaggattgagaggctcctaccactgctcctgtgtctccttaagctcccctcctgccatccccggttcctgctggccacccatggagaaaggaggtcttgtttaatgtccaccaacctaagagggtgactttctttttgtctttttgtgagacagtctcactctgtcgcccaggctggaatgcagtggtacgatctcagctcactgcaacctccgcctcccgggttcaagcgattctcctgcctcagcctccagagtagctgggattacaggcactcgccaccgtgcctggctaatttttg

SEQ ID NO: 112427 - DNA, 601 bp, Human
aaattgacgttgatgcagtccaccaagctggttcagatttcaccagttttatcggcactcctatgtgcgcttgcatgcgtgtgtgtagacagggaaatttgcatgatcaccaccagactcccaggggtccctgtgtgcccctcatggtgtcctcatgtacagccaggattgagaggctcctaccactgctcctgtgtctccttaagctcccctcctgccatccccggttcctgctggccacccatggagaaaggaggtcttgtttaatgtccaccaacctaagagggtgactttctttttktctttttgtgagacagtctcactctgtcgcccaggctggaatgcagtggtacgatctcagctcactgcaacctccgcctcccgggttcaagcgattctcctgcctcagcctccagagtagctgggattacaggcactcgccaccgtgcctggctaatttttgtattttaatagtaacaaggtttcaccatgttggccaggctggtcttgaactcctgacctcaggtgatccgcctgccttggcctcccaaagtgttgggattacaggtgtgagccactgcccctggctgggggtgactct

SEQ ID NO: 112428 - DNA, 601 bp, Human
cctgtgctcggtgagttatttgcattatatttatttataaaatttatttttaatttcaatagtttttggggtgcaggtgttttctggttacctgggtaagttctttagtggtgatttctgagattttggtgcacccttcactcaagcagtgtacattgcacccaatatgtagtcttttatccctcacctcccctttcaaccttccccctcgagttcccaaagttcatgatatcattctcatgcctttgcatcctcatagcctaactctctcttataaatgagaacatatgatgtttggttytccatttctgaattacttagaataatggtctccagctccatccaagttgctgcaaaggccattattttattttattctgtttaatggctgagtagtattccatggtatatgcacaccatattttctttatctactcgtttgtcgatgggcatttaggtcagttctgtattttgtaattgcaaattgtgctgctataaacaacatgcattattttaaaatctcataaggatgctaccaggacagtactattgaattattggctttattttacagctgaaataattgaggatccattgactc

SEQ ID NO: 112429 - DNA, 601 bp, Human
atctttgtacatacaacatctaatcccatgtctggtacctaacaagtgctctatagaaatgatcacctctgatttataaagagaaaaaaatatattttaaaaaagcaataacataaggaaagataaacagttaactataacaacacactgagataaaatggaatatattcattaaggccatccttatgttgttgttgtttttctccaaagttgtttaatcctgacatttcctaatgctatgctgaaaatgtctcttcacccacaattattggctggtacatcaaattctaagtcaccttcrttttgctgacagagtcagtgtctgttcacataaaatacactgttttctttctcaattttctgcttaggccaaaaggatctgagtttataaggatatatttaccttcctgcctgggatgacatctctttctctctcttttcctattctcctcttttaattttctctctccaccacttctgtgtgttacttgttccaacacccatttgcaacttagctttgagaggctgtactgttatctgatctatgtgtagagactccttccagctttgatttgagccccaaattacaaaggttagagtt

SEQ ID NO: 112430 - DNA, 601 bp, Human
agtgaataacacagtaatgaaacattagtctatattttaataataaaatctattgttatgagtatcctcatcttctgttcttgggtaggctcacttagatcacctgttaaaatagacgaggcaattgaacaagggactaagagctaaagtcacagaaatttggaaaagatgccatctacatttttttaattggccaggggatatttattaaacctagtctcccatagtccgccttcattttgcgtaacatgctcttcctgttccaaataatctcattcttatattcccttaagggtgtctcttcattcattcattcattcattcaccaagtggtatgcaatactatgggggacaacaccattttctaacttacttagaaaaatacaaggcttgtgactgtgatttaaaagtgctaataattatgtatcatgatctaagattcagcaggagattagtaaaagatattttagtctcagctctcatattaaccagcagtgagactttgggcaaatatctttatatctctgggcctcggtttcataaaataaagcatactactagattttcagcctactcagataagaagcctttaaagaatttc

SEQ ID NO: 112431 - DNA, 601 bp, Human
tagtgaataacacagtaatgaaacattagtctatattttaataataaaatctattgttatgagtatcctcatcttctgttcttgggtaggctcacttagatcacctgttaaaatagacgaggcaattgaacaagggactaagagctaaagtcacagaaatttggaaaagatgccatctacatttttttaattggccaggggatatttattaaacctagtctcccatagtccgccttcattttgcgtaacatgctcttcctgttccaaataatctcattcttatattcccttaagggtgtctattcattcattcattcattcattcaccaagtggtatgcaatactatgggggacaacaccattttctaacttacttagaaaaatacaaggcttgtgactgtgatttaaaagtgctaataattatgtatcatgatctaagattcagcaggagattagtaaaagatattttagtctcagctctcatattaaccagcagtgagactttgggcaaatatctttatatctctgggcctcggtttcataaaataaagcatactactagattttcagcctactcagataagaagcctttaaagaattt

SEQ ID NO: 112432 - DNA, 601 bp, Human
cagcactttgggaggccaaggcaggaggatcgcttggtctgaggagttcgagaccagcctggacaagatagcgagacccccatctctagaaaaaaataaaataaaataaaataaatcagtcaatcaattaaaatttggccggacacggtggtgcgcgcctgtagttccagcgactcgagagactgaggagggaggattccttgagcccaggagttccaaactcctgtgttgggccactgagctcgctagcctgggcaacgcagtgacatcctgtcaccttaaaaaaaaaaatgatttgacrtgtaaggatttagtttgatatttccactagtagatatttaaacaattttaaaccatttttaaaaattgtcacaaaattgttgggggtaaagaacatgtattttcctttttcgtcaagttctattgaggtgatagctgcactctgaaatttgttcactgtgcttttttttttcccaagtcgaggaagaaaactacatttacaggtgtaagtggtagaggagataaggttagtattcagcatctctggttgaattcagaaaatatttgttcagttgtgggcgctcagttttaattccatgaa

SEQ ID NO: 112433 - DNA, 601 bp, Human
ttgggaggccaaggcaggaggatcgcttggtctgaggagttcgagaccagcctggacaagatagcgagacccccatctctagaaaaaaataaaataaaataaaataaatcagtcaatcaattaaaatttggccggacacggtggtgcgcgcctgtagttccagcgactcgagagactgaggagggaggattccttgagcccaggagttccaaactcctgtgttgggccactgagctcgctagcctgggcaacgcagtgacatcctgtcaccttaaaaaaaaaaatgatttgacatgtaagkatttagtttgatatttccactagtagatatttaaacaattttaaaccatttttaaaaattgtcacaaaattgttgggggtaaagaacatgtattttcctttttcgtcaagttctattgaggtgatagctgcactctgaaatttgttcactgtgcttttttttttcccaagtcgaggaagaaaactacatttacaggtgtaagtggtagaggagataaggttagtattcagcatctctggttgaattcagaaaatatttgttcagttgtgggcgctcagttttaattccatgaatttaaag

SEQ ID NO: 112434 - DNA, 601 bp, Human
cccccatctctagaaaaaaataaaataaaataaaataaatcagtcaatcaattaaaatttggccggacacggtggtgcgcgcctgtagttccagcgactcgagagactgaggagggaggattccttgagcccaggagttccaaactcctgtgttgggccactgagctcgctagcctgggcaacgcagtgacatcctgtcaccttaaaaaaaaaaatgatttgacatgtaaggatttagtttgatatttccactagtagatatttaaacaattttaaaccatttttaaaaattgtcacaaarttgttgggggtaaagaacatgtattttcctttttcgtcaagttctattgaggtgatagctgcactctgaaatttgttcactgtgcttttttttttcccaagtcgaggaagaaaactacatttacaggtgtaagtggtagaggagataaggttagtattcagcatctctggttgaattcagaaaatatttgttcagttgtgggcgctcagttttaattccatgaatttaaagtagtaaatttcatgagtaccagatgtttgatatgactcagatttttgggggaaaaaaaacgggatgcgg

SEQ ID NO: 112435 - DNA, 601 bp, Human
caacgcagtgacatcctgtcaccttaaaaaaaaaaatgatttgacatgtaaggatttagtttgatatttccactagtagatatttaaacaattttaaaccatttttaaaaattgtcacaaaattgttgggggtaaagaacatgtattttcctttttcgtcaagttctattgaggtgatagctgcactctgaaatttgttcactgtgcttttttttttcccaagtcgaggaagaaaactacatttacaggtgtaagtggtagaggagataaggttagtattcagcatctctggttgaattcmgaaaatatttgttcagttgtgggcgctcagttttaattccatgaatttaaagtagtaaatttcatgagtaccagatgtttgatatgactcagatttttgggggaaaaaaaacgggatgcgggattgactttgaaattgggaccaagaggcttttccttccttttttttttctgagacggagtctctctctggcgccaggcggtagtgcagtggtgcgatctcggctcactgcagcctccgcttcccgggttcaagtgattctcctgcctcagcctcctgagtagctgggactataggcac

SEQ ID NO: 112436 - DNA, 601 bp, Human
tttaaaaattgtcacaaaattgttgggggtaaagaacatgtattttcctttttcgtcaagttctattgaggtgatagctgcactctgaaatttgttcactgtgcttttttttttcccaagtcgaggaagaaaactacatttacaggtgtaagtggtagaggagataaggttagtattcagcatctctggttgaattcagaaaatatttgttcagttgtgggcgctcagttttaattccatgaatttaaagtagtaaatttcatgagtaccagatgtttgatatgactcagatttttggggraaaaaaaacgggatgcgggattgactttgaaattgggaccaagaggcttttccttccttttttttttctgagacggagtctctctctggcgccaggcggtagtgcagtggtgcgatctcggctcactgcagcctccgcttcccgggttcaagtgattctcctgcctcagcctcctgagtagctgggactataggcacgcgccaccacgcccagctaatttttgtatttttagtagagacggggcttcaccatgttggccaagatggtctcgatttcttgacctcatgatctccccacctc

SEQ ID NO: 112437 - DNA, 601 bp, Human
ttcaacctcttccccaggttaagcgatcctcccacctcagcatccctagtagctgggaccacaggtgcgtggcaccacctggctaatttcttgtattttttgtagaggtggggtttcgtcatgttgctcaggctggtgtcgaagtgagctcaagtgatctgcctgcctcggcctccaaaacttctgggattacaggcctgagccactgcacttggccctaaattgtaaaattgacatcaaaggggaatgtgtgagtcaccaaatgtttctcctgccctctgtaatgttagtgcaacttctrtcagtgtttaactcatttgttactaagagggagtctcttgcttttttctctttttgggcttcaggttgtgtgtttaatgtggtttttttttttttttttccaaacggagtttcgctctcgtcgcccgggctggagtgcagtggcgccatcttggcttacttgcctcctgggttccagtgattctccagcctcagcctcctgagtagctgggattacaggcatgcgccaccatgcccggctaatttttatatttttagtagagagggggtttcaccatgttggtcaggctggtcttgaact

SEQ ID NO: 112438 - DNA, 601 bp, Human
ctaatttcttgtattttttgtagaggtggggtttcgtcatgttgctcaggctggtgtcgaagtgagctcaagtgatctgcctgcctcggcctccaaaacttctgggattacaggcctgagccactgcacttggccctaaattgtaaaattgacatcaaaggggaatgtgtgagtcaccaaatgtttctcctgccctctgtaatgttagtgcaacttctgtcagtgtttaactcatttgttactaagagggagtctcttgcttttttctctttttgggcttcaggttgtgtgtttaatgtgktttttttttttttttttccaaacggagtttcgctctcgtcgcccgggctggagtgcagtggcgccatcttggcttacttgcctcctgggttccagtgattctccagcctcagcctcctgagtagctgggattacaggcatgcgccaccatgcccggctaatttttatatttttagtagagagggggtttcaccatgttggtcaggctggtcttgaactcccgacctcaggggattcgcccgcctcggcctcccaaagtgctgggattacaggcgtgagccccccaaccctgcctggctgt

SEQ ID NO: 112439 - DNA, 601 bp, Human
taatttcttgtattttttgtagaggtggggtttcgtcatgttgctcaggctggtgtcgaagtgagctcaagtgatctgcctgcctcggcctccaaaacttctgggattacaggcctgagccactgcacttggccctaaattgtaaaattgacatcaaaggggaatgtgtgagtcaccaaatgtttctcctgccctctgtaatgttagtgcaacttctgtcagtgtttaactcatttgttactaagagggagtctcttgcttttttctctttttgggcttcaggttgtgtgtttaatgtggtttttttttttttttttccaaacggagtttcgctctcgtcgcccgggctggagtgcagtggcgccatcttggcttacttgcctcctgggttccagtgattctccagcctcagcctcctgagtagctgggattacaggcatgcgccaccatgcccggctaatttttatatttttagtagagagggggtttcaccatgttggtcaggctggtcttgaactcccgacctcaggggattcgcccgcctcggcctcccaaagtgctgggattacaggcgtgagccccccaaccctgcctggctgtt

SEQ ID NO: 112440 - DNA, 601 bp, Human
tcaggctggtgtcgaagtgagctcaagtgatctgcctgcctcggcctccaaaacttctgggattacaggcctgagccactgcacttggccctaaattgtaaaattgacatcaaaggggaatgtgtgagtcaccaaatgtttctcctgccctctgtaatgttagtgcaacttctgtcagtgtttaactcatttgttactaagagggagtctcttgcttttttctctttttgggcttcaggttgtgtgtttaatgtggtttttttttttttttttccaaacggagtttcgctctcgtcgcccrggctggagtgcagtggcgccatcttggcttacttgcctcctgggttccagtgattctccagcctcagcctcctgagtagctgggattacaggcatgcgccaccatgcccggctaatttttatatttttagtagagagggggtttcaccatgttggtcaggctggtcttgaactcccgacctcaggggattcgcccgcctcggcctcccaaagtgctgggattacaggcgtgagccccccaaccctgcctggctgtttaatgtttttgatgaaatacattgatagaattttctgtattact

SEQ ID NO: 112441 - DNA, 601 bp, Human
gccctctgtaatgttagtgcaacttctgtcagtgtttaactcatttgttactaagagggagtctcttgcttttttctctttttgggcttcaggttgtgtgtttaatgtggtttttttttttttttttccaaacggagtttcgctctcgtcgcccgggctggagtgcagtggcgccatcttggcttacttgcctcctgggttccagtgattctccagcctcagcctcctgagtagctgggattacaggcatgcgccaccatgcccggctaatttttatatttttagtagagagggggtttcwccatgttggtcaggctggtcttgaactcccgacctcaggggattcgcccgcctcggcctcccaaagtgctgggattacaggcgtgagccccccaaccctgcctggctgtttaatgtttttgatgaaatacattgatagaattttctgtattactgcctttcaatgtaaggataacaaccaacttttaggttttctgtgtttttttttttcttggaattatgtaacttttatcatgaagcagatttattttcaacaaaatagagaaattattaactacaaatattttttttaatttttttt

SEQ ID NO: 112442 - DNA, 601 bp, Human
ggtgggcagatcacgaggtcaggagttcgagaccagcccaaccaacatggcgaaaccctgtctctactaaagatacaaaaattagccagttatggtggtgtgtgcgtatagtcccagctactccggaaactgaggcagaagaattgtttgaacctgggaggcggaggttgcggtgagccgagatcacaccactgcactccagcctgggcgacaagagcaaaactccatttgaaaaataaaataaaatgaaataaaaataagaaatagtgaaaataaataacattcccgaagagagaaaatrtaacccctgagaagggagaattgggcaaaagttaaaacgaacttaagttctgagtaatgtctgtttgaatctacaagtaataaatgcattcttttaacttctggattaaatcatacatcttaaatagcctttttgtttagttcactcaaaagaatgctttttgcttttgctgtgtggtacttgcaaaatcaggaggggtttactctaaaatagttttccctgcagcattctttggggctatgggaatgctcaaatcagcggccagcctttgcttctcattgcctccctctccccaggcag

SEQ ID NO: 112443 - DNA, 601 bp, Human
ctgcactccagcctgggcgacaagagcaaaactccatttgaaaaataaaataaaatgaaataaaaataagaaatagtgaaaataaataacattcccgaagagagaaaatataacccctgagaagggagaattgggcaaaagttaaaacgaacttaagttctgagtaatgtctgtttgaatctacaagtaataaatgcattcttttaacttctggattaaatcatacatcttaaatagcctttttgtttagttcactcaaaagaatgctttttgcttttgctgtgtggtacttgcaaaatcrggaggggtttactctaaaatagttttccctgcagcattctttggggctatgggaatgctcaaatcagcggccagcctttgcttctcattgcctccctctccccaggcagttctccctgctctgattgtgtctctactaaatgggcctcctaggaaatggatgttcattccctggcttcaattaagttagctccagattgtggccgtctttcaagtagaggacagctgagcttagaatactaacatttctccctagatgaggaaggatagatgtcaaaggaattcttttctgacacttctc

SEQ ID NO: 112444 - DNA, 601 bp, Human
agaaatagtgaaaataaataacattcccgaagagagaaaatataacccctgagaagggagaattgggcaaaagttaaaacgaacttaagttctgagtaatgtctgtttgaatctacaagtaataaatgcattcttttaacttctggattaaatcatacatcttaaatagcctttttgtttagttcactcaaaagaatgctttttgcttttgctgtgtggtacttgcaaaatcaggaggggtttactctaaaatagttttccctgcagcattctttggggctatgggaatgctcaaatcagyggccagcctttgcttctcattgcctccctctccccaggcagttctccctgctctgattgtgtctctactaaatgggcctcctaggaaatggatgttcattccctggcttcaattaagttagctccagattgtggccgtctttcaagtagaggacagctgagcttagaatactaacatttctccctagatgaggaaggatagatgtcaaaggaattcttttctgacacttctcatatgacctttatgtgtcttttctcagaagcaatattttgttcaagccagatgtgttcttggtgtgtc

SEQ ID NO: 112445 - DNA, 601 bp, Human
aacttctggattaaatcatacatcttaaatagcctttttgtttagttcactcaaaagaatgctttttgcttttgctgtgtggtacttgcaaaatcaggaggggtttactctaaaatagttttccctgcagcattctttggggctatgggaatgctcaaatcagcggccagcctttgcttctcattgcctccctctccccaggcagttctccctgctctgattgtgtctctactaaatgggcctcctaggaaatggatgttcattccctggcttcaattaagttagctccagattgtggccrtctttcaagtagaggacagctgagcttagaatactaacatttctccctagatgaggaaggatagatgtcaaaggaattcttttctgacacttctcatatgacctttatgtgtcttttctcagaagcaatattttgttcaagccagatgtgttcttggtgtgtcagtatgtgtaaaaacatggccttcgaatattgacatttaggatttggacaaggtgaacctatttgtcaattgagttaggaaacatactttgttaatagctctttccacaattatctgaaattgttatcagtttgaac

SEQ ID NO: 112446 - DNA, 601 bp, Human
cagctgagcttagaatactaacatttctccctagatgaggaaggatagatgtcaaaggaattcttttctgacacttctcatatgacctttatgtgtcttttctcagaagcaatattttgttcaagccagatgtgttcttggtgtgtcagtatgtgtaaaaacatggccttcgaatattgacatttaggatttggacaaggtgaacctatttgtcaattgagttaggaaacatactttgttaatagctctttccacaattatctgaaattgttatcagtttgaacatgatgaaatctgatgmctcactctatacagttatttgccacttaatgatggggatgcattctgagaaatgtgtcattagtggattttgttgtgtgaacgtcatagtgtacacaaaccttgatgggatatcctactacctacctaggccctgtggtacagtctgttgctcctaggctgcaaagctatacggcctgttactgtactgaatattgtaggcaattggaacacactggtaagtattagcgtatctaaacatctaaacatagcaaaggtacagtgagaatacttttttttttttttttgagacggagtcgca

SEQ ID NO: 112447 - DNA, 601 bp, Human
catggccttcgaatattgacatttaggatttggacaaggtgaacctatttgtcaattgagttaggaaacatactttgttaatagctctttccacaattatctgaaattgttatcagtttgaacatgatgaaatctgatgactcactctatacagttatttgccacttaatgatggggatgcattctgagaaatgtgtcattagtggattttgttgtgtgaacgtcatagtgtacacaaaccttgatgggatatcctactacctacctaggccctgtggtacagtctgttgctcctaggctrcaaagctatacggcctgttactgtactgaatattgtaggcaattggaacacactggtaagtattagcgtatctaaacatctaaacatagcaaaggtacagtgagaatacttttttttttttttttgagacggagtcgcatctttgttactcaggctggagtgcaatggcatgatctcggctcactgcaatctctgcctcccaggttcaagtgattctcctgcctcagcctcccaagtagttgggattacaggcgtgcaccaccatgcccagctaattttgtatttttagtagaaacgggg

SEQ ID NO: 112448 - DNA, 601 bp, Human
atattgacatttaggatttggacaaggtgaacctatttgtcaattgagttaggaaacatactttgttaatagctctttccacaattatctgaaattgttatcagtttgaacatgatgaaatctgatgactcactctatacagttatttgccacttaatgatggggatgcattctgagaaatgtgtcattagtggattttgttgtgtgaacgtcatagtgtacacaaaccttgatgggatatcctactacctacctaggccctgtggtacagtctgttgctcctaggctgcaaagctatacrgcctgttactgtactgaatattgtaggcaattggaacacactggtaagtattagcgtatctaaacatctaaacatagcaaaggtacagtgagaatacttttttttttttttttgagacggagtcgcatctttgttactcaggctggagtgcaatggcatgatctcggctcactgcaatctctgcctcccaggttcaagtgattctcctgcctcagcctcccaagtagttgggattacaggcgtgcaccaccatgcccagctaattttgtatttttagtagaaacggggttttaccatgtt

SEQ ID NO: 112449 - DNA, 601 bp, Human
aacatagcaaaggtacagtgagaatacttttttttttttttttgagacggagtcgcatctttgttactcaggctggagtgcaatggcatgatctcggctcactgcaatctctgcctcccaggttcaagtgattctcctgcctcagcctcccaagtagttgggattacaggcgtgcaccaccatgcccagctaattttgtatttttagtagaaacggggttttaccatgttggtcaaactggtcttgaactcctgacctcaagtgatccacccgcctctgcctcccaaagtgctgggattayaggcgtgagccactgtgcctggctgacaatgtggtgttatcatcttaggggacccctgttgtatatgcagtatggttgacctaaatgtcgttattcagggcactcctccccagggctgcttaaaaatccattcactggcttggaagttctacctaaaaatagcaagtcagctggcatttttaatgaacatattgaaataccagagaatgaaattcctgtctctgctgaccattttaatacacgtgttcagtcgtgtggtttaacacattcaggtagattgggagtgagacttgtgattga

SEQ ID NO: 112450 - DNA, 601 bp, Human
cgtgagccactgtgcctggctgacaatgtggtgttatcatcttaggggacccctgttgtatatgcagtatggttgacctaaatgtcgttattcagggcactcctccccagggctgcttaaaaatccattcactggcttggaagttctacctaaaaatagcaagtcagctggcatttttaatgaacatattgaaataccagagaatgaaattcctgtctctgctgaccattttaatacacgtgttcagtcgtgtggtttaacacattcaggtagattgggagtgagacttgtgattgaattygggctctttcgctgatcagctgtttgacctttagaatatgaactatagttgtaagtttaaaattgctttcctgtgatgtgtagaaaataaggctgtaacaaagcaagaaatatttttcaaatatgctcctggaaaaataaaattattgctatttagcttttcaggaagaaacttcaataaatctacaaggtaggtgctataatctcattttacagagagatatgaaactcatatgaaaggagttcacctcctttctcccgaaattcatttagagcatctatgagtttcatatctgtctgt

SEQ ID NO: 112451 - DNA, 601 bp, Human
agtcagctggcatttttaatgaacatattgaaataccagagaatgaaattcctgtctctgctgaccattttaatacacgtgttcagtcgtgtggtttaacacattcaggtagattgggagtgagacttgtgattgaattcgggctctttcgctgatcagctgtttgacctttagaatatgaactatagttgtaagtttaaaattgctttcctgtgatgtgtagaaaataaggctgtaacaaagcaagaaatatttttcaaatatgctcctggaaaaataaaattattgctatttagctttkcaggaagaaacttcaataaatctacaaggtaggtgctataatctcattttacagagagatatgaaactcatatgaaaggagttcacctcctttctcccgaaattcatttagagcatctatgagtttcatatctgtctgtaaaatgagattatagtgcctactttgtcaaggttatcgtgaaaattatcacacatcatatgtgaaaaataatatatatttaatataattcctggcaggcagtattaaatattcactaagtagaactgtacttaagtgcaactagcagagtgacaacacatt

SEQ ID NO: 112452 - DNA, 601 bp, Human
tttaaattttttttttggagcctcgctctgtcgcctaggctggagtgcagtggcaggatctcggctcatggcaacctccacctcctgggttcaagcagttctccctgcctcagcctcctgagtaggtaggattacaggtgcctgccaccacccctggctaatttttgtatttttagtagggacagggtttcaccatgttggccaggctggtctcgaactccttacctcaggtgatgcacctgcctcggcctcctaaagtactgggattacaggcatgagccactacgcccagcctaaagatttttttaatacaggggaaattattagaaatttctgggtttccaacattcgaaagcttttgaaaggtgataaagtattatgatgaaatcattagtcttctcactgaagtgaagattaaggtaacacattcatttgtagtattaagaagtattgtaaaacaaaaatcttcccaggcacagtggttcaggcctataatgctagcacttagggaggctgaggcaggaggaaggagatcacttgaggccagtagctcaagaccagcctgggcaacatagtgagaccccctgtctgtctgttggtc

SEQ ID NO: 112453 - DNA, 601 bp, Human
ctttgagaggctcatgcgggtgggtcacctgaggtcaggagttagagaccagcctgaccaacatggagaaaccatgtatctactaaaaatacaaaattagccgggcatggtggcccatgcctgtaatcccagctactcgggaggctgaggcaggagaatcgcttgaacccaggaggctgaggttgtggtgagctgagatcacgccattgcaatccagcctgggcaacaagagcgaaacgacgtctcaaaaaaaaaaaaaaaaaaaaaacagcgaaattcattcttagctcaaaggcagtayaaaaactgacggcaggccagatttggcccacacgctatagtttgcagcccctgtgctaaatcataaaagtattttttcctggaaggtcatagttattcatactgtgaatattatttaagagagcattgaagattgtttttatattaaaatggaacccgttaccttatggaataaaacccagaatttaattttcaagataaaacttggaggcgggggccgggcgtggtggctcacgcctgtaatcccagcactttgggaggccaaggtgggcggatcacgaggtcagaagttcgagaccat

SEQ ID NO: 112454 - DNA, 601 bp, Human
gagagtgtcttgctctctcaccctggctggagtgtggcggtgtgacgatagctcaacctcctgggctcaagcaatcctcccacctcagcctcccaagtagctggaactataggcatgcgcaaccaagccgaaatacttttttttttttttttgtagagacggtttcaccatgttgcccaggctggtcttgagctcctgggctcacgcgatcctcttgcctcttaaagtgctgggattacaggcgtgagctactgtgcctggccatgttgtggtttcagtacacacttacctaatgactaaycatattggatatcttttcatgtgcttattacccattcggaaaagttcttttgtgaatattttgggccccctccccccacctcttttttttgagaaagggtctccgttccccaggctggagtgcagtggcacaatcacggcttactgcagccttgaccttcctgactcaggcaatcctcctgcctcattctcctcaagtagctgggaccaccggagcgctccaccacacctggctaatttgattttttttttctttctttctttctttctttttttttttttttttggtagagacagggcc

SEQ ID NO: 112455 - DNA, 601 bp, Human
cgtgagctactgtgcctggccatgttgtggtttcagtacacacttacctaatgactaaccatattggatatcttttcatgtgcttattacccattcggaaaagttcttttgtgaatattttgggccccctccccccacctcttttttttgagaaagggtctccgttccccaggctggagtgcagtggcacaatcacggcttactgcagccttgaccttcctgactcaggcaatcctcctgcctcattctcctcaagtagctgggaccaccggagcgctccaccacacctggctaatttgattttttttttctttctttctttctttctttttttttttttttttggtagagacagggcctccttatattgcctaggctttttgcccaatttttattttgttttattttattttttgagacagagtatcactctgttgcccaggctggagtgcagtggcgtgatctcagctcactgcaacttccgcctcccgggttcaagcgattctcctgcctcagcctcttgagtagccaggaatacaggcaagcacaaccacacctggcttattttttgtatttttagtagagatgggatttcaccatg

SEQ ID NO: 112456 - DNA, 601 bp, Human
ttttttttggtagagacagggcctccttatattgcctaggctttttgcccaatttttattttgttttattttattttttgagacagagtatcactctgttgcccaggctggagtgcagtggcgtgatctcagctcactgcaacttccgcctcccgggttcaagcgattctcctgcctcagcctcttgagtagccaggaatacaggcaagcacaaccacacctggcttattttttgtatttttagtagagatgggatttcaccatgttggccaggctggtctccagctcctggcctcaagtyatatgcccgtctcagcctcccgaagtgctgggattacaggcgtgagctaccgtgcctggctccaatttttagttaggttgtttgtcttaatctgtaagagttctttagattctaaatattaattttttgttggatatatgtttcacaaatattttccctagtttgtggcttgccttctaattttcataacagtatctttgcagaacaaaaatttttcattttgatgaagtccaacttgctgatttttaagtatgtgaatttaagtaaaagtcataatcatacctacagtttttcttctaa

SEQ ID NO: 112457 - DNA, 601 bp, Human
tttttgcccaatttttattttgttttattttattttttgagacagagtatcactctgttgcccaggctggagtgcagtggcgtgatctcagctcactgcaacttccgcctcccgggttcaagcgattctcctgcctcagcctcttgagtagccaggaatacaggcaagcacaaccacacctggcttattttttgtatttttagtagagatgggatttcaccatgttggccaggctggtctccagctcctggcctcaagttatatgcccgtctcagcctcccgaagtgctgggattacaggygtgagctaccgtgcctggctccaatttttagttaggttgtttgtcttaatctgtaagagttctttagattctaaatattaattttttgttggatatatgtttcacaaatattttccctagtttgtggcttgccttctaattttcataacagtatctttgcagaacaaaaatttttcattttgatgaagtccaacttgctgatttttaagtatgtgaatttaagtaaaagtcataatcatacctacagtttttcttctaaaggatgttagtcaatcttcaaataagcatgaataactagat

SEQ ID NO: 112458 - DNA, 601 bp, Human
caaccacacctggcttattttttgtatttttagtagagatgggatttcaccatgttggccaggctggtctccagctcctggcctcaagttatatgcccgtctcagcctcccgaagtgctgggattacaggcgtgagctaccgtgcctggctccaatttttagttaggttgtttgtcttaatctgtaagagttctttagattctaaatattaattttttgttggatatatgtttcacaaatattttccctagtttgtggcttgccttctaattttcataacagtatctttgcagaacaaaartttttcattttgatgaagtccaacttgctgatttttaagtatgtgaatttaagtaaaagtcataatcatacctacagtttttcttctaaaggatgttagtcaatcttcaaataagcatgaataactagatttaagaataaaaaattgttttttgtagttgttttcttgaggtaaaccttttatttcctttatctttcctgtgtaatatctttgcagtaattccttgtctcacacatactatgtttatttctgataggttgagttgaaccaaatttttgtaaattatatttattttagctt

SEQ ID NO: 112459 - DNA, 601 bp, Human
atgcctttaatcccagctacttgggaggctgaggcaggagaattgcttgaacccgggaggcggaggttgcggcgagccgagatcacgccactgcactgcagcctgggcaacgagcgcgagactctatctcaaaaaaaaaaaagaaaaaagaaaaaaatgaaatttgctgaaaagttgcaagaaagcacagttgataaacctatgcccttcacctagattcatcactaatattttttatacctgattttaaaaaatctttttagacttacagaaaatttgcaaaaatattagagaatccctmtatacctttcaccaagtttcccctaatgttaacatcttcttttttgtttgtttgttttttttgagatgaagcctagctctgttgcccaggctggagtgcagtcagtggcacgatcttggctcactgcaacctccgcctcccgggttcaagcgattctgtagcctcagcctcctgagtagctgggattacaggcgcccaccaccacgcccagctaatttttgtatctttagcagagatggggtttcactgtgttggccggggtggtcttgaactcctgacctcgtgatccgcctgccttgg

SEQ ID NO: 112460 - DNA, 601 bp, Human
aaaaaaaagaaaaaagaaaaaaatgaaatttgctgaaaagttgcaagaaagcacagttgataaacctatgcccttcacctagattcatcactaatattttttatacctgattttaaaaaatctttttagacttacagaaaatttgcaaaaatattagagaatccctctatacctttcaccaagtttcccctaatgttaacatcttcttttttgtttgtttgttttttttgagatgaagcctagctctgttgcccaggctggagtgcagtcagtggcacgatcttggctcactgcaacctcygcctcccgggttcaagcgattctgtagcctcagcctcctgagtagctgggattacaggcgcccaccaccacgcccagctaatttttgtatctttagcagagatggggtttcactgtgttggccggggtggtcttgaactcctgacctcgtgatccgcctgccttggcctcccaaagtgctgggattacaagcgtgagccaccgtgcctggcctaatgttaacatcttatataaccatagccacattatcaaaatcaggaaattaatatagaatcagtactgttaactgattcacagtcct

SEQ ID NO: 112461 - DNA, 601 bp, Human
ccaggcttgatgaaaggaatcaagtggtgtctagatgtactgtcagagacacacctgtttttttcactatttgaggccttaagagaaacgtttgaaaactttagtcatatgccagaacttagcatttttgaggaagttttagcatggatggggaatgatttgttttcccccatgccagaagtcatcacacctttggtttagtgttgagaacagagtgcagatttgtagcagcagctgtttgaaaatactagttcatggtggagattgcagtgagccaagatcatgccactgcactctagcycaggcgacagagccagaccctgtgtaaaaaaaaaaaaattttttttttttttttgagagagagtcttgcactgtcacctgggctagagtgcagtgacgccatcttgggtcactgcaacctccgcctcccaggttcacacgattctcctgcctcagtctcctaagtagctgggattacaggtgcccaccaccatacccggctaattttttgtatttttagtagagatggggtttcaccatgttggccagactgctcttgaactcctgacctcgtgatccgctggcctcggcctccaaaagt

SEQ ID NO: 112462 - DNA, 601 bp, Human
aaaaaaaattttttttttttttttgagagagagtcttgcactgtcacctgggctagagtgcagtgacgccatcttgggtcactgcaacctccgcctcccaggttcacacgattctcctgcctcagtctcctaagtagctgggattacaggtgcccaccaccatacccggctaattttttgtatttttagtagagatggggtttcaccatgttggccagactgctcttgaactcctgacctcgtgatccgctggcctcggcctccaaaagtgctgggaatacaggcgtgagccactggccctttcttttttcttttttttgagacggagtcccgctctgtcatcctggctagagtggtgcagtggcgcaatcttggctcactgaatcctccgcctcctgggttcaagtgattctcctgcctcagcctcctgagtagctgggattacaggtgcatgccgccatgcccagctaattttttgtattttagtagagacggagtttcaccatgttggccaggctggtctcgaacttctgggctcaggcaatccacccaccttggcctcccaaagttctgggattacaggcatgagccactgcgtctg

SEQ ID NO: 112463 - DNA, 601 bp, Human
ggagttcaagaccagcctggccaacatggcaaaaccccatctctactaaaaatacaaaaattggccgggtacgatgcctcacacctgtaatcccagcacttggggagactgaggtgggcatatcacgaggtcaaggtcaggagatcgagaccatcctgtctgactggtgaaaccccgtctactaaaaatacaaaaaattagcccggtgtagcaacgtgcacctatagtcccaggtacttggaaaattgaggcaggagaatcgcttgaacctgggaggcagaggttgcagtgagccgagatygtgccactgcactccagcctgggcgacagagtgagactccgtctccaaaaaaaaaaaaaaatacaaaaattagctgggcatgatggtgcatgcctgtagttctagctactcaggaggctgaggcacgagaatggcttgaacccgggaggcggaggttgcagtgagatgagttcaagccactgcactccagcttgggcaggagagagagactctgtctcaaaaaaaaaaaatttttttttattcttatacacactgaacacctgtaatgttctagcactctagttttgtttttgttttatc

SEQ ID NO: 112464 - DNA, 601 bp, Human
cagagagaggttttttgtttttttctgtttgtttgttttgagccatagtctcaccctgtcgcccaggctggagtgcaatggtgtgatctcgctcttctccacctccccggttcaagcgattctcctgcctcagttcctgaatagctggaattacaggtgtggccaccacacctggctaattttttgtatcttagtagagacagggtttcactatgttggacaggctggtctcgaactcctgaccttgtgatccacctgccttgacctcccaaagtgctgggattacaggtgtgagccaccrtgtgcctggcccaaaaagtttttaaatgttcagaagggcttggtttatcagctgaagactggttttattccatttttattgtttttttccttcttcaagcaaatctgtctctcagtggcaataaatgtcatctgttcatccatacttaacagtcctcctctcctttgatgactggcatagtaagtgttattaatgacagacttgagtaagtttagtgaaatgcccagatcttcaggaattcagtaggctctagtaagatgctatacacagtgaaatttttcccgtcttagaactaactcc

SEQ ID NO: 112465 - DNA, 601 bp, Human
aattacaggtgtggccaccacacctggctaattttttgtatcttagtagagacagggtttcactatgttggacaggctggtctcgaactcctgaccttgtgatccacctgccttgacctcccaaagtgctgggattacaggtgtgagccaccatgtgcctggcccaaaaagtttttaaatgttcagaagggcttggtttatcagctgaagactggttttattccatttttattgtttttttccttcttcaagcaaatctgtctctcagtggcaataaatgtcatctgttcatccatacttaacagtcctcctctcctttgatgactggcatagtaagtgttattaatgacagacttgagtaagtttagtgaaatgcccagatcttcaggaattcagtaggctctagtaagatgctatacacagtgaaatttttcccgtcttagaactaactccaaaaaataaataaatatatttgatttttcagatgtaatttagatgccagaaggagaccagaattggggtctgtttctgctgtttagccttacacatgactcttcaagtctgtttcttcatcttcaaagtgtaaaaaataatggtacct

SEQ ID NO: 112466 - DNA, 601 bp, Human
tacaggtgtgagccaccatgtgcctggcccaaaaagtttttaaatgttcagaagggcttggtttatcagctgaagactggttttattccatttttattgtttttttccttcttcaagcaaatctgtctctcagtggcaataaatgtcatctgttcatccatacttaacagtcctcctctcctttgatgactggcatagtaagtgttattaatgacagacttgagtaagtttagtgaaatgcccagatcttcaggaattcagtaggctctagtaagatgctatacacagtgaaatttttccygtcttagaactaactccaaaaaataaataaatatatttgatttttcagatgtaatttagatgccagaaggagaccagaattggggtctgtttctgctgtttagccttacacatgactcttcaagtctgtttcttcatcttcaaagtgtaaaaaataatggtacctagttcctagggctgtttgaaagaataaacagaataataccatgtaaaatgcctaccactgtgttcagagcataatgcgtacctaagacattgtttaaaacaaaaggaaatccctgcatgcatggggtctgtgttt

SEQ ID NO: 112467 - DNA, 601 bp, Human
cctctggaataagtgtggtgttaagggtgggaagtcctcctgtagccagtgtgggtagcctctagaagctgatgccttctatgaggcagaatcgattggttccaaatagcccaaaagagtacatacataaaaagatgaaattgacaaggcgttttctttttatatacttgctttatttttttttttttaacagtgtcttccatgaagaaatgatgaagatgcgacaggctaagctggattatcaggtgagcagagtctcctcttttgaaataggtggccaactatactgaccgtgatgctsatggtcttggctctgaagcctttggcagggctatggaaagaagactggaaaggagaaggctcgggtggttacctgtgaagcagtgtctggagttagtggttgctgaaccaaggctctggctatggcaagaccaaagtgctttgaggatgtcagcaacaagactggccttggatttacaatcaccaaaaattccttggcgcctttctttctgaggaattagaagagtgttaacattgtatttctgtgtagtaatttggttctgctaccttaagtacctctctacgatgtcatttcacttaa

SEQ ID NO: 112468 - DNA, 601 bp, Human
aagctgatgccttctatgaggcagaatcgattggttccaaatagcccaaaagagtacatacataaaaagatgaaattgacaaggcgttttctttttatatacttgctttatttttttttttttaacagtgtcttccatgaagaaatgatgaagatgcgacaggctaagctggattatcaggtgagcagagtctcctcttttgaaataggtggccaactatactgaccgtgatgctgatggtcttggctctgaagcctttggcagggctatggaaagaagactggaaaggagaaggctcggktggttacctgtgaagcagtgtctggagttagtggttgctgaaccaaggctctggctatggcaagaccaaagtgctttgaggatgtcagcaacaagactggccttggatttacaatcaccaaaaattccttggcgcctttctttctgaggaattagaagagtgttaacattgtatttctgtgtagtaatttggttctgctaccttaagtacctctctacgatgtcatttcacttaactgcaagatggtgttcttatgcgaaaatgcatatccgagcttgctgccgtgctgctttcaaatct

SEQ ID NO: 112469 - DNA, 601 bp, Human
acaggctaagctggattatcaggtgagcagagtctcctcttttgaaataggtggccaactatactgaccgtgatgctgatggtcttggctctgaagcctttggcagggctatggaaagaagactggaaaggagaaggctcgggtggttacctgtgaagcagtgtctggagttagtggttgctgaaccaaggctctggctatggcaagaccaaagtgctttgaggatgtcagcaacaagactggccttggatttacaatcaccaaaaattccttggcgcctttctttctgaggaattagaakagtgttaacattgtatttctgtgtagtaatttggttctgctaccttaagtacctctctacgatgtcatttcacttaactgcaagatggtgttcttatgcgaaaatgcatatccgagcttgctgccgtgctgctttcaaatctccatcgcagggccgggcgcagtggctcacgcctgtcatcccagcactgtgggaggccgaggcaggcagatcacgaggtcaggagatcgagaccatcctggctaacacggtgaaacccagtctctactaaaaaatacaaaaaattagccgggcatggtg

SEQ ID NO: 112470 - DNA, 601 bp, Human
ctttggcagggctatggaaagaagactggaaaggagaaggctcgggtggttacctgtgaagcagtgtctggagttagtggttgctgaaccaaggctctggctatggcaagaccaaagtgctttgaggatgtcagcaacaagactggccttggatttacaatcaccaaaaattccttggcgcctttctttctgaggaattagaagagtgttaacattgtatttctgtgtagtaatttggttctgctaccttaagtacctctctacgatgtcatttcacttaactgcaagatggtgttcttakgcgaaaatgcatatccgagcttgctgccgtgctgctttcaaatctccatcgcagggccgggcgcagtggctcacgcctgtcatcccagcactgtgggaggccgaggcaggcagatcacgaggtcaggagatcgagaccatcctggctaacacggtgaaacccagtctctactaaaaaatacaaaaaattagccgggcatggtggcgggcacctctagtcccagctactcaggaggctgaggcaggagaatggcgtgaacccaggaggcggagcttgcagtgaggcgcagcttgcagtgag

SEQ ID NO: 112471 - DNA, 601 bp, Human
aaaggagaaggctcgggtggttacctgtgaagcagtgtctggagttagtggttgctgaaccaaggctctggctatggcaagaccaaagtgctttgaggatgtcagcaacaagactggccttggatttacaatcaccaaaaattccttggcgcctttctttctgaggaattagaagagtgttaacattgtatttctgtgtagtaatttggttctgctaccttaagtacctctctacgatgtcatttcacttaactgcaagatggtgttcttatgcgaaaatgcatatccgagcttgctgccrtgctgctttcaaatctccatcgcagggccgggcgcagtggctcacgcctgtcatcccagcactgtgggaggccgaggcaggcagatcacgaggtcaggagatcgagaccatcctggctaacacggtgaaacccagtctctactaaaaaatacaaaaaattagccgggcatggtggcgggcacctctagtcccagctactcaggaggctgaggcaggagaatggcgtgaacccaggaggcggagcttgcagtgaggcgcagcttgcagtgagcagagcaagactccgtctcaaagaaaaaa

SEQ ID NO: 112472 - DNA, 601 bp, Human
gtgtctggagttagtggttgctgaaccaaggctctggctatggcaagaccaaagtgctttgaggatgtcagcaacaagactggccttggatttacaatcaccaaaaattccttggcgcctttctttctgaggaattagaagagtgttaacattgtatttctgtgtagtaatttggttctgctaccttaagtacctctctacgatgtcatttcacttaactgcaagatggtgttcttatgcgaaaatgcatatccgagcttgctgccgtgctgctttcaaatctccatcgcagggccgggcrcagtggctcacgcctgtcatcccagcactgtgggaggccgaggcaggcagatcacgaggtcaggagatcgagaccatcctggctaacacggtgaaacccagtctctactaaaaaatacaaaaaattagccgggcatggtggcgggcacctctagtcccagctactcaggaggctgaggcaggagaatggcgtgaacccaggaggcggagcttgcagtgaggcgcagcttgcagtgagcagagcaagactccgtctcaaagaaaaaaaaaatctccatcgcatagagaataattttcttca

SEQ ID NO: 112473 - DNA, 601 bp, Human
gccttggatttacaatcaccaaaaattccttggcgcctttctttctgaggaattagaagagtgttaacattgtatttctgtgtagtaatttggttctgctaccttaagtacctctctacgatgtcatttcacttaactgcaagatggtgttcttatgcgaaaatgcatatccgagcttgctgccgtgctgctttcaaatctccatcgcagggccgggcgcagtggctcacgcctgtcatcccagcactgtgggaggccgaggcaggcagatcacgaggtcaggagatcgagaccatcctgrctaacacggtgaaacccagtctctactaaaaaatacaaaaaattagccgggcatggtggcgggcacctctagtcccagctactcaggaggctgaggcaggagaatggcgtgaacccaggaggcggagcttgcagtgaggcgcagcttgcagtgagcagagcaagactccgtctcaaagaaaaaaaaaatctccatcgcatagagaataattttcttcatagagctgctggcacatttagtttgttttctccattacactaagctctgtgagaacagagccaagcatgttttggataacca

SEQ ID NO: 112474 - DNA, 601 bp, Human
ggacattctccctgccttagtgctagagacatagggtagatcttgttctttcccttaacacgttctttttttttttcttcttcttcttttgagacagtctccctctgtcgccaggctggagtgcagtggcacgatctcggctcactgcaacctctgcctctgtgcccagccagtttttccacattcttaccaacacttgttattgtctgtctgtgatttagagccattctagtgggtgtgaagtggtatctcattgtagttttgatttgcattaccctaatgactaattatgttgagtttttgtgtgtgtgtgtgtgtgtgtgtgtgtgtgtgtggtggccttttatttttttttatttttttgagataggttctcactctgtcacccaggctggagtgcagtgatacggtcatagctcactgaagtcttgacctcctgggctcaagcgatcctcccaccccagcctcccaagtagctgagactacaggcatgcacgaccacacttggctaatttttcttttttcttttcttcttcctgtatttagagatgggatcttgcagtgttgcccaggctggtctcaaacttgtgacttcaagtga

SEQ ID NO: 112475 - DNA, 601 bp, Human
tgcccggcctctgtggtttacttctaaaactgacgtataataattgtacatatttatggggtacacatgatatttgatatttgatacatgcacacaacgtgtaatgatcaaattattgtaatgatcatgttatttaaggtatccatcacctcaaacatttgtcatttctttgtgttgggaacatttcaaatcttctagctattttgaaatatacaataaataattctttttttttttttttttttgagacggagttttgctcttgtcgcccaggctggagtacaatggcgcaatcttggcycactgcaacctctgcctcccaggttcaagcagttctcctgcctcagcctcctgagtagctgggattataggcatgtgccaccacgcccagctaattttgtatttgtagtagagacagggtttctccatgttggttaggctggtctcgaactcccgacctcaggtgatctgctcgcctcagcctcccaaagtgctgggattacaggcatgagctaccactcccagccaataaattattcttaactatagtcaccctcttgtgctattgaacactagaacatatttcttctgtctaactgta

SEQ ID NO: 112476 - DNA, 601 bp, Human
tctgtggtttacttctaaaactgacgtataataattgtacatatttatggggtacacatgatatttgatatttgatacatgcacacaacgtgtaatgatcaaattattgtaatgatcatgttatttaaggtatccatcacctcaaacatttgtcatttctttgtgttgggaacatttcaaatcttctagctattttgaaatatacaataaataattctttttttttttttttttttgagacggagttttgctcttgtcgcccaggctggagtacaatggcgcaatcttggctcactgcaamctctgcctcccaggttcaagcagttctcctgcctcagcctcctgagtagctgggattataggcatgtgccaccacgcccagctaattttgtatttgtagtagagacagggtttctccatgttggttaggctggtctcgaactcccgacctcaggtgatctgctcgcctcagcctcccaaagtgctgggattacaggcatgagctaccactcccagccaataaattattcttaactatagtcaccctcttgtgctattgaacactagaacatatttcttctgtctaactgtatgtttgaat

SEQ ID NO: 112477 - DNA, 601 bp, Human
gttttcttggtctcattcttaagtttctgaagtacatattacttcagttactgaagtacaagtacatatgactttagtaacagagcatgttaataaaatgaacaccaggctgggcgtggtggcttatacctgtgatcccagcactttgggaggccagaaaggcagatcacttaaggccaggtgtttgagactagcctgggcaacataacaagactccatctctacaaaaaaattaacaattagccaggtgtagtagcacacacctgtagtcccagctactcgggggactgaagtgggaggmtcgtttgagcctaggaagtcgaggctacagtgagctgtgattacaccactgctctccagcctgggtgacagagtgagatcctgtctcagaaaaaaagaacaccagttctgaccttctctcttaacaaatgttcttatggatgttaagaaaggagggcagataaaatgatttggtagttcttaattctgatcacatacgccaaatctacccaactagtgaataatactttgctccttttttaaaattcattttattttggcccttaggtattgatggtccagctgctgtcctgaaaccaga

SEQ ID NO: 112478 - DNA, 601 bp, Human
tagtcccagctactcgggggactgaagtgggaggatcgtttgagcctaggaagtcgaggctacagtgagctgtgattacaccactgctctccagcctgggtgacagagtgagatcctgtctcagaaaaaaagaacaccagttctgaccttctctcttaacaaatgttcttatggatgttaagaaaggagggcagataaaatgatttggtagttcttaattctgatcacatacgccaaatctacccaactagtgaataatactttgctccttttttaaaattcattttattttggcccttaggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatggtgaggactggtaatgattttaaggcaatttgtctccttactcaattgtaatcttttcctttcttttcattgtgggtaacaatctacatgactgaaaatgactcatggcttagggcctcacagaggtgacagtgtttagcatcttttacatctgaatgt

SEQ ID NO: 112479 - DNA, 601 bp, Human
tccaagccaggacttcaggagcgtctccaaaagcatggtgaggactggtaatgattttaaggcaatttgtctccttactcaattgtaatcttttcctttcttttcattgtgggtaacaatctacatgactgaaaatgactcatggcttagggcctcacagaggtgacagtgtttagcatcttttacatctgaatgttggtaattgtcagcaatggtagtatttatactgttgcctgagaaaaagaagataattaaatataaaatactagctgccatagatggccatagatgactgtttgtytctttttgactattttcagttcccaccctcttcttctgacagagttgtcactcaacccctctactccacctccatttcatagttggtgatgattgatagcctttcttctagttggagctctcatttccataaatattcccatacatttcaaaggtcccttgtagtcttctttcctttttagaaaaataattttttttttttttttttttgagacaaagtctcactctgtcgcgctggctggagtgcagtgacgcgatctcggctcactgcaagctccgcctcccgggttcacgccattct

SEQ ID NO: 112480 - DNA, 601 bp, Human
tgtttgtctctttttgactattttcagttcccaccctcttcttctgacagagttgtcactcaacccctctactccacctccatttcatagttggtgatgattgatagcctttcttctagttggagctctcatttccataaatattcccatacatttcaaaggtcccttgtagtcttctttcctttttagaaaaataattttttttttttttttttttgagacaaagtctcactctgtcgcgctggctggagtgcagtgacgcgatctcggctcactgcaagctccgcctcccgggttcacrccattctcctgcctcagcctcctgagtagctgggactacaggcgcccgccaccacgcctggctaattttttgtatttttttagtagagacggggtttcacggtgttagccaggatggtatcaatctcctgacctggtgatccgcccgcctcggcctcccaaagtgctagctaggattataggcgtgagccaccacgcccagccgaaaaataattttataatgagaagggattaagcatcccctttgcagatgagaaaactgaagcccaataatgaatatgtattgggtacctactttgca

SEQ ID NO: 112481 - DNA, 601 bp, Human
caagagtgaaacttctcaaaaaaaaaaaaaaagaaaagaaaaagaaagtatgttttgagtccaggcatggtggctcatgcctataatcctaacactctgggaggctgaggcgggcagatcacttgagtccaagggttcaagaccagcctgggcaacatggagaaaccttgtctctacaaaaaatgcaaaaaaaaaaaaattgtctgggtgcagtggcgcacacctgtagtcccagctacttggggggctgaggcaggaggatggcttgagcctgggaagtggaggttgcactaagcttgcrattgcaccactgcactccagcctgggttacagagcaggaccccgtctcaacaacaacaacaacagaagtaaagtaagaaaatatgtttgagtacataccatatctgaggcaacattctaggtacttaggatacatgagtaagcatggttcctgccctcatggagcgcttattctaattgaagcttcatgcacttaaataggctagagctagaaaatcaaggtgctgagagagcctgacgcctcactccacttggacactttcccagagaaagtgatatttgagctagtgcctgactcagg

SEQ ID NO: 112482 - DNA, 601 bp, Human
aatagaaggctggacatggtggctcacatgtgtaatcccagcactttaagaggctgaggtgggagtattgcttgaagttaggtgttcaggaccagccagggcaacatagcaagacccagtctctaacaaaaaaaaatttttaattagctgggtgtggtggtacacactggtagtcccagctacttgagaggttgtgctaggaggattgctcgagcccaggttattgaggatgcagtgagctatgatcatgccacagcactccagcctgggtgacagaatgaaaccatgtctttaaaaattwaaaaaaaaaaaaaattgggttgggtggagtggctcatgcctataaccccagcactttgggaggctgaggtgggaggattgcttgagccccagagttcgaggctgcagtgagccaagattgtgctgctgcattccagcctgtgtgtagagtgagaccctgtctcaaaaaataaaaattaaaaataaaaattaattaaaaaaaaatagggctgggcgctatggcttatgcctgtaatcccagcactttgggaggccgacacgggcggatcacaaggtcaggagatcaagaccatcctggcta

SEQ ID NO: 112483 - DNA, 601 bp, Human
attagccaggtgtggtggcgggcgcctgtagtcccagctactcgggaggttgaggcacgagaatggcgtgaacccgggaggcggagcttgcagtgagccgagatcacgccactacactccagcctgggcgacggagcaagactccgtccgtctcaaaaaaaaaaagagcagtaagaacctgtgaggaattttaagctgaacaatgatatgatcacagttgagctgtggaaaaattactgtgtaccagaaagaaggaattgaagggggaagtccagaaacaggaaagctatttaggagatcrtttgattgatgatggcctgacctccagttccaatatagtgtggtgtttgcaaaagcacaggcaggggagatgcagaattgctctgctagggcaatgagaagagacaagagaggtaccaggaggaagggagggggtgattccgctgaacaaagaaggatgtgtgtctgcctacgtgctaggggagcagggaagtagctggagcctgacattgtgagtgtccatcatgtgtcaggcacttgacatgtactacctcatctgatttaatagttgtaatagtgccttgggggtttgtaaagacag

SEQ ID NO: 112484 - DNA, 601 bp, Human
agttgtaatagtgccttgggggtttgtaaagacagttttcctgtctttaacatgaaggtgaccatggtactttcctattattttactaccactatttttacaacaaaagaaagtgaaagatatgcgttggacagataggatgagtcggagcaaaaataattttctatttaaccaaagctaaattactcaccctgagtcaactagctgaaaagtggcagatttagattttctgattcttagtctggttctttatccctgactgtaaacaccacactgtctccttgtgcactgctctatgaartggctgttcgttttcagaattggccttccagtgccaggtgagttaacgccttttcatgtctcaacaggttgcatcttgactataaaacccattaagtgctgttttgattaaattctaagaagtgtcagtttggcagattatgtccctgtaagtgggtccaatttgcttgtcttaaaagtttcagagagatctttgatctctcaagacagattcacgggaactgagttcttggtattaaaatggcatttgaaagcatagtaataggtgaagatagccatacgatagtgatatctcaggagt

SEQ ID NO: 112485 - DNA, 601 bp, Human
gataaaccacattttgttgatcagctgatggacgtttgattgttcccactttccctgttaggaataatgttgttatcaacactcataagtttttgtatggacctatgttttcagttgagactgattttttttttttttttttgagaccaagtcttgctctgtcgcccaggctagagtgcagtgatgtgatctcggctcactgcaacctctgcttcctgggttcaagggattctcttgcctcagcctcctgagtagctgggactacaggtgcctggctaatttttgcatttttagtagagayagggtttcaccttattggccaggctgatctcgaatttctgaccttgtgatccacccatttcggcctcccaaagtgctgggattacaggcatgagccactgcgcccggcctgagattgatttttttaaaactgacctttgtcttatccttgtgttcttcagtaaagctaataccaatctatgtatgtaccgtataaaaatagatcatttttctttccgagatgttgaatgtgcacaaaaagtggttcagagaaaaaagccacacttgttaattccatctgtaaatctatgattcaaggacc

SEQ ID NO: 112486 - DNA, 601 bp, Human
aatgccggggggccagccatggtggctcacgcctataatcccagcactttgggaggcttaggcggacagatcacctgaggttgggagttcgaggccagcctgaccaacatggagaaaccccgtctctactaaaaataaaaaattaaccggatgtggtggcacatgcctgtaatcccagctactcgagaagctgaggcaggagaatcgcttgaacctaggaggcggaggttgcggtgagcccagattgcaccattgcactccaccctgggcaacgagagcgaaactccatctcaaaaaaaawaaataaataaaataaaaagaaaatgctgaggggaataaaactgctgtaaagaataatgcatcattgaattttttttttactgtggtaaaatatgcatcgtaacatagaagttaccagtgttggcctggcatgttggctcacacctgtaatcccagcactttgtgaggccaaggtgggcagatcacctgaggtcaggagtttgagaccagcctgaccaacatggtgaaacccagtctctactaaaaatacaaaaaaattagctgggcttcgtggcgcacacctgtaatcccagctaccggg

SEQ ID NO: 112487 - DNA, 601 bp, Human
ggtgagcccagattgcaccattgcactccaccctgggcaacgagagcgaaactccatctcaaaaaaaaaaaataaataaaataaaaagaaaatgctgaggggaataaaactgctgtaaagaataatgcatcattgaattttttttttactgtggtaaaatatgcatcgtaacatagaagttaccagtgttggcctggcatgttggctcacacctgtaatcccagcactttgtgaggccaaggtgggcagatcacctgaggtcaggagtttgagaccagcctgaccaacatggtgaaacccwgtctctactaaaaatacaaaaaaattagctgggcttcgtggcgcacacctgtaatcccagctaccggggaggctgagacaagagaattgcttgaacccaggagacggaggttgcagtgagctgagatggtgccactgcactccagcctgggcaacagagtgagactccatctcaaaaaatcataataatttaccagtgctgcagctctttttagaatttgtctagcaagttttcctgtttttactgaagccttcccttcccttccaaataacaaaaagtacacttttttttttttaagag

SEQ ID NO: 112488 - DNA, 601 bp, Human
ataacaaaaagtacacttttttttttttaagagttcgggtgggccgagacgggcggatcacgaggtcaggagatagagaccatcctggctgacacggtgaaaccccgtctctactaaaaatacaaaaattagccgggcatggtggcgcgcgcctgtagtcccagctacttgggaggctgaggcaggagagtggcgtgaacccgggaggcggagcttgcagtgagtcgagatcgcgccactgcgctccagcctgggcgacagagcgagactccgtctcaaaaaaaaaaagagttcgggtgtmattctgtcacccaggctggggtgcagtggcacaagcatagctcactttagcctcaaaatcctgggcttaagtgatccaaccacctcagctagctaggactacagacacacaggtaccatcgtgaccagctaatttttttaaaaaaactttttatggagacaggtctcaaactggtggcctcaagcagtccttctgcctcagcctcccaaagtgctaggagttcaagcacgagccactgtgccctgcctaaattttttttgttttgtttttttgagacagagtctctgtctcccaggctat

SEQ ID NO: 112489 - DNA, 601 bp, Human
ccatcctggctgacacggtgaaaccccgtctctactaaaaatacaaaaattagccgggcatggtggcgcgcgcctgtagtcccagctacttgggaggctgaggcaggagagtggcgtgaacccgggaggcggagcttgcagtgagtcgagatcgcgccactgcgctccagcctgggcgacagagcgagactccgtctcaaaaaaaaaaagagttcgggtgtaattctgtcacccaggctggggtgcagtggcacaagcatagctcactttagcctcaaaatcctgggcttaagtgatccarccacctcagctagctaggactacagacacacaggtaccatcgtgaccagctaatttttttaaaaaaactttttatggagacaggtctcaaactggtggcctcaagcagtccttctgcctcagcctcccaaagtgctaggagttcaagcacgagccactgtgccctgcctaaattttttttgttttgtttttttgagacagagtctctgtctcccaggctatagtacagtggcacagtctcggctcgctgcaagctccgcctcccaggttcaagtgattctcctgcctcagcctcctgagt

SEQ ID NO: 112490 - DNA, 601 bp, Human
agtggcgtgaacccgggaggcggagcttgcagtgagtcgagatcgcgccactgcgctccagcctgggcgacagagcgagactccgtctcaaaaaaaaaaagagttcgggtgtaattctgtcacccaggctggggtgcagtggcacaagcatagctcactttagcctcaaaatcctgggcttaagtgatccaaccacctcagctagctaggactacagacacacaggtaccatcgtgaccagctaatttttttaaaaaaactttttatggagacaggtctcaaactggtggcctcaagcagkccttctgcctcagcctcccaaagtgctaggagttcaagcacgagccactgtgccctgcctaaattttttttgttttgtttttttgagacagagtctctgtctcccaggctatagtacagtggcacagtctcggctcgctgcaagctccgcctcccaggttcaagtgattctcctgcctcagcctcctgagtagctgggactacaggtgcgtgccaccacacctggctaattttttgtattttagtagagatggggtttcaccatgttagccaggatggtctcaatctcctgacttcgtga

SEQ ID NO: 112491 - DNA, 601 bp, Human
tgctgggattacaggcatgagccaccgcgcccagcctgccctgcctaaaatttacaactttaatcaattttaagtgtgagattcagtgacattaagtgtattaacaatgttgtgcaaccatcactaccatccatctccagaactttttcatcatcccagagacttcacacccattcaagataattcctcattctcccctgcccccagcccctagtaacctctattctactttctgtctctatgaatttgcctgttttatgtatttggacaaaatagttgtgtttacggtcagaatagttargaatgttttaagcaagaaaattaaaactatctttgtttcaaagaccttttttaaacagtgttggcagtgctaacagttcttccttttctgctagatatctctgaaagtgtgaacttcgatgaggagactgatggaatatcccagtcagcatgtttagaaagacccaattctgcatcaagccagaattcaaccgtatgtagttctgaaacttcttccattagagctaatttgactctttctcaaacatatcttcagtatttatttatttattattattatgtattttttgaggtggagtct

SEQ ID NO: 112492 - DNA, 601 bp, Human
ttatttatttattattattatgtattttttgaggtggagtctcgctctgtcacccaggctggagtgcagtggcatgatctcagctcactgcaaactccgcctcccgggttcacgccattctcctgcctcaatctcccgagtagctgggactacaggcgcccgccatgacacccggctaattttttgtatttttagtagagacagggtttcaccatgtttgccaggatggtctcgatctcctgacctcgtgatccgcccgcctcagcctcccaaagtgctgggattacaggcatgagccacmgtgcccagccctcaaacatatcttcagtatttaaataccattactgagtgagggttccttcagaagtgtaagctcaaatttagtttatgatctaattttttctgtctcaggtcagctattgtgaggctttgtcccattttgatacttactcttcattactctcaatattcatatacttaatttaacttttcagttttcctcattctgtcagaagactgaagacacgggtaaattactaagttgctttgtccactaagtgtttttcaaagagaatcagattttgagtctcggcctgttgtt

SEQ ID NO: 112493 - DNA, 601 bp, Human
acaggcgcccgccatgacacccggctaattttttgtatttttagtagagacagggtttcaccatgtttgccaggatggtctcgatctcctgacctcgtgatccgcccgcctcagcctcccaaagtgctgggattacaggcatgagccacagtgcccagccctcaaacatatcttcagtatttaaataccattactgagtgagggttccttcagaagtgtaagctcaaatttagtttatgatctaattttttctgtctcaggtcagctattgtgaggctttgtcccattttgatacttactyttcattactctcaatattcatatacttaatttaacttttcagttttcctcattctgtcagaagactgaagacacgggtaaattactaagttgctttgtccactaagtgtttttcaaagagaatcagattttgagtctcggcctgttgttgctcatgtatggctgtcctttcaggatacaggcacttccggttctgctactgccgcccaaccagctgataacctcctgggagacatagacgacctggaggactttgtgtatagtcctgcccctcaaggtgtcacagtaagatgtcggataa

SEQ ID NO: 112494 - DNA, 601 bp, Human
taatgatactaggtgttaattcttctaaccaccatttattgagtgtttacgacagaccaagcatatgcatatatatctatatatattatcacctgtaatccttgcagccaccttgttaggtaggatttcttatctctgctttaaagatgaggtaactggggcttagggagtgacttacctaccccacgttgcactaagtggtggcagagccaaattcaaacctattttgcataattctaaagtcttcctgcttagccactgccactctcctgcttccctattatggtcctagtctaggagrgtttaggaaggatgcctatataggatggtattcatgccattgaggtcacagtggtttaacacaacagcagtatagaaaaaagagtatttcctccctggagaggcttcccttttgtcccttcttgccctttgcctaatcagagtctttcctgatgtgcttcaccagatgtggttgacattcctctgtctgtgtccccatggcatgaagaaagctatcacaggccaggtgcggtggctcacacatatgatcccagcacttcgggaggctgaggcaggtggatcccttgaggacatgagctcg

SEQ ID NO: 112495 - DNA, 601 bp, Human
tcttcctgcttagccactgccactctcctgcttccctattatggtcctagtctaggagagtttaggaaggatgcctatataggatggtattcatgccattgaggtcacagtggtttaacacaacagcagtatagaaaaaagagtatttcctccctggagaggcttcccttttgtcccttcttgccctttgcctaatcagagtctttcctgatgtgcttcaccagatgtggttgacattcctctgtctgtgtccccatggcatgaagaaagctatcacaggccaggtgcggtggctcacacrtatgatcccagcacttcgggaggctgaggcaggtggatcccttgaggacatgagctcgagaccagcttggctaacatggggagaccctgcctctagcaaaaaattaaaaaattagccaggagtggtggcatgcacctgtagttccagctactcgggaggctgaggcaggaaaatcacttgaacctgggaggcagaggttgcagtgagctgtgattgcaccactgcactctagcctgggtgacagagtgagaccctatctcaaaaaaaaaaaaaaaaaaaagccatcacagtaaagaatgg

SEQ ID NO: 112496 - DNA, 601 bp, Human
tgtttaaaaaataataataatcggccgggcgtggtggctcacgcctgtaatcccagcactttgggaggccgaggccggtggatcacctgaagtcaggaggtggagaccagcctggccaacatggcaaaaacccgtctctactaaaaatacaaaaaaaattagccaggcgtggtggcaggcacctgtaatcccagctactcgggaggctgaggcaggagaatcgcttgaacccaggaggcagaggttgcaatgagccaagattgtgccactgcactccagcctgggtgacagagcaagacgmcatctcaaaataaaataagaataatctgcttggcttgacaggcatttttaatacctagtgcaggccttatttaaccacagctcattttcactgtatgtaatatagtgctatgccctcactgggaaataaatatgtgttggtgctgacaaagttgaacagtttgttcacagttatctcaaatcacatttaagactcaagagtaagaggccgggcgtggtggctcactcctgtagtcacagcaccttgggaggccaagatgggcggatcacctgaggtcgggaattcgagaccaacatggag

SEQ ID NO: 112497 - DNA, 601 bp, Human
gatcacctgaagtcaggaggtggagaccagcctggccaacatggcaaaaacccgtctctactaaaaatacaaaaaaaattagccaggcgtggtggcaggcacctgtaatcccagctactcgggaggctgaggcaggagaatcgcttgaacccaggaggcagaggttgcaatgagccaagattgtgccactgcactccagcctgggtgacagagcaagacgacatctcaaaataaaataagaataatctgcttggcttgacaggcatttttaatacctagtgcaggccttatttaaccacarctcattttcactgtatgtaatatagtgctatgccctcactgggaaataaatatgtgttggtgctgacaaagttgaacagtttgttcacagttatctcaaatcacatttaagactcaagagtaagaggccgggcgtggtggctcactcctgtagtcacagcaccttgggaggccaagatgggcggatcacctgaggtcgggaattcgagaccaacatggagaaaccccgtctcgactaaaaaaaaaaaaaaaatacaaaattagccgggtgtggtggcgcatgcctataatcccagctact

SEQ ID NO: 112498 - DNA, 601 bp, Human
cacctgaagtcaggaggtggagaccagcctggccaacatggcaaaaacccgtctctactaaaaatacaaaaaaaattagccaggcgtggtggcaggcacctgtaatcccagctactcgggaggctgaggcaggagaatcgcttgaacccaggaggcagaggttgcaatgagccaagattgtgccactgcactccagcctgggtgacagagcaagacgacatctcaaaataaaataagaataatctgcttggcttgacaggcatttttaatacctagtgcaggccttatttaaccacagctmattttcactgtatgtaatatagtgctatgccctcactgggaaataaatatgtgttggtgctgacaaagttgaacagtttgttcacagttatctcaaatcacatttaagactcaagagtaagaggccgggcgtggtggctcactcctgtagtcacagcaccttgggaggccaagatgggcggatcacctgaggtcgggaattcgagaccaacatggagaaaccccgtctcgactaaaaaaaaaaaaaaaatacaaaattagccgggtgtggtggcgcatgcctataatcccagctactcag

SEQ ID NO: 112499 - DNA, 601 bp, Human
aagaataatctgcttggcttgacaggcatttttaatacctagtgcaggccttatttaaccacagctcattttcactgtatgtaatatagtgctatgccctcactgggaaataaatatgtgttggtgctgacaaagttgaacagtttgttcacagttatctcaaatcacatttaagactcaagagtaagaggccgggcgtggtggctcactcctgtagtcacagcaccttgggaggccaagatgggcggatcacctgaggtcgggaattcgagaccaacatggagaaaccccgtctcgactaaaaaaaaaaaaaaaatacaaaattagccgggtgtggtggcgcatgcctataatcccagctactcaggctgaggcaggaaaattgcttgaacccgggaggcggaggttgtggtgagctgagattgtgccattatactccagcctgggcaacaagagtgaaactctggtcccaaaaaaaaaatagttaagagtaaactctcaagccaagagattctgttttaaatgtaggtgtttaaagaaggtataggccaggtgcagtggctcacgcctgtaatcccagcactttgggaggctgaggcag

SEQ ID NO: 112500 - DNA, 601 bp, Human
actgggaaataaatatgtgttggtgctgacaaagttgaacagtttgttcacagttatctcaaatcacatttaagactcaagagtaagaggccgggcgtggtggctcactcctgtagtcacagcaccttgggaggccaagatgggcggatcacctgaggtcgggaattcgagaccaacatggagaaaccccgtctcgactaaaaaaaaaaaaaaaatacaaaattagccgggtgtggtggcgcatgcctataatcccagctactcaggctgaggcaggaaaattgcttgaacccgggaggcrgaggttgtggtgagctgagattgtgccattatactccagcctgggcaacaagagtgaaactctggtcccaaaaaaaaaatagttaagagtaaactctcaagccaagagattctgttttaaatgtaggtgtttaaagaaggtataggccaggtgcagtggctcacgcctgtaatcccagcactttgggaggctgaggcaggcagatcacgaggtcaggagatcgagaccatcctagccaacttggtgaaaccccgtctctactaaaaatacaaaaaataattagccaggcgtggtggcatg

SEQ ID NO: 112501 - DNA, 601 bp, Human
tggctcactcctgtagtcacagcaccttgggaggccaagatgggcggatcacctgaggtcgggaattcgagaccaacatggagaaaccccgtctcgactaaaaaaaaaaaaaaaatacaaaattagccgggtgtggtggcgcatgcctataatcccagctactcaggctgaggcaggaaaattgcttgaacccgggaggcggaggttgtggtgagctgagattgtgccattatactccagcctgggcaacaagagtgaaactctggtcccaaaaaaaaaatagttaagagtaaactctcamgccaagagattctgttttaaatgtaggtgtttaaagaaggtataggccaggtgcagtggctcacgcctgtaatcccagcactttgggaggctgaggcaggcagatcacgaggtcaggagatcgagaccatcctagccaacttggtgaaaccccgtctctactaaaaatacaaaaaataattagccaggcgtggtggcatgcgcctgtagtcccaggctgaggcacaggaatcgcttgaacccaggaggtggagattggaggttgcagtgagctgagattgtgccactgcactccagcctg

SEQ ID NO: 112502 - DNA, 601 bp, Human
aaaaaatacaaaattagccgggtgtggtggcgcatgcctataatcccagctactcaggctgaggcaggaaaattgcttgaacccgggaggcggaggttgtggtgagctgagattgtgccattatactccagcctgggcaacaagagtgaaactctggtcccaaaaaaaaaatagttaagagtaaactctcaagccaagagattctgttttaaatgtaggtgtttaaagaaggtataggccaggtgcagtggctcacgcctgtaatcccagcactttgggaggctgaggcaggcagatcacraggtcaggagatcgagaccatcctagccaacttggtgaaaccccgtctctactaaaaatacaaaaaataattagccaggcgtggtggcatgcgcctgtagtcccaggctgaggcacaggaatcgcttgaacccaggaggtggagattggaggttgcagtgagctgagattgtgccactgcactccagcctggcgacagagcgtgactctgtctcaaaaaaaaaaagagaagtataaagagatataatattactttcctgtttttgattctgtttacagcaaagtaataaaattatttttg

SEQ ID NO: 112503 - DNA, 601 bp, Human
cctcccgagtagctgggattacaggcgcctgccaccacgcctggctaatttttgtatttttagtagagacagggtttcaccatgttggccaggctggtctcaaactcctgacctcaggttatctgcccacctcggcctcccaaagtgctgggattataggcgtgatccactgccccggctgatacagctgatattgtcagcatcttacattcccaagaaagtctcatgttataaaagaatgtggtctctatttttttcctgtttccaagttctgctttgttttcctatcttccaggaaacraacgtacttggatttaaaggtcctaggaaaatgtctgtgatcattcctggaatgacactgaatcataagcagatcccctatcagccacaaaacgtgagtaagaatgtatttaaatcagtgaaagactctaaaagacagtagtacaatacacagagattaatacaaaaaaaaaaaaaaagattgagcttccagagccccacactggagatagctccatacacttctttaggaaagctgcccctccaaaacctcaggataagagcagttgcagagtcattgccttgaaaccattttttctac

SEQ ID NO: 112504 - DNA, 601 bp, Human
attcttcgcttctggtttaccctttctgaaatggagaaagtattctcctactctaccttctacctcgtagagttggagttctcagtacaaagtaatgattttccctttggacagaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccgtaagcctccaggargggttgggtgggaagaggaggacagatgctcttacaggatgggaatgcacattccctgtacatgataggaagtgacagtcagcagataatcatggaggagagacaggatttctttggaaagatgaaactacagttttagagaaaacttgtaaatcactgtgttgaggaggggagaggagtgtgagagagatgctatagcaaatcagagaagttggctgggcaccatggctcacgtctgtaatcccagcactttgggaggccgaggtgggcagatcgcttgagaccagcctgggcaacatg

SEQ ID NO: 112505 - DNA, 601 bp, Human
ccgacaccagagtgagagatacaaggagagcctggtgtagcccccaccagcttcctggctgtgaacccttaggctgtggcctgaggaggtggggatgtggctctccacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatcycgcagcatcacgaagcgacgcgtgctgcgcagtgcgcagcggaagttggttttccagccggcgcgctccgcagtctcagcctcggggggcgggccacctcccctgctgctaggcggccacctgccgcgggccacagcccaggcctgaagagggggacagaacacgtgtgccgggcccgcggggtcctaggcgggctctcccacccggggcggggcggggctggggtccccaccttgaagatgcgcgcgtcggcctcgctcaggtccttgcgcgcgaagtgcttccagggcacgcggaaac

SEQ ID NO: 112506 - DNA, 601 bp, Human
gtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcctggctgtgaacccttaggctgtggcctgaggaggtggggatgtggctctscacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatctcgcagcatcacgaagcgacgcgtgctgcgcagtgcgcagcggaagttggttttccagccggcgcgctccgcagtctcagcctcggggggcgggccacctcccct

SEQ ID NO: 112507 - DNA, 601 bp, Human
gggagggggcctggggcttggagtccagcatgtgtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcctggctgtgaacccttakgctgtggcctgaggaggtggggatgtggctctccacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatctcgcagcatcacgaagcgacgcgtgctgcgcagtgcgcagcggaagttggttttccagccggcgcgctccgc

SEQ ID NO: 112508 - DNA, 601 bp, Human
cccagcagggagccctgggcctgaggaggggaggacagtgggaacggtggtcccctcctaattctccagctccccaatccccagcccccttctaaagtgtccgtccaggtgcactggcccctcccgcgctccccccctccccgggcacgcccacacctccagcacaggccccagtcaggggaagcccttcttgtccctctccaggagccttggttgggactggatctgccccccatgacgctgtcagcagatggtctgccaggcagctctgttgcactgcctggagcaggaggtccccctygtcaccagctggggcagggagggggcctggggcttggagtccagcatgtgtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcc

SEQ ID NO: 112509 - DNA, 601 bp, Human
gggctggggaatgctacctgctgggggtctgtggcccggacagctgggtctggggggccgtataggaacgtgcagctcgggtgtcccaccaccttctgcagcaccgtgcggcccttgtacatgatggtcacgtccagcgcccctgggctgggctctgtgtggagaccaagctgtgagtgacgggggtgggcggggacaggctgtgagtgacgggggtgggcggggacaggatgtgagtgacgggggtgggcggggacaggatgtgagtgatgggtgggcggggacaagccgtgagtgacgrgggtgggcggggacaggctgccccttcctgggatgcactcaccttgcaccgcggtgcaggcgcttggggagggtgacaggtacggctctgcctggtgcggggactctggggccgcggcctcgcctgcatccggaagggaatcctgtgctggcacctcatccctagcctctccctgtgccccaggcctcccaacccctacccctctcacctgtcgttagtgccgcgggctggggcccggggctgggggtcgtctctactgcccacccgtacagctccccagcagggagccctgggcctgag

SEQ ID NO: 112510 - DNA, 601 bp, Human
accttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcaggggcctcactgacctcggaagaagactctgaagtcgaagatgggggtgtcacagttccgaggcagcaggcaggctggggtggaggggctggcggagcctgggggkccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtataggaacgtgcagctcgggtgtcccaccaccttctgcagcaccgtgcggcccttgtacatgatggtcacgtccagcgcccctgggctgggctct

SEQ ID NO: 112511 - DNA, 601 bp, Human
tcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcaggggcctcactgacctyggaagaagactctgaagtcgaagatgggggtgtcacagttccgaggcagcaggcaggctggggtggaggggctggcggagcctggggggccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtatagga

SEQ ID NO: 112512 - DNA, 601 bp, Human
ctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcaggggcctcactgaccycggaagaagactctgaagtcgaagatgggggtgtcacagttccgaggcagcaggcaggctggggtggaggggctggcggagcctggggggccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtatagg

SEQ ID NO: 112513 - DNA, 601 bp, Human
gacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcargggcctcactgacctcggaagaagactctgaagtcgaagatgggggtgtcacagttccgaggcagcaggcaggctggggtggaggggctggcggagcctggggggccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtct

SEQ ID NO: 112514 - DNA, 601 bp, Human
ctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaasgacccctggagacagccccccaggcaggggcctcactgacctcggaagaagactctgaagtcgaagatgggggtgtcacagttccgaggcagcaggcaggctggggtggaggggctggcggagcctggggggccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgg

SEQ ID NO: 112515 - DNA, 601 bp, Human
taaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtcttgtcagtgacccggcgtgtgtcctcccctccccctccccaggctctgagggcgtcgggcgtctgtcagtgacccggtgtatggcctcccctccccctctccgaggctctgagggcatcaggcgtctgtcagtgggcctgagcacrtggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcaggggcctcactgacctcggaagaagactctgaagtcgaagatgggggtgtcacagttccgaggcagcaggcaggct

SEQ ID NO: 112516 - DNA, 601 bp, Human
atgccagtacgtgttctggagttctttttattagactgggcggccgcggccagctctaggtgggctgctccagctttctggagttctcattagactgggttctaggcgggctgctccagctccataaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtcttgtcagtgacccggcgtgtgkcctcccctccccctccccaggctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtac

SEQ ID NO: 112517 - DNA, 601 bp, Human
cccaattccccaccagccaagatgccagtacgtgttctggagttctttttattagactgggcggccgcggccagctctaggtgggctgctccagctttctggagttctcattagactgggttctaggcgggctgctccagctccataaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtcttgtcagtgacccggcgtgtgtcctcccctccccctccccaggctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaa

SEQ ID NO: 112518 - DNA, 601 bp, Human; identical to SEQ ID NO: 112505

SEQ ID NO: 112519 - DNA, 601 bp, Human; identical to SEQ ID NO: 112506

SEQ ID NO: 112520 - DNA, 601 bp, Human; identical to SEQ ID NO: 112507

SEQ ID NO: 112521 - DNA, 601 bp, Human; identical to SEQ ID NO: 112508

SEQ ID NO: 112522 - DNA, 601 bp, Human; identical to SEQ ID NO: 112509

SEQ ID NO: 112523 - DNA, 601 bp, Human; identical to SEQ ID NO: 112510

SEQ ID NO: 112524 - DNA, 601 bp, Human; identical to SEQ ID NO: 112511

SEQ ID NO: 112525 - DNA, 601 bp, Human; identical to SEQ ID NO: 112512

SEQ ID NO: 112526 - DNA, 601 bp, Human; identical to SEQ ID NO: 112513

SEQ ID NO: 112527 - DNA, 601 bp, Human; identical to SEQ ID NO: 112514

SEQ ID NO: 112528 - DNA, 601 bp, Human; identical to SEQ ID NO: 112515

SEQ ID NO: 112529 - DNA, 601 bp, Human; identical to SEQ ID NO: 112516

SEQ ID NO: 112530 - DNA, 601 bp, Human; identical to SEQ ID NO: 112517

SEQ ID NO: 112531 - DNA, 601 bp, Human
gagaagtaagccgggcggaggtcgggcgccggtggctcacgcctgtagtcccagtactttgggaggacgaggcaggcggatcacctgaggtcaggggttcgagaccagcctggtaaacatgtcgaaaccccatccctactaaaaatacaaaaattagccgggcgtggtggtgggtgcctgtagtccccctacttgggaggctgaggcaggaaaatcgctcgaacccgggagatggaggttgcacggatcgtgccactgtactccagtctgggtggcagaaggagaccctgtctcaaaaggaaaaaaaaaaaaaaagcagggtgggtacgaggcaaaatcgtgattaacaagctttggaagtttaataccagtgagctgcgtaagattgctttaaaaaaaaaaaaaaagcagtcctggcgcatggctcacccggctttgggaggccatggcgagtggattattggagccttgaagttcgagactggtctggaaaacattgcaagacccggtctccacaaaaaaaaaaaaaaaaaaaatggttggaggcagtggtgcacatctgtagtctcagctactcatgaggctgatgcgggagaatcat

SEQ ID NO: 112532 - DNA, 601 bp, Human
gtcaggggttcgagaccagcctggtaaacatgtcgaaaccccatccctactaaaaatacaaaaattagccgggcgtggtggtgggtgcctgtagtccccctacttgggaggctgaggcaggaaaatcgctcgaacccgggagatggaggttgcacggatcgtgccactgtactccagtctgggtggcagaaggagaccctgtctcaaaaggaaaaaaaaaaaaaaagcagggtgggtacgaggcaaaatcgtgattaacaagctttggaagtttaataccagtgagctgcgtaagattgckttaaaaaaaaaaaaaaagcagtcctggcgcatggctcacccggctttgggaggccatggcgagtggattattggagccttgaagttcgagactggtctggaaaacattgcaagacccggtctccacaaaaaaaaaaaaaaaaaaaatggttggaggcagtggtgcacatctgtagtctcagctactcatgaggctgatgcgggagaatcatttgagccttagaggtcaaggctgcactgagtagtgattgtgccactgcagtctaacagaaccaggcctcgtctctaaaatacaataaaa

SEQ ID NO: 112533 - DNA, 601 bp, Human
tgctcctagccctgaggccattccccaggatttgtctgaagcttggtgtctggagaactgagttcacgtcagcagtccttaccacatgctttctgtgagggggttgggggcagggactgagggtgccagggatgtccataggctccttgcctctttgttgggcagatggttttttgttggcttcagctgagctggtggaacttgtttggaagttgagctgttggggcagctgttcttgtcttccatgcatgtgaccacgacagggccagctcagcaaacgggccaagccatgaacacagcrttgtggccagagatgtggatactggggcagcacactcattccctacctagttatgaacatgtctgtccagtggacctctgagggtggaggtggggaaattgggcaggcaggcagtgtgggcctaattcctagaaggcaagtccctggataggaaaggtggggaagagaagtccccgttgaggagtggctcagggagggagtgttcaggaagaacgggagacactggcatatggtgggtccagatatgttgggtgccatgtgccatctctggtgccatctaacttccctgtggaacagcct

SEQ ID NO: 112534 - DNA, 601 bp, Human
tctggggaggggcatagcctgtctgtgctgccccctcgggttggtgtgggtcgcctgtccaggaaaaaccctcccagtctgccaggctccacctgcctccacgctccattctccccaccccggccaggatgaaggaagggctgccctttaacagaccgtaaacaggcctggagagcttaggaaggggctgagctggggcctgtctgagcccctacccctctgctgtctgagtggcctcctccgcccttactgcaggcccataggctcctgccagcctgtgacgtgcggccccgggaatgcygtggggagcgggcaggctggcatgagctcaccggaggtacccgctagggcttcctcccccggccgccagcaggggtgagtcagcagtgatggcgggaggtcctccatgacccctgtcctgtctgtgggcaccaggggtctgtcctggctgtcagggctcctgagtcgctaggaagtgacacgtcctgttcccacaggggctcattcacaggcctcccaggacagtggctggctctgccccgacttctgggctggcttgggtatctgtgtcccctcttttttttcttttttattgagatgg

SEQ ID NO: 112535 - DNA, 601 bp, Human
tgggtatctgtgtcccctcttttttttcttttttattgagatggagtctcactgtcgcccagcctggagtgcagtggcaccatcttggctcactgcaagctccgcctcccgggttcatgccattctcctgcctcagcctcccaagtagctgggaccacaggcgcccaccatcacgcccagttaatttttgtatatttttgatggagatggggtttcaccacaatggccaggctggttgtgaactcccgacctcaagtgattgcacctgccttggcctcccaaagtgctggcattataggcrtgagacaccgcacctggactcctttcctctactttctttgggttaatttgctagtctctttttattatttatttatttattttgagatggagtctcactctgtcgcccaggctggagtgcagtggcaccatctcggctcactgcaagctccgcctcccgggttcacgccattctcctgcctcagcctcccaagtagctgggactacaggcgcccgccaccacgcccggctaattttttgtatttctagtacagatggggtttcaccgtgttagccaggatggtcttgatctcctgacctt

SEQ ID NO: 112536 - DNA, 601 bp, Human
agctccgcctcccgggttcatgccattctcctgcctcagcctcccaagtagctgggaccacaggcgcccaccatcacgcccagttaatttttgtatatttttgatggagatggggtttcaccacaatggccaggctggttgtgaactcccgacctcaagtgattgcacctgccttggcctcccaaagtgctggcattataggcgtgagacaccgcacctggactcctttcctctactttctttgggttaatttgctagtctctttttattatttatttatttattttgagatggagtctcrctctgtcgcccaggctggagtgcagtggcaccatctcggctcactgcaagctccgcctcccgggttcacgccattctcctgcctcagcctcccaagtagctgggactacaggcgcccgccaccacgcccggctaattttttgtatttctagtacagatggggtttcaccgtgttagccaggatggtcttgatctcctgaccttgtgatctgcctgccttggccccccaaagtgctgggattacaggcgtgagccaccgcgcctggccctgtgtcccctcctatccgtcccccagtcaggg

SEQ ID NO: 112537 - DNA, 601 bp, Human
gtgattgcacctgccttggcctcccaaagtgctggcattataggcgtgagacaccgcacctggactcctttcctctactttctttgggttaatttgctagtctctttttattatttatttatttattttgagatggagtctcactctgtcgcccaggctggagtgcagtggcaccatctcggctcactgcaagctccgcctcccgggttcacgccattctcctgcctcagcctcccaagtagctgggactacaggcgcccgccaccacgcccggctaattttttgtatttctagtacagayggggtttcaccgtgttagccaggatggtcttgatctcctgaccttgtgatctgcctgccttggccccccaaagtgctgggattacaggcgtgagccaccgcgcctggccctgtgtcccctcctatccgtcccccagtcaggggcctggtgctgtggccccgctgacccctcccctgcctcctcagccccaggatgggtgagttcaacgagaagaagacaacatgtggcaccgtttgcctcaagtacctgctgtttacctacaattgctgcttctgggtgaggaggggtcgccttgccccc

SEQ ID NO: 112538 - DNA, 601 bp, Human
cgctgtggaccagctgcagcaggaggtgggtgggtggtgctgggagggcgcgtgcatccccagggcctccctggacctctgcaggagcctctggccccaggtctcaaccccagccttgttcttgatgcagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggaggtgggtgtgcakcgggatcatgcctccagtgtctacgaggtgggggggggcaccccagtgactggctgtgggcagtgggacacgcctccaatatctaccaggaggtggggggtcaccccagtggccggatgtgggcagtgagaccacacctccaatatctacgaggaagtgggtgggcagcccagtggctggctgagctgttggtggcctggctgcctaggtgctaggggtgggtttggccacaccctggaggctggaggcagtaggggccagtgggaggtgccccctgggcccgccttcaacacccatccg

SEQ ID NO: 112539 - DNA, 601 bp, Human
ggtggtgctgggagggcgcgtgcatccccagggcctccctggacctctgcaggagcctctggccccaggtctcaaccccagccttgttcttgatgcagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggaggtgggtgtgcagcgggatcatgcctccagtgtctacgaggtggkggggggcaccccagtgactggctgtgggcagtgggacacgcctccaatatctaccaggaggtggggggtcaccccagtggccggatgtgggcagtgagaccacacctccaatatctacgaggaagtgggtgggcagcccagtggctggctgagctgttggtggcctggctgcctaggtgctaggggtgggtttggccacaccctggaggctggaggcagtaggggccagtgggaggtgccccctgggcccgccttcaacacccatccgcgccccgcagggcggctgcatcaccaagttgg

SEQ ID NO: 112540 - DNA, 601 bp, Human
aaaagccagacctcagaggatccttaccagtacgtgggtgagtacgtgggcccagcacagggacaggggcggggacagaaaggtcccttcgctgtcatggggctgtcacggggctgagcctggctcgaggaagcccccttttccagaagagatgtgaaacaagacatacaatttcacagattccagagctctgggtacggccggccaatgctgctccccacccaaccccacccctgggactcttaaaagagggaaacagaacaactgcctagccagacccaggggcccatgaccaagaagmaagcaagcaccatgactgggtccaggctggcccgaggggccatggtgcaggtagccacctgggatgtgcagaacaggagcagcaggacggtgtaggcagcaatcagggcagcagggggcgccgccagcaccacccatgccctgctgcgggcacccaggagggaccccaggtgaagccagatcctccttgttccgacgggagacagcgccctgcctgggccctgctgcccatggtggcacaagctgtcagcacggatgaggctggagggctctgggaccccagtgaggtcaaccacactgt

SEQ ID NO: 112541 - DNA, 601 bp, Human
ggctgactggggcacctgcgcagctgaccgagctgcatcttcatttaggtccagagtggatgtgacagagatgagggggattgggtgtctcttggtgaaggaagttgcccataaaccagagagcgagaggaacaagcatcctccatgccacctcctcatgtaacccaactccgtaaatctctgctccccgccgcaccctcctcgccctcgcactcacccttggtggcccctgcctcctgcgggctcaggagggtcatcagggtgtggaaccccaggaccagccctgctctgagggccattrcactctggtgctttaatcaaatcagtctcagtccgtgtggtgaggacaggaacaaggcggaggtaaagaagaagaaaacagattcgaggatgggggcgacccctgctgtcttcagccaatcacagaaattctctgagtgaatgtatctgttgctgggtaaagagggaaagagccggggtgagaaggtggaaggattcactgggcccccaggagaggccaaaggaagttttggaggatgggaggggcttggaccaactattaccacgtcctccaagaagggaccccctgaagagagagaaa

SEQ ID NO: 112542 - DNA, 601 bp, Human
cacccagcacaatggtgggccagggaaataaaagaaaaaaaagatgaaccatctgtagacccgcaccccagctcatgtctcccgaagaacaaagacaggtaaatagttaactaccggcatgggcataaatactgcaacagaactggacttgatcgggcacattcccggccaggggtggtagagaaatcagggtgcttgctggcatctgttgggtggaggtttgggtctcaggaaggaggaaggaatgaggagaaatctgaacgtcagcaaaggctgactggggcacctgcgcagctgaccragctgcatcttcatttaggtccagagtggatgtgacagagatgagggggattgggtgtctcttggtgaaggaagttgcccataaaccagagagcgagaggaacaagcatcctccatgccacctcctcatgtaacccaactccgtaaatctctgctccccgccgcaccctcctcgccctcgcactcacccttggtggcccctgcctcctgcgggctcaggagggtcatcagggtgtggaaccccaggaccagccctgctctgagggccattacactctggtgctttaatcaaatcagtctc

SEQ ID NO: 112543 - DNA, 601 bp, Human
actgagtgtggctcttccataactgttgtctagttttctggaagttagggattaagttttaattcttgtagaactctatgaagttgtttgagcaacagttattgaggaactagcatgcacccagcacaatggtgggccagggaaataaaagaaaaaaaagatgaaccatctgtagacccgcaccccagctcatgtctcccgaagaacaaagacaggtaaatagttaactaccggcatgggcataaatactgcaacagaactggacttgatcgggcacattcccggccaggggtggtagagraatcagggtgcttgctggcatctgttgggtggaggtttgggtctcaggaaggaggaaggaatgaggagaaatctgaacgtcagcaaaggctgactggggcacctgcgcagctgaccgagctgcatcttcatttaggtccagagtggatgtgacagagatgagggggattgggtgtctcttggtgaaggaagttgcccataaaccagagagcgagaggaacaagcatcctccatgccacctcctcatgtaacccaactccgtaaatctctgctccccgccgcaccctcctcgccctcgcac

SEQ ID NO: 112544 - DNA, 601 bp, Human
ccatctcagagcattatgactgagtgtggctcttccataactgttgtctagttttctggaagttagggattaagttttaattcttgtagaactctatgaagttgtttgagcaacagttattgaggaactagcatgcacccagcacaatggtgggccagggaaataaaagaaaaaaaagatgaaccatctgtagacccgcaccccagctcatgtctcccgaagaacaaagacaggtaaatagttaactaccggcatgggcataaatactgcaacagaactggacttgatcgggcacattccmggccaggggtggtagagaaatcagggtgcttgctggcatctgttgggtggaggtttgggtctcaggaaggaggaaggaatgaggagaaatctgaacgtcagcaaaggctgactggggcacctgcgcagctgaccgagctgcatcttcatttaggtccagagtggatgtgacagagatgagggggattgggtgtctcttggtgaaggaagttgcccataaaccagagagcgagaggaacaagcatcctccatgccacctcctcatgtaacccaactccgtaaatctctgctccccgccgca

SEQ ID NO: 112545 - DNA, 601 bp, Human
ggtgggtgtgaggggaaacaggccacggctggcaggggtaagaattaaggttagtgacccagagaccaaggggatagggagaggcaactcaaggcattacaaagagcactggacgaggagtcagaagtcaaggttcatgtcccaattcctccatctcagagcattatgactgagtgtggctcttccataactgttgtctagttttctggaagttagggattaagttttaattcttgtagaactctatgaagttgtttgagcaacagttattgaggaactagcatgcacccagcacaatggkgggccagggaaataaaagaaaaaaaagatgaaccatctgtagacccgcaccccagctcatgtctcccgaagaacaaagacaggtaaatagttaactaccggcatgggcataaatactgcaacagaactggacttgatcgggcacattcccggccaggggtggtagagaaatcagggtgcttgctggcatctgttgggtggaggtttgggtctcaggaaggaggaaggaatgaggagaaatctgaacgtcagcaaaggctgactggggcacctgcgcagctgaccgagctgcatcttcatt

SEQ ID NO: 112546 - DNA, 601 bp, Human; identical to SEQ ID NO: 24063

SEQ ID NO: 112547 - DNA, 601 bp, Human; identical to SEQ ID NO: 24064

SEQ ID NO: 112548 - DNA, 601 bp, Human; identical to SEQ ID NO: 24065

SEQ ID NO: 112549 - DNA, 601 bp, Human; identical to SEQ ID NO: 24066

SEQ ID NO: 112550 - DNA, 601 bp, Human; identical to SEQ ID NO: 24067

SEQ ID NO: 112551 - DNA, 601 bp, Human; identical to SEQ ID NO: 24068

SEQ ID NO: 112552 - DNA, 601 bp, Human
cgcctccggcctccctgccgccttcagcacgttcgagtggatgaaagtgaagaggaatgcctctaagaaaggtaagtccgcgggccttggatggggccacctggggttggggacggagcctcccccgcggaaatgcgctgggagcgtggtgtcgctgcctttccagacagcggtttgggttttgtggaggagacgcgttcccgggcgaattccatggagtctgcctcgagtacagattcggaaaatgtgccaggcattgagaaaatttcaggaaggagctctccgtggaacttctcctggyacaaattctgttcctagggacccaggagggctgcgctgggactttgattctaactagctccactgctcacccacattctgtccccggcctcaggcctggctgacgccctgtctttacgttgcaggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctgg

SEQ ID NO: 112553 - DNA, 601 bp, Human
ctccactgctcacccacattctgtccccggcctcaggcctggctgacgccctgtctttacgttgcaggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacgrccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagc

SEQ ID NO: 112554 - DNA, 601 bp, Human
gggagacagtaacagccttggatttctctaactggaaggggagcccctccagttggggccttctctaggtccacccagggcatgtagaagataggcatggccaggaactctgagggctgttccttctctctgcttagactgcttggttcctgaaattttctgaccttgtggtatctgatgtggtttatcttcaggtagatgaacttgcttccaggtccagggcaagtttggggcctggggtgtggcttgctatcagggatctggtttgcctgatgttttctggggctgctgctcctagggrgagggtattatcctgcctgcaacctccttttcctgcccctccttcctcagctgcaggctcaggccctccctcccaggagaaatccatttgtcttccctgggagggagtggacaagcagctgagaggtggcagggtagtaaaagccagtgttgaggctgctgctcctagcactgtgaatactcaaaatgcttccagcctggccttggactccctaaaatacccaggcagtgtttttttttgtttgtttgtttggttggtttttttttattttttattttttggtttgtcacctccctggct

SEQ ID NO: 112555 - DNA, 601 bp, Human
aaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacytgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtgg

SEQ ID NO: 112556 - DNA, 601 bp, Human; identical to SEQ ID NO: 37706

SEQ ID NO: 112557 - DNA, 601 bp, Human; identical to SEQ ID NO: 37707

SEQ ID NO: 112558 - DNA, 601 bp, Human; identical to SEQ ID NO: 40236

SEQ ID NO: 112559 - DNA, 601 bp, Human; identical to SEQ ID NO: 40237

SEQ ID NO: 112560 - DNA, 601 bp, Human; identical to SEQ ID NO: 39825

SEQ ID NO: 112561 - DNA, 601 bp, Human; identical to SEQ ID NO: 39826

SEQ ID NO: 112562 - DNA, 601 bp, Human; identical to SEQ ID NO: 39827

SEQ ID NO: 112563 - DNA, 601 bp, Human; identical to SEQ ID NO: 39828

SEQ ID NO: 112564 - DNA, 601 bp, Human; identical to SEQ ID NO: 39829

SEQ ID NO: 112565 - DNA, 601 bp, Human; identical to SEQ ID NO: 39830

SEQ ID NO: 112566 - DNA, 601 bp, Human; identical to SEQ ID NO: 39831

SEQ ID NO: 112567 - DNA, 601 bp, Human; identical to SEQ ID NO: 39832

SEQ ID NO: 112568 - DNA, 601 bp, Human; identical to SEQ ID NO: 39833

SEQ ID NO: 112569 - DNA, 601 bp, Human
cttgcctctactgatgagggatggctgggggtacctcactcgacctcataatcccaaaagatagaatggtgtccctctcagagatgaaaaaccaaagccaagggtcagttcagtagggctggtgcactcctgtgtgtggggtctgtccagggccaagggctgacattggcaaggttggctgctgtggcagagttttggacagggtgtgatcaccaggctggccctacttctaagaactactcacacccctcatctgcaggacaaagtccagcctgcgcactggcctctgctccccgccacttttttttttttttttttttttgagacagagttttgctcttgttgcccaggctggagtgcaatgacgccatctcggctcactgcgacctctgcctcccgggttccagtgattctcctgcctcagcctcccgagtagctgggattacaggcatacgacaccacacccagctaattttgtatttttagtagatagggtttctccatgttggtcaggctggtctcgaactcctggcctcaggtgatctgcctgccttggcctcccaaagtgctgggattacaggtgtgagccaccacgcccagc

SEQ ID NO: 112570 - DNA, 601 bp, Human
ctagagtggggacagagagtgacaccctggggagctgggaagggaaagggctgggggtcctcttccggcctctacagaattccaggcctccaggaaatgggaatagggggaagagaaaggtgcccaagggtgcaaaccttctcaaagcgtggaaccttgcaggccttcagggcagtggcatccagcaacagcacagggcccaggccaaagatgtcacggagtagctcattgttctggggggcagagggcagtgagctcaggccagactgaagcaaccacaccagatgtcccctccctgtcygtccccgcacctggaggtggtggtgcatgcccgaacccagcacttccttgaaggcagcgtagatccggtgccgagcccagctgtccatgtagagcacctcaaagccgaagcgcactatctcttcttcgcattcaccgccctgcagggtagaggtgccaacacaactgggcttggctgctatgcctgggggtgcacccttgctaggacacatatgttctcacacacacctccacggagtgcagcacggcgcggaaagtagagcgctggcgccgacgatcagccttggcacggtacttgtta

SEQ ID NO: 112571 - DNA, 601 bp, Human
tacagagccttgggttcctttcacataacaatcaatagtggatgaataagtctcaccacttgaaagtatctgagaaaggaagtcaacagagtaatctgggtttgctgggttgattcaagaagagacacaatatccacccctcttcttctagttctcttcccccaaccagcccacacccctgcaagaaagaaagaagggaaagagagaaagaaggaaagagagagggaaaaggcaagaccaaaatgtagggatcccaggcataatttacgctgaggagaaaatgtcacactgtgggataaamtatagccatggaaacagacttatgacttttactttgaaaataaaagaatgacaatgaaatttgtgtgaggtctgtgtgaatccagtcccagatgtttacaatgctgtagtagtatggctctgcaatatgagaggtttcagaagaaacagtacaacaggacaccacaaagcagtgcatacgctattgacaatgcagacatgagcatcatgttaccaagagggaaggcaggcagaagacaaatagcagcggtggtgcctgaaaagctaacttcatggactgcaatcactcaaactaacataa

SEQ ID NO: 112572 - DNA, 601 bp, Human
caaattttaaaagtacatttctaagctattctttgttgtactgactgactgacacagataaaggtaacatgcactgagaagaaagagtgccgattacaaaataatgttttaaatctgtgaaacaaagtaataaacacccttggtcaaatgtcaaatgtaaattatcttagatcattgcaatataccatgaaagatttaaatccttctgcataaatgacttgagacaaaatgaagttgattacttgtatatattgtgataaaactgtattaaaattacataaacatgaattgtatattccaycttactgtaaaataaaatagatttataatttctggaaggaaaattctaatattttacttatattaagcaaacatcaactataaatgttgacagatgttggaacagtaatactaaaaatgtcatctgaattactcttcattgcaaagttcacagaattaatgttaagatagattaaaatcactttgaactaatacacatatattactcttctttctgaagcataataaagaaatatcatttgcactacaatgtcagataagcatacagacattaaggcttaggaaagatgtagttattcac

SEQ ID NO: 112573 - DNA, 601 bp, Human
tcagtatcagagtgtcactagtggctttccaagatgcaggtatatttcctttcgcaaattttaaaagtacatttctaagctattctttgttgtactgactgactgacacagataaaggtaacatgcactgagaagaaagagtgccgattacaaaataatgttttaaatctgtgaaacaaagtaataaacacccttggtcaaatgtcaaatgtaaattatcttagatcattgcaatataccatgaaagatttaaatccttctgcataaatgacttgagacaaaatgaagttgattacttgtmtatattgtgataaaactgtattaaaattacataaacatgaattgtatattccatcttactgtaaaataaaatagatttataatttctggaaggaaaattctaatattttacttatattaagcaaacatcaactataaatgttgacagatgttggaacagtaatactaaaaatgtcatctgaattactcttcattgcaaagttcacagaattaatgttaagatagattaaaatcactttgaactaatacacatatattactcttctttctgaagcataataaagaaatatcatttgcacta

SEQ ID NO: 112574 - DNA, 601 bp, Human
tgaaaatattcatcttctattctttattttaagcaccttgttctctcctcaagttaccttcagttttcaaatacaggttgagtatcctttatctgaaatgcttgggatcagaaaggtttcagattttggaattttcagtttttgaaatatttgcatatacataatgtgatatcttggggatgggacccaagtctaaacacaaaactaatttgtggtttacatacacacagcctggaagtaattttttaaaatattttaaatcattttgttcatgaaacaaagtccatatacattgaaccaycagaaagcaaagatgtcactatcttagccgttgatgtaggtaatctgtggttgtttggcatcaccatcattcctgactctgaatttaaatgctactgataagcaatcattttcttacacttattcatacataagtacttaagagtaaacaacatgacataccactattacagtgaaaaaatcatgtgttgggggtaactaggcagcacagtagcatcaccagaatacctgtatcagctgttaagcaacagcagctgaagggggatgggagggtcttttttccccttggggatgctgaata

SEQ ID NO: 112575 - DNA, 601 bp, Human
cacttcatgattacacattttttttaattcagaaattttaatgaatttaagtacttaacagtctcttaaataatgatagccctactaacttatttttcaggttctcagaattgtagaacttagaactaagtgaaattttaagagctaatttacttcaaccatcattttaggtaggtagcatattaatcacctttccagaccaggtgactgaactttgagagtctaagtaagttgaccaagatcatatggttaaaagcagttatttacctaataatatatagaaagaggacttattatatgscaaatactatcttaagtgcatgcatgtaaaagtcagtgaggtgtggttctcactctcaacaagttttctgtttatgaggaaactagatgggtaaacagtcaactaatcaagtgtggtattgcattataatgctaggtatatggtttttggaagcacaggttttgagaggacagcaggaaggtttcccagagatgacatctaagtgaaatttgaaaagaagaagagctgggaaagagggcagggacatcattccaggccgacctagcagtgtctggcaaggctgaacaggaagggacaagg

SEQ ID NO: 112576 - DNA, 601 bp, Human
ttaagatccacagtaaatgttttgacacagacaagaccactccctttactcccactctttacagcactttattcttcctctctaaaataattactaagaattgctcattttttaataaccaccaaattatccaagaatccataaacacaactctgaaactagaaataactgtctcatagtcagcaggaattttaaaggggataaagtaatttttaatccccactgaatgttatcagtagtaaccttaggaaaagtagagaaacatgaaaaatgattcacttcatgattacacattttttttaattcagaaattttaatgaatttaagtacttaacagtctcttaaataatgatagccctactaacttatttttcaggttctcagaattgtagaacttagaactaagtgaaattttaagagctaatttacttcaaccatcattttaggtaggtagcatattaatcacctttccagaccaggtgactgaactttgagagtctaagtaagttgaccaagatcatatggttaaaagcagttatttacctaataatatatagaaagaggacttattatatgccaaatactatcttaagtgcatgca

SEQ ID NO: 112577 - DNA, 601 bp, Human
gttggtgtcttagactaatataaatctattctctcaatgttctggggactagaaatccaatatcaatttttctgggcctagagcaaggtgtcagcagggccaaactcctctgtaggttctagggagacaatctgttcctttcctcttccagtctccttggctcatgactcctttgtccatcttcaaagacaacaacattgtatctttaaatctttctgtttccattttcaaaatgccttctgccttctgtgcttctacgtatgtctaatctccttgtgtctctcttataagggcacttgtsatggcattaagggcctacctggacaatgacaataatctcctcatttcaagatccttaacttgatcacatttgcaaaaactttacaaatacagtaacattcacaggttccaggattagaacctgatgtctttgggtgctcattattcagcataatatagctttatttcctaatataggtacactccaggaatctggtccttagtctgtgaaataaatatactaaactaaaatattttaataataatgtagttcaatacactcatattatagattaagtctctgaggccaagataaagtaaa

SEQ ID NO: 112578 - DNA, 601 bp, Human
gttcgccaaaagctgattctaggttagtttggttgaaattcattgggaaaagcatttgctaagatggggattttatttgatagtgtctggataatttttaatttatactttagacttaaaaatggctacatatagatgtgggagtttaatatgaatactttctttaataaagataatatttcaagttctgaacttgggaactatgggaagattaaataaagaagaaaataaatgtcagcaaccctaagttaacttctcttaaaattttgctttctttgtaaaagagtatgtcttcaggcartttggcatcaagacaaatatttctcaaactgcaagaaaataaaataaatagtgttcctcatatgtgagaaggttaaaaatctttgatattaaacaaataacaaaagaaatttcaaactgaaagatctgatagaaaatgaattcacactataaaagtattttttaaatgtttccatttatcatcctttgaaaagtaactactgaaaaaaatccatttttttcatctgtttcttttttagccatcaggagtttcaaaataaaagtggtcaggagccagacttttttaactgcaggtaaacat

SEQ ID NO: 112579 - DNA, 601 bp, Human
ttactgtaaaatgtcggcatggttgggagctgtctaaaataacaaagagtgtgatttgtggagagagattgaagtgacctaaatgacctctgaaagctccttccatacctaagacctccactcagactttataccccaagatgagctgtcaacaggctttggtaggttgtcttgtaggattccagactttgccacattcaggagctcactctttaatcagtcagctccttttggtctcctcatgtctcttttctggtggtcaatttcatcctcaaataatttgcaaaaaaaaaaaaaaaaagagagaggtaaaaagctcctttttgttattgcttctttctttataaatcctgatgctgtaatgctatttaaaaataaatttagtaggaaactcaaaaccttcttcttgcacctcccctttcttgctccataaaattcctattgcagtctgagccatgactaacatgtacagtatgcttgcaatgaaaatggttttttcccctacatgccctaactccagattttcaatcttatgactctacgctttgattaagacttaggttgaaagtaagactctgttgtcatcccagtctcaggtcct

SEQ ID NO: 112580 - DNA, 601 bp, Human
cttggactagttactccttaattcttctgaaaaatgaaaataacatcatctgctccatgatgtgtgctactttccgtcctctattcacaatgtccccaatgtcttggagatagtccatatatcttttatcctttgctaaagagattccttcttgaaacttgaattgacaccattcctttcctagtattcttgctccaaacactcagacctaggcagggttaactcttctctctttttttgtacctctgctgccctgttattctagcactcactgtaatgttacaatttttgataaaattarctaggacatagggagaactcctataacccagcaaacagcacaaagcaacttactatatttcctcatatttgacaacactagtgttattcacaggagctagtcctgtattccttttgtcctcttatcccatatagagatatcatagagtatcaatggatactatatgttagagaacaaatactccctcagcatgacaaattgttgtaattttatctgcccttatagatgctgcttccctcctctactcaaaatgtccctaatgtcttggagatatcctatatatcctttaccctctgctaa

SEQ ID NO: 112581 - DNA, 601 bp, Human
tgctatttaccatctttgtgaacttggactagttactccttaattcttctgaaaaatgaaaataacatcatctgctccatgatgtgtgctactttccgtcctctattcacaatgtccccaatgtcttggagatagtccatatatcttttatcctttgctaaagagattccttcttgaaacttgaattgacaccattcctttcctagtattcttgctccaaacactcagacctaggcagggttaactcttctctctttttttgtacctctgctgccctgttattctagcactcactgtaatrttacaatttttgataaaattagctaggacatagggagaactcctataacccagcaaacagcacaaagcaacttactatatttcctcatatttgacaacactagtgttattcacaggagctagtcctgtattccttttgtcctcttatcccatatagagatatcatagagtatcaatggatactatatgttagagaacaaatactccctcagcatgacaaattgttgtaattttatctgcccttatagatgctgcttccctcctctactcaaaatgtccctaatgtcttggagatatccta

SEQ ID NO: 112582 - DNA, 601 bp, Human
ttcagcagttttgtagtctctacttcctaagcacctatataccattctcatttcctttcgtctgcatctgcaaaaggtctctttctcaaatccatatggacacaaagtcacctcctatcactctctcaactgctccctttaccagaaaggtgatctgtatttatttttcccaaacaaatctcatgtctttatgcctcctgcttctattccctgaagatcccttgaagagactatactctctaaaaagccatgccaaaccagataaaacacatagaagagagatgatatttcatgaaaatcrgagtcaagcagacctagcttggcatcatggctctgctatttaccatctttgtgaacttggactagttactccttaattcttctgaaaaatgaaaataacatcatctgctccatgatgtgtgctactttccgtcctctattcacaatgtccccaatgtcttggagatagtccatatatcttttatcctttgctaaagagattccttcttgaaacttgaattgacaccattcctttcctagtattcttgctccaaacactcagacctaggcagggttaactcttctctctttttttgtacct

SEQ ID NO: 112583 - DNA, 601 bp, Human
acttaataaatctgcatttgctattttctgtaagtttgcttgaaaattttccctgattttggtttgcctattcagcagttttgtagtctctacttcctaagcacctatataccattctcatttcctttcgtctgcatctgcaaaaggtctctttctcaaatccatatggacacaaagtcacctcctatcactctctcaactgctccctttaccagaaaggtgatctgtatttatttttcccaaacaaatctcatgtctttatgcctcctgcttctattccctgaagatcccttgaagagaytatactctctaaaaagccatgccaaaccagataaaacacatagaagagagatgatatttcatgaaaatcggagtcaagcagacctagcttggcatcatggctctgctatttaccatctttgtgaacttggactagttactccttaattcttctgaaaaatgaaaataacatcatctgctccatgatgtgtgctactttccgtcctctattcacaatgtccccaatgtcttggagatagtccatatatcttttatcctttgctaaagagattccttcttgaaacttgaattgacaccattc

SEQ ID NO: 112584 - DNA, 601 bp, Human
aaggccatcactttgaattccctgcagccacttctctagactacaggcttccttcaaagaatacctcttgtctacctcatggcttctcatacctacctctgtattaattttatatgtcatttcttttgcatcaacaattaggaatttttataggtacttatcagaatactagctgtcttgttttctaaatttaattgcaagactttaaagcatgggagctgaaatcttaatgtctctttatatgatgcctgcaaggatgtaattaatatttgcaaggcatgatgacaatcattaacactaycactaaaaagaagcaagtcacctgtagcaacacaatcaccaagtgaataattgtgaaagaatattaatggcctgactactttatcgaccaaatattctgtcctaatgatatttcaaaatttggatcttttaaagaggcctgctgctgcagaaagcataggtaaattctctaattttcctaacttcaacttctaacttttctgaatgaatgtcatccttgttatctcattgacccaataaagaattcaaaccaaagttcccagaaatgtctttgttaaaaggtactctgtatacttaaaag

SEQ ID NO: 112585 - DNA, 601 bp, Human
aaatggaaattagataattaataggattaccctcctaaaataaaaatctcagaataacattctccaataaagaccctctgcttttgtggtacatttgttctctatgtgatgcaatacatatacgcttatccttggcatacacaatggctcaagccttttagcagttgattatgtgcagtgttataccccaatgagagcctcctaacaagatctgaagtcagcaaagtcaaattatcatcttgtacttcttttgcaccatctaagcacctttggagagtgcttatatttaatttatgtgccrgtaaagttttgaggattgctactaggtaatgctattaacttgcatatttttgcataaaagattttggaagaaaaagttatattggcacacagggaatgggatagcattgcaaaaatcacatgcatattcaaagataatgacatatgatattctgaatcctacagggaaatcaattcttaattactcttcctgacatttgtcattgcatagcattccaggaaaatcactgaatctcaaaaacttccacattacctggaagaaggaaaatgtgaattagataaatcttttctagaccaatcc

SEQ ID NO: 112586 - DNA, 601 bp, Human
tccagtgtccttgctcttaaccattatgctattttgcctctctttgtgaggtgcttaggtagtttagagacaaagatgccaattgggggcaaaattctcctgcttttcaacatcttggtgaatacagatttctccttatagctaagtatagccaaataagtgctttttcacttaaaaggccatcaggaccctcaagcttcctagtcttttctgccatgaaggttcttaggaagacctgttggaataatgcattcccctctgtctcctccagaacttaccaaacccaccacattataagatratgcagagttcgtgccaggtaaagtagaaatcgtgtacccaagaggctgagtgactttaaagtcaggagtcttgaggggggcaagggcatttctggattagcttagactaatgttcttccaccctacttttgtttaggaacagaaagaatattatacataagaacattatggttaattgacaattaggaagattctacatggcagaagttccaacagataagatacgacatacacaagggagaagatctttaacgtatgttcattggctaatttcttcatagcacttctgcaggttagga

SEQ ID NO: 112587 - DNA, 601 bp, Human
ttaggaagggcaaggcagccttatcaaactgatgcagtattacccaactgccattctgaagaagccagaatgaggtgagagagaaaagaattacacacttcaaactaaccaggtgaccttacatccctttcccccagtacacttggctttcaaaaatctaatgtttcacttctttctgcttcaactgccaaaactgtttgaaaaaaagattattacaaaaaaaatatgtatgtgtaggtaagagatgccatttagatcaccgacactacctccaatttcctaagattttcataaaaaaaaacaacattctaatgtaatttcgaaacatgatgagttatttttgtttagcaacaacaaaaccctaaagttggaaaaacttaatgttagaccagaaaggggccataccagtgatctacttcaacctttcttttacagaggaggaatcttaaaccctgaaagatcatgtttttgcacaaagtcacagcttcccagtgttgggctaagagcaagaagttatcttgtagttttgtcaggtttttttcttattagtttatagatataaaagttgatctatacataaatgactaataatgaactttct

SEQ ID NO: 112588 - DNA, 601 bp, Human
ggagtcaatagtttatgattcagtgtaataatttttgccaaaagataaacaacagttacattccttttttaaattacacacacacgtgcacacacatctagagttaaatatttactgatttatatcttgatttttacgtttaaggtctggattttccaagtgtgaaattctaatactactaatactactactactaattttaatactactaactcagtagtaaaagaaactaataaatatttatagaatcaatcagttatgccattatcagtgattccatctcagactaagtagggccaawaattaattagaagcatagtccatgaaagaggagcacatttggggatgcactgcatgggtgaccatcattcagcactgggcacaacattgggactgataaagataacgccatgccacttacaccgttagcagggtgaggatttgagggactttcgatgcaattctttgactgaaatcttgtgctctgacagtagatttcaatggtttagtcaaagagttgcttgtacacaatgcaaaagctgccacagagggaactcatgcctggcccttcatacctctaaaaggggacaccaatacagag

SEQ ID NO: 112589 - DNA, 601 bp, Human
tggtttgatttctcacccaacaataaacagataataagatagatagacacataattggcaaaatgagtcagcagttcattctcatatttttgataattagagattatattgagatgtcctatatcaataacagatgtcaccttctctgatttatcccatttgatagaatctttttttaacagttcagtggttttccaaagatttaaaaatagaaatatctctgacgatttgagaactataagtaaaactaaagttaaatgttagatcaaaaataccgtttaattaaacaaagaaacatgckactctgtaaacttttcctctgaaaaccagaaatcaatgctttccaagtcagtcccatcgttggaatcttatctgtaaggaagaagacttccagattacctgtgactactttctatactaacatttctattaatattttactaccattattagtttgaaccctatgaatttccattcttgcaggataaatttggagagatggagtcaatagtttatgattcagtgtaataatttttgccaaaagataaacaacagttacattccttttttaaattacacacacacgtgcacacacatctag

SEQ ID NO: 112590 - DNA, 601 bp, Human
ctagaggttcttaggagcaggttcctagacttagcaaataaaaatacagaattcccaattaaatttgaatttaagatatataacgaatggctttttattttacgtgtatttatattacatgcaatattttggacatatttataaaaagaatctgttatttatctgaagtccatatttaattggaagccatttaatagaaatccatatttaatttttatctggcagctctacatggggagaattctgggaagtggtgacttatgtttcccctcatcacctctgattctaaattctggcttamcctaaatgctcaatcttatgtgtccactacaattctgatttcattttctatgactcttcttccttatgctctgcactagttgcatggtgaaccagggtttctcttctttaatgtttccttccaaaactcgttcaagaaatttatgaacacagcagactttgcttaacatttgcagctaaaaagagactatagatctgtccagcttaaataatttaagattaaattaaagttgtgtttattttctaggatactttggttacattctctgcccctctcccactttctactttgagcaaattt

SEQ ID NO: 112591 - DNA, 601 bp, Human
accttctgagttgtaaagaaagttcagtgcaagtttctatcactcccatcccagataaggtggaacttccagccttcccattatctctagaggttcttaggagcaggttcctagacttagcaaataaaaatacagaattcccaattaaatttgaatttaagatatataacgaatggctttttattttacgtgtatttatattacatgcaatattttggacatatttataaaaagaatctgttatttatctgaagtccatatttaattggaagccatttaatagaaatccatatttaatttytatctggcagctctacatggggagaattctgggaagtggtgacttatgtttcccctcatcacctctgattctaaattctggcttaccctaaatgctcaatcttatgtgtccactacaattctgatttcattttctatgactcttcttccttatgctctgcactagttgcatggtgaaccagggtttctcttctttaatgtttccttccaaaactcgttcaagaaatttatgaacacagcagactttgcttaacatttgcagctaaaaagagactatagatctgtccagcttaaataattt

SEQ ID NO: 112592 - DNA, 601 bp, Human
tagtctcacctagttctgaaaacagaactagggacagaagaaagggcacttaacatgggatctggattttataatcattttgacactaattgtgcatatttgtgttcaccagaccttctgagttgtaaagaaagttcagtgcaagtttctatcactcccatcccagataaggtggaacttccagccttcccattatctctagaggttcttaggagcaggttcctagacttagcaaataaaaatacagaattcccaattaaatttgaatttaagatatataacgaatggctttttattttamgtgtatttatattacatgcaatattttggacatatttataaaaagaatctgttatttatctgaagtccatatttaattggaagccatttaatagaaatccatatttaatttttatctggcagctctacatggggagaattctgggaagtggtgacttatgtttcccctcatcacctctgattctaaattctggcttaccctaaatgctcaatcttatgtgtccactacaattctgatttcattttctatgactcttcttccttatgctctgcactagttgcatggtgaaccagggtttct

SEQ ID NO: 112593 - DNA, 601 bp, Human
tttgcttttgtgaaaccactggcaatagtaggatgaaatattccataagtattaaacaaagttaacactaataaaacttactaatgggatagtcttgccatacttccttgccatagtaacacaacttactaatggagtagtctcacctagttctgaaaacagaactagggacagaagaaagggcacttaacatgggatctggattttataatcattttgacactaattgtgcatatttgtgttcaccagaccttctgagttgtaaagaaagttcagtgcaagtttctatcactcccatccsagataaggtggaacttccagccttcccattatctctagaggttcttaggagcaggttcctagacttagcaaataaaaatacagaattcccaattaaatttgaatttaagatatataacgaatggctttttattttacgtgtatttatattacatgcaatattttggacatatttataaaaagaatctgttatttatctgaagtccatatttaattggaagccatttaatagaaatccatatttaatttttatctggcagctctacatggggagaattctgggaagtggtgacttatgttt

SEQ ID NO: 112594 - DNA, 601 bp, Human
ttgaactttttgcaataatagaaatgtttgataacttatgctatccaatatgtgagtgttgagcatttaaaatatgactaataatattgagaaacagaataattttatttagttttcttttactgtgtcaactaatttaaattaaaatagctatgcttggctagtgactactgaattgaataatgcagttctagcacagcatcttattttgtttcttaaaaaataaaattataaattataaatttcaaaaaatgaattaatatgcttttgaaaaatttatttctgttctctacagcataaycaccatgagggtggggatgtctttgttggtttgctttcatataatcagtacctagaggaaggccaagaacatagtaaatactcaataaatatttgtagaaaaaaatagataattgaatgaatggatgaatctatccctcatgaagttaagcatgagtcataatatctccctttcagactagtataactgcgtcctccctatgcttcctgggatgactcctgcctcactcgactctctccttcacgtcactgtcaaaagtgatcactctgagttacatatgggatcaagtcacactctcct

SEQ ID NO: 112595 - DNA, 601 bp, Human
aggaagttttggaactttcaaaggatttcatttgaaaaaataacttttcgaatttggataatagcacttgtatattccttgtagtttccctgattcaaggcaataagcagtatatacaattacttgttagctcccttcttttcatgttgatagggaccacccatctgtggccttgggtgcctaaaaaactttagttattacaatcgagagtcacattagagattgtctgtaacttaaatcagcatatattatgtatatacactattttcaaatatatttggatatttttagtgacaaaatwataaaatttattttaaagcatccacactagcttttcatcataatgtaggtataatgaccccatgtgggagtctgcaaaatatcttgaccttaaaaatagtcttcaaattccaaaacaaacaatatactgctggaaaataatgaatatagaatgagaaaatgggaagacttgatttgaagataccttgaggaaaaaaatcagtaaaataaaactgaacaaatagaatttaaccaagaatataatacttcagctaggttttatattttctgtttacaagactattaatgcattacaattttc

SEQ ID NO: 112596 - DNA, 601 bp, Human
ctataatgtccacataatagaccaacttactgtaatgtaataatcttggaggagatttaacacccattatctgaagacctaaaacctctagggaactgttatggttgctcagcactgctataggacctaaatgtaagaacagaaacatttctgaataagatccaaagtgactggggagaaatcatgggacagtgggttcatcatagaatttaaaatcagacagagctgaaccaggtctgccttatactcttttgattgatattgaacaaccctacttcatagaatttatgtaagtaatacrttatttaaggtatggaaagtattcaacaaatagtggttattttatttctaaattccaactaatcttgtatgctttgcagaaataccatttggtgatgattgaaggtagagaggggaaagcaatattgtcttttctataatattctttaaaaagagtgtatgcatatcttgataacctcactctagcaataacatttgtgaatttaaaactatctggaagttagtaaatttttattctcagtccatgctaccacgtattccttaattagctgtctcctttataaaattatattattttagt

SEQ ID NO: 112597 - DNA, 601 bp, Human
aaacaaaaaacatactttcatattaagggtactaaacaaaagttctcttgggaattctactggtaacaatcattcagattttatgttcccaattctatgtgacaaatataatgtttggcatgttaaacatattcattgatttacaacctgagtgttattaagaaaggccaattacattctatttatttaggttaaattattttttagcacatggaagctaattatggaaaacacatcctttgtaccaattcatacaggagtcaagccatgattagagttgcctgtctagctttaatatacygctttccactttattgactatacagattgggaaagtacatattgaaaatgaaagacaatctgtaaacaaatgttatagaatatgctactttacctaggcatacccattttagtaactcatataaacattcatattattgaatatttaaaatatcagaatataattggtaaatattaataacagtaataacttcaacagaggtctaacaaataggacaattctatggattcaaatgtttgaccaactagaaagtaaaagggaagaaaactgaaataagataacataaaatatgtaccattt

SEQ ID NO: 112598 - DNA, 601 bp, Human
taggcttacaggtaggaatatgtggctcataacataacaataatcactcataacaatgatcactcaccaagaggcattcatgcatcttttcttaatggtgagaagaaatgacctactctcccttcccttccctcaagcatgcccaagtagactggagatcttcagattttcctttttgtatcaagttaaactctagtggctgtattttccattctatttatagctagtgttctacttagtatgtatcttagtataaaacaaaaaacatactttcatattaagggtactaaacaaaagttcacttgggaattctactggtaacaatcattcagattttatgttcccaattctatgtgacaaatataatgtttggcatgttaaacatattcattgatttacaacctgagtgttattaagaaaggccaattacattctatttatttaggttaaattattttttagcacatggaagctaattatggaaaacacatcctttgtaccaattcatacaggagtcaagccatgattagagttgcctgtctagctttaatataccgctttccactttattgactatacagattgggaaagtacatattga

SEQ ID NO: 112599 - DNA, 601 bp, Human
tctttgtctcccttaatcattctcacttgaacattttcccctactaatgttaggattttaaaaagatataatattgtatttgatttaatttaatcttttccaagtacttccagactcaaaatttaacttcatcatgaaagagtgataaataacagcaagacaggaacatataaatctgaatagtctttttctaatcatcagttataaatgaaatttggttttcaaactaggcttacaggtaggaatatgtggctcataacataacaataatcactcataacaatgatcactcaccaagagrcattcatgcatcttttcttaatggtgagaagaaatgacctactctcccttcccttccctcaagcatgcccaagtagactggagatcttcagattttcctttttgtatcaagttaaactctagtggctgtattttccattctatttatagctagtgttctacttagtatgtatcttagtataaaacaaaaaacatactttcatattaagggtactaaacaaaagttctcttgggaattctactggtaacaatcattcagattttatgttcccaattctatgtgacaaatataatgtttggc

SEQ ID NO: 112600 - DNA, 601 bp, Human
taaatgtcctaatggttgaatgaattacctagcttaacacaactggtggttaagccagctgaaattcaaactcatgtttttttcaatatcagccaaatgctcttttcactagctctaaaaaaatgatactattgcagagtagttaccacctgatatggtaatgcctagcgaaagctggtgcctgacattgtttagtcagctgacaaataaagatacttgcataaacaagcccaggaaaggctcagtggaaattgatcatgaatgttgggaggaaatcatgagtaagcataagataaatccstgtatcacagaagaacttttccctttctttgtctcccttaatcattctcacttgaacattttcccctactaatgttaggattttaaaaagatataatattgtatttgatttaatttaatcttttccaagtacttccagactcaaaatttaacttcatcatgaaagagtgataaataacagcaagacaggaacatataaatctgaatagtctttttctaatcatcagttataaatgaaatttggttttcaaactaggcttacaggtaggaatatgtggctcataacataacaataatcact

SEQ ID NO: 112601 - DNA, 601 bp, Human
tttatatttatgagctcattcttgtgagttaaatattttggatgtatttctgcaactttagtatttacccaatacttactcaaaaacagtaagttgtctaatcctttagtagtttttcaacattttcaaaagtattgcattttcaaaagaaagttaaaggagcattataaacaaggtgcaaggagacagtggcagttgagacttcgctttctcaacatatggcttatgttacaactgagcaagcccccagcttttatctctgggagctgtgaagttgactgcttataaggtctcaatgtcyaattaatccttacttaaaattcacctaagtaagtataacagggataggaagttggtttctgttagcagttccacctttcaccctaccaaacatctgggaaatattcagtttaagatcagatccaagccttttggcattaactaccttaaaacattaagatatcaccagcaatttgcctctgtttcagaaaattaaaagcatatttgagatataaacatgagtgtgtcactaatattactggcaataattgagagctattcttttattataatgaggggaaaacagaggatattctcagat

SEQ ID NO: 112602 - DNA, 601 bp, Human
gcccatcaccatgcccggctaatttttgtggttttagtagagacagggtttctccatgttggccaggctggcattgaactcctgacctcaagtgatctgcccgccttagcctcccaaagtgctgggattacaggtgtgagccactgcgcccagctacatcttcccttatacacagaagtgagatggctttttaaaggtagatccctggccagagtttttgagttatgagaactactccagagatttttagaacaacaatcaccactggcagcacatttcagtgacacagaatgggtcccaraacttgcctatttgtgtgacatattcaacctagtcaacaaactcaatctgtcacttcaggggagaatgagaactgtgttcaagtcagcaaaagggtctgcattaaaagccaaagtagaattatgggggtgatgagtgaacattgggatttctgatatgttttaaacattagctgtgatttataaagaggctgagccagggccttctttctcacagctggtacatgatcacttacctcagctttcaaaagcatttgagtattactcaaaagaccccaaactgggaagaaatggatccatga

SEQ ID NO: 112603 - DNA, 601 bp, Human
ttctgtatcagaaaacatatttctatataaagttttatgtagcaatttattggtttttctttcccctcatttcctttagtagataactcaacccttcaaaaattctgaaaagttcgaaatcctggctttttgccagagcatcatggccacatcccacttttgtctctattcttatctaatgcatttcatattttaaggaaaatcccaagggaatctttgtgtggtttgtgtcttctcgcgagcattggaaggacagaaagtctgccagtctgtacagaaagtttcatatactgaccatgcwaaaataaggcacaatcattgcaatgttatcacttctgggaaaatatatccagaatgcaaaataatgttagaaacatgttatgcatcagtagaagccaacttactacctagattagatctattatgatacagaagctttggcaagcatgtcaactgtcatatttttccccaaagtactaagttattttacattattttgagatatcttctatgttcaatcaaaacctctgatcaatctaatttgagctaaaattactaaatttaaaaaatacttgttattttagtgagaaaagttcagatc

SEQ ID NO: 112604 - DNA, 601 bp, Human
aggacttctttactttttgtaaggaatcactccagtttttctgttctttggtgaggatgatcaagtttgcctatcaaattatttttggaaaggagctccagaattttgtttgaggattgttggatcagtagcttatagttctatatgtgtatattttgaatcaaaactaaatgccagttaaaagagcctcctggaggaaagtgagttaagggcatactggatctccccgtgtttcttacaagtttatgactctacaattaccttaacattaaaagctataaaaaaaggtttttttttttttaactcaaagaaacacctgaaaattatattattaatgaaaggacacatgaattatatttcccattcatgtaaaacagatattttgtaaatttataggcatattcttgtagtgaaattctattatttatattaagttgtaactatattagtttttatgtcccttaaaacatgaatagcccaggtagtattgtgaatctatttaagggtctttggacaatttagttcaatcacttaggaagacctaggaggagaagggtacgcttttagaaaatgaaaatataaagtcaaatacgtaatggct

SEQ ID NO: 112605 - DNA, 601 bp, Human
tatatgttttcactcttcccatagagatagagtggcttagcttattctcgagagatgaataccttctttcctattccttcacaggttagccttatggaggccaatagaaatgcttgagtttcccctgttgccaagttgacataaccagagactttgccaagactacatgtcagagacccttctgtccatgtatctgtaggaagtctctgacctaacacagcactccttttcatcaaaagagatatatctcactctatttgcaagccaaaaccaaggaaagattgtgaaggatgaaggagayattatttgtgtttttttacatccatttcccttatgctggtagtttccctaaggtacacacacacacacacacacacacgcacatttatttgcatattctgaaaaatattttcttaattcacacaatagccctctaaggatactgttgttagtctcgattacaaatataaaaacggaagatacttaggttatttaactcacacacacacaggtggtaaggtgataaaggtcggtaataatggatgttaacacttaagcctctgacttttagactctattgctccccatctctgactacttt

SEQ ID NO: 112606 - DNA, 601 bp, Human
taatatttaaatataacattcaaatgatgatttaactggctgaaagtaagaaggaaaggtaaattatttaaggtaaggattttgataaaacaaaaataattctgtatttgaaaggaatataaatccttagtgtggatttacttttattctctttatctcagtctgtctaaaactatatacttttcaaagcagagtaatttttaaaatatggataattatgttcatttcaatcaataaatggggtacagtttagagactaatgaaggactgagattgtttgaggtgatttcatatttcagaygaagctaggtatagaaaagtgggagtgtatgcttaatgttaattttcctccccaaaattaatttatagagtaatgtttcttaaattgaagtgcacatgtatcagcctttttatttcagatgttttaaatatttgggccaaaggtaccaaatctctagaggaggggcctcaaaatatatgttgttgacaggatctaagcaaatcataagcagttatgtataaaaagaaaattcaggctacagcaaggactcaaaagcagggttcagggagtttttttaaaagaagtttggattttttccag

SEQ ID NO: 112607 - DNA, 601 bp, Human
gtgctttgaatattatatggtttaagtgcctagagtgattgtcaagaagtagacatctcactaacaatatttgtgatgagtcagtaataaagaatagtgttataatgcttcttttacagtaataaccaggggccccatgggaaaaaatagaactgaaggaaagatatgggcttgtcaagtttgcaaactttacctacaaatccataataaatacacacacacattcataagaaagcagagcttatagcaaaaccacaatagttctgcataaccaaaagggggggatgtctttcttccaaayatcaaatttcttaatttaatgaaattatttgcaatattctatagcttggaattttgacagattttgctcgtgaactctagggattgaaaactaggacatggaattcctcgttttgtgaactactatgttgaagaaattatgagcatggtgaatagcaatgcctacattgtatcttaaggacttggatcctgggaagttccatcccatagccatagagctttggttttgttcaggaggccaattggatttaaggagacattcctggacaaggcttcgctctcactcactccacaaatccag

SEQ ID NO: 112608 - DNA, 601 bp, Human
agtaaatctcagaaccacaaaacacattctgtttgaaagcacatgatacattttaattgatcatcatagccactttttgaaagcccttttaaaaagctgatgtgctttgaatattatatggtttaagtgcctagagtgattgtcaagaagtagacatctcactaacaatatttgtgatgagtcagtaataaagaatagtgttataatgcttcttttacagtaataaccaggggccccatgggaaaaaatagaactgaaggaaagatatgggcttgtcaagtttgcaaactttacctacaartccataataaatacacacacacattcataagaaagcagagcttatagcaaaaccacaatagttctgcataaccaaaagggggggatgtctttcttccaaatatcaaatttcttaatttaatgaaattatttgcaatattctatagcttggaattttgacagattttgctcgtgaactctagggattgaaaactaggacatggaattcctcgttttgtgaactactatgttgaagaaattatgagcatggtgaatagcaatgcctacattgtatcttaaggacttggatcctgggaagttc

SEQ ID NO: 112609 - DNA, 601 bp, Human
caggtcttctgactcccaggcagggtggggcaggcctggttcccccataccatgctgcctgctgtatgcagattgagagaaatggcctctgccccatattcctgacagagagggaagcctggatctggttttatttataattcttgagacaaggtcttactctatcacccaggctggagtgcagtggcaccttcacggttcactgcacccttgacctcccaggctcaagcattcctcccaccttcctcccaagtagctgggactgcaggcacaggccaccatgccctgctaatttttttgktttttttttgtagagactgaggtttcactttgttgcccaggctggtctcaacctcctgggcccaagtgatcctcccaccttggcctcccaaagtgctgggattacaggcatgagccactgcacccagcctggatctgatgaaaagttaggtggaaactcatgggtgaatccccaggtatttgcacagctccttaactgtctttctcctggttgggtccacaggactgtggaagaatgaggtcctccctgacacctttggggccccctgtgagccgcgaccgtgtcatcgccagcttccct

SEQ ID NO: 112610 - DNA, 601 bp, Human
ttaattagcttctaaatctaggatagtataggggacaagaggtatggttgtgggtttgggttgaaatctcttagtaaggtttgacaattcaggaattgttggaattggttggggaggataggtagatacataattactaattactaatgtatttgtcaattctttgggttcttataagtcaatgttatgatcagatgtaaggatgctgtatctgtgcatcactctgtggccatgcatatgactccttttgtgcctatataagtttgtgaacgtggagggttttcatatttttatttttactttttttttttttgagatggagtctcgctctgtcacccaggctggagtgcagtggtgtgatctcagctcactgcagcctccgcctcccaggttcaagcaattctgcctcagcctcacaagtagctggaactacaggagtgccaccacacccggacaatttttttgtgttcttagtagagacggggtttcaccatgttggccaggctggtctcaaactcctgacctcaagtgatctgccctgccttggactcccaaagtgctgagattatactttgagtcaccaagcctggcccatattttt

SEQ ID NO: 112611 - DNA, 601 bp, Human
atctcagctcactgcagcctccgcctcccaggttcaagcaattctgcctcagcctcacaagtagctggaactacaggagtgccaccacacccggacaatttttttgtgttcttagtagagacggggtttcaccatgttggccaggctggtctcaaactcctgacctcaagtgatctgccctgccttggactcccaaagtgctgagattatactttgagtcaccaagcctggcccatatttttatttatttatttgagatggagtcttgctctgtcgcgcccaggctggaatgcagtggcgygatttcggctcactgcaacctccgcctcctgggttcaagtgattctcctgcctcagctttctgactagttgggattacaggtgcccgccaccacgcccagctaatttttttgtatttttagtagagacggggtttcatcatgttggtcaggctggtcttgaactcctgacctcaggtaatctgcctgcctcggcctcccaaagtgctgggattacaggcatgagccactgcgcctggccccatatttttatttttattttacttaatttttttcctcaacactagatgaccagggagggt

SEQ ID NO: 112612 - DNA, 601 bp, Human
ctctgtcgcgcccaggctggaatgcagtggcgcgatttcggctcactgcaacctccgcctcctgggttcaagtgattctcctgcctcagctttctgactagttgggattacaggtgcccgccaccacgcccagctaatttttttgtatttttagtagagacggggtttcatcatgttggtcaggctggtcttgaactcctgacctcaggtaatctgcctgcctcggcctcccaaagtgctgggattacaggcatgagccactgcgcctggccccatatttttatttttattttacttaatktttttcctcaacactagatgaccagggagggtgtttttaaactatagcattattacgttgctctttgtcttgtcaagtagggcttactgtgtttctgttttggaaagggttgtagatgcatttgcttatgtaatttgtgtattttccatactcagttaaattttatttatttgtttatttatttattttgagacagagtcttaccctgtcacccaggctggagtccagtggcgcgatcctggctccctgcaacctcagtctcctgggttcaagcgattctcccgcctcaacctcctgggt

SEQ ID NO: 112613 - DNA, 601 bp, Human
aataaataaaataaaataaaataaaacataaaaggtaggattattttattttgaaatacatacttcacttatcaggaaagatgtttcctgaggagcccatgacagtcatagttttcttactctttattggctggtggtaaatatgggaatgccgtcaacaaatgtataatgcctaataaaggcggacttttttctcaggaagtagtgttaaatttttttttcctttctttggaattaaaatagttactgaaggggaaaaatgtggatttcaaagagggattctgcaagataattttgtgtktttttttttttaaacatcagttttaatgcccttcagtaacttggttcattaaaaaaaaaaaaaaaaaggctgaagtaaaaagagacagggtctcaacactgtttcttcaatgtttgaagaagttgccaaagtagagagatttgagtataggtgagatcgaaagaggaaatgtttgggactaaaggaatttcaaacttgtaaagggcctaaccacgcctttcttgacatcatctctctggcatgtgttattataatttaactcctcataggatcaacaaccatttcctttggaaaaaaaga

SEQ ID NO: 112614 - DNA, 601 bp, Human
tttcttcttcttctagccattgtttcatttctcttcttccctttacagtaaaacatcttgaaagagctatctattcaagaatcatatatacttgctgtctccaatttatttccttccattcttttttcttttattatcttgaatatattgtcagataatacaaaagtttacatgtagttataaagtgtaataatagaggaacacctgtaagaggtactctcaagtactagactagattcattgcctgtaaattacgtacacatgaatttctccatctcatcctctgcacctcttctagagstaaccactgtcctaaattctgtatttattactctcttgctttttattttattttattttattttattttttgagactgggtctcactttgtcactcgggctggagtgcagtggctcgatcgtggctcactgcagcctcgacctccctggctcaagcaatcctcccacctcagcctcctgagtagctaggattacagatgtgcgtcaccatgcccagctaatttttaaattttttgtggagacagggtctcactctgtcatccagagtggagtgcagtggcatgatcgtagctcagtgcag

SEQ ID NO: 112615 - DNA, 601 bp, Human
tattgtcagataatacaaaagtttacatgtagttataaagtgtaataatagaggaacacctgtaagaggtactctcaagtactagactagattcattgcctgtaaattacgtacacatgaatttctccatctcatcctctgcacctcttctagaggtaaccactgtcctaaattctgtatttattactctcttgctttttattttattttattttattttattttttgagactgggtctcactttgtcactcgggctggagtgcagtggctcgatcgtggctcactgcagcctcgacctcmctggctcaagcaatcctcccacctcagcctcctgagtagctaggattacagatgtgcgtcaccatgcccagctaatttttaaattttttgtggagacagggtctcactctgtcatccagagtggagtgcagtggcatgatcgtagctcagtgcagcctggaactcctgggctcctgtgatcctcctgcctcagcttcccaagtaggtaggactataggcactcaccaccacacctggctaattttaaaatttttttgtagacacagggactcgctatgttgcccaagatggtctcgaact

SEQ ID NO: 112616 - DNA, 601 bp, Human
ctacaggtgcatgccactacacctggcttatttttgtgtttttagtagagacagggtttcaccatgttgaccaggttggtctcgaactcctgacttcaagtgattcgcccaccttggcctcccaaagtgctgggattacaagcatgagccactgcgcccagcagccctgttactttttaaaaacatagttttagttttctgtggaagaaagtgaagccagtttacttctatactgccattttggactgaaagtctttcccaaaaaacatagttttaaaatcatgtttaattaacttgtttrcactgttctaagtactttgtataactgtatataattatatctatataatatatagttatataactatattttatcttatttaatccttacaacttcattattattattcccatcttatagatgaggaaaagtgagttacagagagtttgaaaatcatactgctagtgaatggcccaactgggatttgaacccgggtaatctagttccaaatctgtgcttgcaaccactgctgtagtgtcttattgcagcacatagtcttctgtttttgtttttgtttttttaccttcagttttgtgtttt

SEQ ID NO: 112617 - DNA, 601 bp, Human
gtagagacagggtttcaccatgttgaccaggttggtctcgaactcctgacttcaagtgattcgcccaccttggcctcccaaagtgctgggattacaagcatgagccactgcgcccagcagccctgttactttttaaaaacatagttttagttttctgtggaagaaagtgaagccagtttacttctatactgccattttggactgaaagtctttcccaaaaaacatagttttaaaatcatgtttaattaacttgtttgcactgttctaagtactttgtataactgtatataattatatctayataatatatagttatataactatattttatcttatttaatccttacaacttcattattattattcccatcttatagatgaggaaaagtgagttacagagagtttgaaaatcatactgctagtgaatggcccaactgggatttgaacccgggtaatctagttccaaatctgtgcttgcaaccactgctgtagtgtcttattgcagcacatagtcttctgtttttgtttttgtttttttaccttcagttttgtgttttcacgattcattcatgttgcatatagatgtggtttatccattttt

SEQ ID NO: 112618 - DNA, 601 bp, Human
gttttctgtggaagaaagtgaagccagtttacttctatactgccattttggactgaaagtctttcccaaaaaacatagttttaaaatcatgtttaattaacttgtttgcactgttctaagtactttgtataactgtatataattatatctatataatatatagttatataactatattttatcttatttaatccttacaacttcattattattattcccatcttatagatgaggaaaagtgagttacagagagtttgaaaatcatactgctagtgaatggcccaactgggatttgaacccrggtaatctagttccaaatctgtgcttgcaaccactgctgtagtgtcttattgcagcacatagtcttctgtttttgtttttgtttttttaccttcagttttgtgttttcacgattcattcatgttgcatatagatgtggtttatccattttttcatgctttacaatatttcatttgtgaatatactgtaatttatccattctcctaccaagggatttttggattgtttctagattgtgtttgttcatttttgctgtttttgaaattgctgttctgaacattcttctgtatatagtatcctt

SEQ ID NO: 112619 - DNA, 601 bp, Human
tctatataatatatagttatataactatattttatcttatttaatccttacaacttcattattattattcccatcttatagatgaggaaaagtgagttacagagagtttgaaaatcatactgctagtgaatggcccaactgggatttgaacccgggtaatctagttccaaatctgtgcttgcaaccactgctgtagtgtcttattgcagcacatagtcttctgtttttgtttttgtttttttaccttcagttttgtgttttcacgattcattcatgttgcatatagatgtggtttatccattttttcatgctttacaatatttcatttgtgaatatactgtaatttatccattctcctaccaagggatttttggattgtttctagattgtgtttgttcatttttgctgtttttgaaattgctgttctgaacattcttctgtatatagtatccttgtgctagagtttctcttgggtttctacctaagagtgggattgctgagccatcaggtatgcgaatattccactttgggagataatgctaaatttatttccaaagtattgtaccaaatctgtttccatcaacaatgtataaaatttgtc

SEQ ID NO: 112620 - DNA, 601 bp, Human
cattttttcatgctttacaatatttcatttgtgaatatactgtaatttatccattctcctaccaagggatttttggattgtttctagattgtgtttgttcatttttgctgtttttgaaattgctgttctgaacattcttctgtatatagtatccttgtgctagagtttctcttgggtttctacctaagagtgggattgctgagccatcaggtatgcgaatattccactttgggagataatgctaaatttatttccaaagtattgtaccaaatctgtttccatcaacaatgtataaaatttrtcatagatttacatcctttccattttttgataatgtcagacttctctcattccctcttaaagcaaactaattaggcttttattcctaccactccaccaaaactgcttttttgaaagtctgcagtgactcatgttattaagtaaatgtttatttatttatttattttttatgatggaggctcgctctgtcgcccaggctggagtgcagtggcacgttctcggctcactgcaacctccgcctcccagcttcacgtcattctcctgcctcagcctcccgaatagcagggactacaggcgcccg

SEQ ID NO: 112621 - DNA, 601 bp, Human
tttaccatcttgaacttttttttttttttttgagacggagtcttgctctgttgtgcaggctggagtgcagtggcatgatcttggctcactgcaacctccgcctcccaggttcaagtgattctcctgccacagcctcccaagtagctgggattacgggcacctgccatcacacctggctaatttttgtatttttagtagagacgagttttcaccaggttggtcaggctggccttgaactcctgacctcaagcagtccactcacctcagcctcccaaagtgctgggattacaggcgtgaggcrcccaccttgcctggctcatcttgaacattttagtatacagtttagtagcattaagtgcatttacattgttgtgcaacccatctccagaattcttttcatcttacaaaactgaaactctatacccattaaacaactccacattctcctctccctccagcctctggcaaccactgttctactttctgtctcgatgaatttgactatcctatgtaccttatgtaagtggaatcatacagtatttctgtgactgtcttatttcacttggtgtaatgtcctcgtggttcacctatgttgtagctt

SEQ ID NO: 112622 - DNA, 601 bp, Human
ctcctgacctcaagcagtccactcacctcagcctcccaaagtgctgggattacaggcgtgaggcgcccaccttgcctggctcatcttgaacattttagtatacagtttagtagcattaagtgcatttacattgttgtgcaacccatctccagaattcttttcatcttacaaaactgaaactctatacccattaaacaactccacattctcctctccctccagcctctggcaaccactgttctactttctgtctcgatgaatttgactatcctatgtaccttatgtaagtggaatcatacartatttctgtgactgtcttatttcacttggtgtaatgtcctcgtggttcacctatgttgtagcttgtgtcagtgtttccttgcctttcaccctgaataatgtttcattgtatgtacaacatatagcacatatttgtttattcattttcccattgatggatacttgggttgcttctaccttttggctgttgtgaataatgtcgctatgaacttgagtgtacaaatacattcaagtgtccctttgagacactgctttcaattcttttgggtatatacccagaagtggaattgctacatcatat

SEQ ID NO: 112623 - DNA, 601 bp, Human
acctcaagcagtccactcacctcagcctcccaaagtgctgggattacaggcgtgaggcgcccaccttgcctggctcatcttgaacattttagtatacagtttagtagcattaagtgcatttacattgttgtgcaacccatctccagaattcttttcatcttacaaaactgaaactctatacccattaaacaactccacattctcctctccctccagcctctggcaaccactgttctactttctgtctcgatgaatttgactatcctatgtaccttatgtaagtggaatcatacagtatttytgtgactgtcttatttcacttggtgtaatgtcctcgtggttcacctatgttgtagcttgtgtcagtgtttccttgcctttcaccctgaataatgtttcattgtatgtacaacatatagcacatatttgtttattcattttcccattgatggatacttgggttgcttctaccttttggctgttgtgaataatgtcgctatgaacttgagtgtacaaatacattcaagtgtccctttgagacactgctttcaattcttttgggtatatacccagaagtggaattgctacatcatatggcaag

SEQ ID NO: 112624 - DNA, 601 bp, Human
tacaggcgtgaggcgcccaccttgcctggctcatcttgaacattttagtatacagtttagtagcattaagtgcatttacattgttgtgcaacccatctccagaattcttttcatcttacaaaactgaaactctatacccattaaacaactccacattctcctctccctccagcctctggcaaccactgttctactttctgtctcgatgaatttgactatcctatgtaccttatgtaagtggaatcatacagtatttctgtgactgtcttatttcacttggtgtaatgtcctcgtggttcayctatgttgtagcttgtgtcagtgtttccttgcctttcaccctgaataatgtttcattgtatgtacaacatatagcacatatttgtttattcattttcccattgatggatacttgggttgcttctaccttttggctgttgtgaataatgtcgctatgaacttgagtgtacaaatacattcaagtgtccctttgagacactgctttcaattcttttgggtatatacccagaagtggaattgctacatcatatggcaagtctatttttaactttttcaggaaccactgtcctgttttcaacac

SEQ ID NO: 112625 - DNA, 601 bp, Human
gaaactctatacccattaaacaactccacattctcctctccctccagcctctggcaaccactgttctactttctgtctcgatgaatttgactatcctatgtaccttatgtaagtggaatcatacagtatttctgtgactgtcttatttcacttggtgtaatgtcctcgtggttcacctatgttgtagcttgtgtcagtgtttccttgcctttcaccctgaataatgtttcattgtatgtacaacatatagcacatatttgtttattcattttcccattgatggatacttgggttgcttctrccttttggctgttgtgaataatgtcgctatgaacttgagtgtacaaatacattcaagtgtccctttgagacactgctttcaattcttttgggtatatacccagaagtggaattgctacatcatatggcaagtctatttttaactttttcaggaaccactgtcctgttttcaacactgcacaagggttccaatttctctgcatccttaccaacacttgttgttttctgcctttttttttttttttataagtagccatcctgatgggtgtgaggtggtatcccatggttttgatttctgttt

SEQ ID NO: 112626 - DNA, 601 bp, Human
ccacattctcctctccctccagcctctggcaaccactgttctactttctgtctcgatgaatttgactatcctatgtaccttatgtaagtggaatcatacagtatttctgtgactgtcttatttcacttggtgtaatgtcctcgtggttcacctatgttgtagcttgtgtcagtgtttccttgcctttcaccctgaataatgtttcattgtatgtacaacatatagcacatatttgtttattcattttcccattgatggatacttgggttgcttctaccttttggctgttgtgaataatgtygctatgaacttgagtgtacaaatacattcaagtgtccctttgagacactgctttcaattcttttgggtatatacccagaagtggaattgctacatcatatggcaagtctatttttaactttttcaggaaccactgtcctgttttcaacactgcacaagggttccaatttctctgcatccttaccaacacttgttgttttctgcctttttttttttttttataagtagccatcctgatgggtgtgaggtggtatcccatggttttgatttctgtttctctaatgattagtgatgttgaacg

SEQ ID NO: 112627 - DNA, 601 bp, Human
attgtatgtacaacatatagcacatatttgtttattcattttcccattgatggatacttgggttgcttctaccttttggctgttgtgaataatgtcgctatgaacttgagtgtacaaatacattcaagtgtccctttgagacactgctttcaattcttttgggtatatacccagaagtggaattgctacatcatatggcaagtctatttttaactttttcaggaaccactgtcctgttttcaacactgcacaagggttccaatttctctgcatccttaccaacacttgttgttttctgcctttttttttttttttataagtagccatcctgatgggtgtgaggtggtatcccatggttttgatttctgtttctctaatgattagtgatgttgaacgtcttttcacatttgtgaaatgtcatttgtaaatcttctttggagataagtctattcaagtcctttgcttattttattttatttatttatttatttatttgagacagagttttgctctttttgcccaggctggagtgcaatggcatgatctcggctcattgcaacctccacctcttgggttcaagtgactctcctgcctccgcctc

SEQ ID NO: 112628 - DNA, 601 bp, Human
ctgcctttttttttttttttataagtagccatcctgatgggtgtgaggtggtatcccatggttttgatttctgtttctctaatgattagtgatgttgaacgtcttttcacatttgtgaaatgtcatttgtaaatcttctttggagataagtctattcaagtcctttgcttattttattttatttatttatttatttatttgagacagagttttgctctttttgcccaggctggagtgcaatggcatgatctcggctcattgcaacctccacctcttgggttcaagtgactctcctgcctcmgcctcccgggtagctgggattacagacgtgcaccaccacgcccagctaatttttgtatttttagtagagatggggttttgccatgttggccaggctggtgtcgaactcctggcctcatgtgatccacccacctcagtctcccaaagtgcctggaattacaggcatgagccaccacacccggcccatctttgggattttgatagggattacattgaatctgcagattacaggcatgagccactacacctagcccatttttgggattttgatatggattacactgaatctgcagattgcttt

SEQ ID NO: 112629 - DNA, 601 bp, Human
ggtgtgaggtggtatcccatggttttgatttctgtttctctaatgattagtgatgttgaacgtcttttcacatttgtgaaatgtcatttgtaaatcttctttggagataagtctattcaagtcctttgcttattttattttatttatttatttatttatttgagacagagttttgctctttttgcccaggctggagtgcaatggcatgatctcggctcattgcaacctccacctcttgggttcaagtgactctcctgcctccgcctcccgggtagctgggattacagacgtgcaccaccaygcccagctaatttttgtatttttagtagagatggggttttgccatgttggccaggctggtgtcgaactcctggcctcatgtgatccacccacctcagtctcccaaagtgcctggaattacaggcatgagccaccacacccggcccatctttgggattttgatagggattacattgaatctgcagattacaggcatgagccactacacctagcccatttttgggattttgatatggattacactgaatctgcagattgctttgagtagtactgatatcttttttttttttttttttttctg

SEQ ID NO: 112630 - DNA, 601 bp, Human
tagtagagatggggttttgccatgttggccaggctggtgtcgaactcctggcctcatgtgatccacccacctcagtctcccaaagtgcctggaattacaggcatgagccaccacacccggcccatctttgggattttgatagggattacattgaatctgcagattacaggcatgagccactacacctagcccatttttgggattttgatatggattacactgaatctgcagattgctttgagtagtactgatatcttttttttttttttttttttctgagacggagtctcaggctgtctcrctctgtcacccaggctggagtgcagtgatctcagcttactgcaacctccgcctccctggtacaagcaattctctgcttcagcctcctgagtagctgggattacaggtgcctgccaccaagcccggctaatttttgtatttttagtagagatggggtttcaccatcttggccaggctggtcttgaactcctgacctcgtgatccacccgccttggcctcccaaagtgctgggattacaggcgtgagccaccacacctggccctgatatcttaacaatgttaatgcttccaatccatgagca

SEQ ID NO: 112631 - DNA, 601 bp, Human
gtgatccacccacctcagtctcccaaagtgcctggaattacaggcatgagccaccacacccggcccatctttgggattttgatagggattacattgaatctgcagattacaggcatgagccactacacctagcccatttttgggattttgatatggattacactgaatctgcagattgctttgagtagtactgatatcttttttttttttttttttttctgagacggagtctcaggctgtctcgctctgtcacccaggctggagtgcagtgatctcagcttactgcaacctccgcctccckggtacaagcaattctctgcttcagcctcctgagtagctgggattacaggtgcctgccaccaagcccggctaatttttgtatttttagtagagatggggtttcaccatcttggccaggctggtcttgaactcctgacctcgtgatccacccgccttggcctcccaaagtgctgggattacaggcgtgagccaccacacctggccctgatatcttaacaatgttaatgcttccaatccatgagcatggagtgtctttccatatatttgtgtcttctgcaatttcttttagtaatgtttttgg

SEQ ID NO: 112632 - DNA, 601 bp, Human
ccaccacacccggcccatctttgggattttgatagggattacattgaatctgcagattacaggcatgagccactacacctagcccatttttgggattttgatatggattacactgaatctgcagattgctttgagtagtactgatatcttttttttttttttttttttctgagacggagtctcaggctgtctcgctctgtcacccaggctggagtgcagtgatctcagcttactgcaacctccgcctccctggtacaagcaattctctgcttcagcctcctgagtagctgggattacaggygcctgccaccaagcccggctaatttttgtatttttagtagagatggggtttcaccatcttggccaggctggtcttgaactcctgacctcgtgatccacccgccttggcctcccaaagtgctgggattacaggcgtgagccaccacacctggccctgatatcttaacaatgttaatgcttccaatccatgagcatggagtgtctttccatatatttgtgtcttctgcaatttcttttagtaatgtttttggctttcactgtacaagtcttttgcctccttggttaaccttattcttaagca

SEQ ID NO: 112633 - DNA, 601 bp, Human
ccatctttgggattttgatagggattacattgaatctgcagattacaggcatgagccactacacctagcccatttttgggattttgatatggattacactgaatctgcagattgctttgagtagtactgatatcttttttttttttttttttttctgagacggagtctcaggctgtctcgctctgtcacccaggctggagtgcagtgatctcagcttactgcaacctccgcctccctggtacaagcaattctctgcttcagcctcctgagtagctgggattacaggtgcctgccaccaagcccggctaatttttgtatttttagtagagatggggtttcaccatcttggccaggctggtcttgaactcctgacctcgtgatccacccgccttggcctcccaaagtgctgggattacaggcgtgagccaccacacctggccctgatatcttaacaatgttaatgcttccaatccatgagcatggagtgtctttccatatatttgtgtcttctgcaatttcttttagtaatgtttttggctttcactgtacaagtcttttgcctccttggttaaccttattcttaagcatattattatttttg

SEQ ID NO: 112634 - DNA, 601 bp, Human
tgggattacaggcgtgagccaccacacctggccctgatatcttaacaatgttaatgcttccaatccatgagcatggagtgtctttccatatatttgtgtcttctgcaatttcttttagtaatgtttttggctttcactgtacaagtcttttgcctccttggttaaccttattcttaagcatattattatttttggtgctattagaaatggaacagttttaatttccttttcaaatcattcgttgttagttatataaaattcagaaattcttttttttttttgagacagagtcttgctctgktgcccaggctggagtgcggtggcgcaatctcggcttactgcaacctccgcctcccaggttcaaacaattctcctgcctcagccacgcaagtagctgggattacacgtgcacaccaccacgcccagctaactttttgtatttttagtagagatgaggtttcaccatgttggccagggtggtctggaactcctgaactcaagtgattcacccacctcagcctcccaaagtactaggattacaggcgtgagccactgcgcccagccagaattcagcaattctataagtctatgtttgtgtatt

SEQ ID NO: 112635 - DNA, 601 bp, Human
agcatattattatttttggtgctattagaaatggaacagttttaatttccttttcaaatcattcgttgttagttatataaaattcagaaattcttttttttttttgagacagagtcttgctctgttgcccaggctggagtgcggtggcgcaatctcggcttactgcaacctccgcctcccaggttcaaacaattctcctgcctcagccacgcaagtagctgggattacacgtgcacaccaccacgcccagctaactttttgtatttttagtagagatgaggtttcaccatgttggccaggstggtctggaactcctgaactcaagtgattcacccacctcagcctcccaaagtactaggattacaggcgtgagccactgcgcccagccagaattcagcaattctataagtctatgtttgtgtattgattcagcaaatcagatattgcctttctgttatagagggtaaagatttatttctcttaaaccccgtgcccttatgttccagcttcccctttcttcacaccttctgtttataagttgtgtcatgatttttagttaaaccagtattcagtatttatattattatgattttataagtat

SEQ ID NO: 112636 - DNA, 601 bp, Human
caatctcggcttactgcaacctccgcctcccaggttcaaacaattctcctgcctcagccacgcaagtagctgggattacacgtgcacaccaccacgcccagctaactttttgtatttttagtagagatgaggtttcaccatgttggccagggtggtctggaactcctgaactcaagtgattcacccacctcagcctcccaaagtactaggattacaggcgtgagccactgcgcccagccagaattcagcaattctataagtctatgtttgtgtattgattcagcaaatcagatattgcctytctgttatagagggtaaagatttatttctcttaaaccccgtgcccttatgttccagcttcccctttcttcacaccttctgtttataagttgtgtcatgatttttagttaaaccagtattcagtatttatattattatgattttataagtattatttctagctaagctatataatatgctatgataatagttcctttgttcaatttttgttttccctggagttaataattaccttgttttcttagttttattttgtataatagacagtatttttacataccagttactgttcttttatttt

SEQ ID NO: 112637 - DNA, 601 bp, Human
gggattacacgtgcacaccaccacgcccagctaactttttgtatttttagtagagatgaggtttcaccatgttggccagggtggtctggaactcctgaactcaagtgattcacccacctcagcctcccaaagtactaggattacaggcgtgagccactgcgcccagccagaattcagcaattctataagtctatgtttgtgtattgattcagcaaatcagatattgcctttctgttatagagggtaaagatttatttctcttaaaccccgtgcccttatgttccagcttcccctttcttcmcaccttctgtttataagttgtgtcatgatttttagttaaaccagtattcagtatttatattattatgattttataagtattatttctagctaagctatataatatgctatgataatagttcctttgttcaatttttgttttccctggagttaataattaccttgttttcttagttttattttgtataatagacagtatttttacataccagttactgttcttttattttttttgagatggagtttcgttcgctcttgttgcccagactggagtgcaatggcgtgatctcggctcactgca

SEQ ID NO: 112638 - DNA, 601 bp, Human
tgcacaccaccacgcccagctaactttttgtatttttagtagagatgaggtttcaccatgttggccagggtggtctggaactcctgaactcaagtgattcacccacctcagcctcccaaagtactaggattacaggcgtgagccactgcgcccagccagaattcagcaattctataagtctatgtttgtgtattgattcagcaaatcagatattgcctttctgttatagagggtaaagatttatttctcttaaaccccgtgcccttatgttccagcttcccctttcttcacaccttctgtktataagttgtgtcatgatttttagttaaaccagtattcagtatttatattattatgattttataagtattatttctagctaagctatataatatgctatgataatagttcctttgttcaatttttgttttccctggagttaataattaccttgttttcttagttttattttgtataatagacagtatttttacataccagttactgttcttttattttttttgagatggagtttcgttcgctcttgttgcccagactggagtgcaatggcgtgatctcggctcactgcaacctctgcctc

SEQ ID NO: 112639 - DNA, 601 bp, Human
tataagtctatgtttgtgtattgattcagcaaatcagatattgcctttctgttatagagggtaaagatttatttctcttaaaccccgtgcccttatgttccagcttcccctttcttcacaccttctgtttataagttgtgtcatgatttttagttaaaccagtattcagtatttatattattatgattttataagtattatttctagctaagctatataatatgctatgataatagttcctttgttcaatttttgttttccctggagttaataattaccttgttttcttagttttattttrtataatagacagtatttttacataccagttactgttcttttattttttttgagatggagtttcgttcgctcttgttgcccagactggagtgcaatggcgtgatctcggctcactgcaacctctgcctcccaggttcaagtgattctcctccctcagcctcctgagcataccagttactgttctaagccctttataaaatttaactcacataaaccttctaaaaactgagaggccggatgcttcattacattccagcttcactggccttctattccttccaaagtcccaccttatagcttt

SEQ ID NO: 112640 - DNA, 601 bp, Human
gttcctttgttcaatttttgttttccctggagttaataattaccttgttttcttagttttattttgtataatagacagtatttttacataccagttactgttcttttattttttttgagatggagtttcgttcgctcttgttgcccagactggagtgcaatggcgtgatctcggctcactgcaacctctgcctcccaggttcaagtgattctcctccctcagcctcctgagcataccagttactgttctaagccctttataaaatttaactcacataaaccttctaaaaactgagaggccrgatgcttcattacattccagcttcactggccttctattccttccaaagtcccaccttatagcttttaaccgtgtgctccctctttctggaatgatctctttcattctccgaatggctagtttcttctcatccttgaagtctttcatacttaaatgtcatctttctgactagtctaatgaaaataggccacagccttctttttgtcttttttttggtagcccatttatcacagtgggtaattattaaattattttatgattatttgattaatgtctctctccccactaaatactcctgaaa

SEQ ID NO: 112641 - DNA, 601 bp, Human
tagacagtatttttacataccagttactgttcttttattttttttgagatggagtttcgttcgctcttgttgcccagactggagtgcaatggcgtgatctcggctcactgcaacctctgcctcccaggttcaagtgattctcctccctcagcctcctgagcataccagttactgttctaagccctttataaaatttaactcacataaaccttctaaaaactgagaggccggatgcttcattacattccagcttcactggccttctattccttccaaagtcccaccttatagcttttaaccrtgtgctccctctttctggaatgatctctttcattctccgaatggctagtttcttctcatccttgaagtctttcatacttaaatgtcatctttctgactagtctaatgaaaataggccacagccttctttttgtcttttttttggtagcccatttatcacagtgggtaattattaaattattttatgattatttgattaatgtctctctccccactaaatactcctgaaaattttattagggccagagccatgtctggtttagctaagcattttgtccttggtacctaacgtagtacctag

SEQ ID NO: 112642 - DNA, 601 bp, Human
attctccgaatggctagtttcttctcatccttgaagtctttcatacttaaatgtcatctttctgactagtctaatgaaaataggccacagccttctttttgtcttttttttggtagcccatttatcacagtgggtaattattaaattattttatgattatttgattaatgtctctctccccactaaatactcctgaaaattttattagggccagagccatgtctggtttagctaagcattttgtccttggtacctaacgtagtacctagtactctaaagtgggcattgaatatttattgartgaatagatgtcagctccttttatgtttcaggcagcatgataagagttttacatgtatgtatgtatgtatttatgtatttatttgtatttacatatatgtatatatttatttatttattgcaaaaggggatctcactttctgtcccaggctggagtggagtggtgtgatcatagctcactgcagcctcaaacacctgagctcaggtgatcctcctgccttagccttccatgtagccgggactacaggtgtacactaacacacccagctgatttttaaaaaactgttttttatagagacaa

SEQ ID NO: 112643 - DNA, 601 bp, Human
tagtctaatgaaaataggccacagccttctttttgtcttttttttggtagcccatttatcacagtgggtaattattaaattattttatgattatttgattaatgtctctctccccactaaatactcctgaaaattttattagggccagagccatgtctggtttagctaagcattttgtccttggtacctaacgtagtacctagtactctaaagtgggcattgaatatttattgaatgaatagatgtcagctccttttatgtttcaggcagcatgataagagttttacatgtatgtatgtakgtatttatgtatttatttgtatttacatatatgtatatatttatttatttattgcaaaaggggatctcactttctgtcccaggctggagtggagtggtgtgatcatagctcactgcagcctcaaacacctgagctcaggtgatcctcctgccttagccttccatgtagccgggactacaggtgtacactaacacacccagctgatttttaaaaaactgttttttatagagacaaggtctcactatgttgcccagactgatctcgaactcctggcttcaagtgatcctcccacctcagtct

SEQ ID NO: 112644 - DNA, 601 bp, Human
tgaaaattttattagggccagagccatgtctggtttagctaagcattttgtccttggtacctaacgtagtacctagtactctaaagtgggcattgaatatttattgaatgaatagatgtcagctccttttatgtttcaggcagcatgataagagttttacatgtatgtatgtatgtatttatgtatttatttgtatttacatatatgtatatatttatttatttattgcaaaaggggatctcactttctgtcccaggctggagtggagtggtgtgatcatagctcactgcagcctcaaacrcctgagctcaggtgatcctcctgccttagccttccatgtagccgggactacaggtgtacactaacacacccagctgatttttaaaaaactgttttttatagagacaaggtctcactatgttgcccagactgatctcgaactcctggcttcaagtgatcctcccacctcagtcttcagagtagctgggattataggcaagaataaccacacctggctacctgcatttattttaatccccacaacagtcctatttcataggtgttgttaactgtccccattttataggtgaggtcaagcaac

SEQ ID NO: 112645 - DNA, 601 bp, Human
taatcccagcactttgggaggtcaaggcaggaggatcacttgaacccaagagttcaagaccagactaggtaacatggcaagactaagtctctacaaaaaactcaaatattagccaggtgtggtagcatgcgcctgtagtcgcagctactcgggaggctgaggtgggaagattacttgagcccaggaatttggggctacagcgaaccatgattgtgccactacactccagcctgggcagcagagtgagaccttgactcaaaaaaaaaaaaaaaccccaaaaccgctaagtctctgcgacttytgagccagtgttttaaccattttctgttggttaatgggatttatagtcaagaaaaatactttttaaaaaattgagtaaacattgattccttgcctattcagttgctgaatgaacagtgaaaaattaagttagttatataaaaagtgaatctgattttccctcatttgtaaaatgaagacattaattaggaatgaaattgatttactttaactcaaattgaattactattaaattattattttacaaataataggatttgcaaactggtagggctgtactctaacctttaccccactattt

SEQ ID NO: 112646 - DNA, 601 bp, Human
ttatttttttttgagacagggtctcactgtcatcctggtggagtgcagtagcatgatcaccactcactacagcctcaacctctgtggactcaggtgatcctcccacctcagcatccagagtagctgggactacttacgggcacatgccaccatgcccagctaatttttgcatttttctttcttttttttttgtagagacagagtttcgccatgttgcccaggctgatgtcaaactcctgggctcaagggatcttcccaccttggcctcccaaaattctgtgattacaggcatgagccacckcacctggctctagtagactttttgatgattcaggtaaaatggtaaactaaatccctttaacctgttttttggtgtcattttagactactgatttgagcatatttaaagtatgggtttttttttttaaaaaatggggcttatagttaacgaaaaccattgactgtccctgtgtttcctttttttttttcttgtttttctttttttttttttttattcagggtttcactgtgttgcctaggctggagtgcagtggcccgatcttggctcactgcagcctcaacctcctcggctcaagtgatc

SEQ ID NO: 112647 - DNA, 601 bp, Human
gggactacttacgggcacatgccaccatgcccagctaatttttgcatttttctttcttttttttttgtagagacagagtttcgccatgttgcccaggctgatgtcaaactcctgggctcaagggatcttcccaccttggcctcccaaaattctgtgattacaggcatgagccaccgcacctggctctagtagactttttgatgattcaggtaaaatggtaaactaaatccctttaacctgttttttggtgtcattttagactactgatttgagcatatttaaagtatgggttttttttttwaaaaaatggggcttatagttaacgaaaaccattgactgtccctgtgtttcctttttttttttcttgtttttctttttttttttttttattcagggtttcactgtgttgcctaggctggagtgcagtggcccgatcttggctcactgcagcctcaacctcctcggctcaagtgatcctcacaggtcagcctcctgagtagctaggactataggtgcacaccactatgttaggctaattttaaaatttttttgtagaggcagggtctccctgtgttgcccaggatggtctcaaactcctggg

SEQ ID NO: 112648 - DNA, 601 bp, Human
aaccaagatggtaagcatggcagcaaaccaatagcctcttttttcttttcttttcttttttttttttttgagacggagtttcgctcttgttgcccaggctggagtgcaatggcgcgatctcagctcaccgcaacctctgcctcccaggttcaagcgattctcctgcctcagcctcctgagtaactgggattacaggcatgcaccaccacgcccggctaatttcgtatttttagcagagacggggtttctccatgttggtcaggctggtctccaactcccgatctcaagtggatccacccgyctcagcctcccaaagtactgggattacaggcatgagccacctcgcccgggctttttttttttttttttttttttgagacggagtcttgctctgtcgcccaggctggagtgcaatggcgagaactcatctcactgcaagctctgcctcctcctgggttcacaccattctcctgccccagcctcccgagaagctgggactacaagcacgcaccaccacgcccagctaatttctgtatttttagtagagacggggttttgccatgttggccaggatggtctcggtctcttgacctcatgatct

SEQ ID NO: 112649 - DNA, 601 bp, Human
gctgggactacaggcatgtgccaccacgcctgactaatgtttgtatttttagtagagacggggtttcatcatgttggccagactggtcttgaactcctgacctcaaacgatccacccgcctcggcctcccaaagtgctgggattacaggtgtgagccaccgtacccggccataggtcatagtcttcttgactgcgttttatctttatgaaatatatatttatcacaaccttcataattttttttttttttgagacggagtctctttctgttgcccaggctggagtgcagtggtgcagtctyggctcactgcaacctctgcctcccgggttcacaccattcttctgcctcagcctcctgagtagctgggactacaggtgcatgccaccacacctggctaattttttgtattttaatagacagggtttcacctgttgcccaggctgatcttgaactcctgagctcaggcaatccacccacctcgacctcccaaagtgctgggattacgggcgtgagccactgcaccctgcctcaactaatttttgtattttttgtagagatggggtcttgttatattgcccaggctggtctcaaactcatggg

SEQ ID NO: 112650 - DNA, 601 bp, Human
cgtgatccacccccccccccttggcctcccaaagtgctggggttacaagggtgagccaccgcgcccgtcctgcatttcttttccaaacgtgctgtcgcccaggctggagtgcagtggcgcgatctcagctcactgcaagctctgcctcccgggttcacgccattctcctggctcagcctcctgagtagctgggactacaggcgcccaccaccatgcccaactaatttttttgtatttttaatagagacagggtttcaccatgttagccacaatggtctcgatctcctgacctcatgatccrcctgcctcggcctcccaaagtgctgggattacaggtgtgagccaccacgcccagcctacagactgttatctgggaaatcctaatgtaagtgctggcaaaaagagggaaaaaggaataggaaatataaaggatgtattaaaagctacaacaggattttaagtctttgggctatctcacaatgtggtattaatttcttcttctctgctaaaatatagagctaaggaacaaactatgtgtgtccaagtgagtgcacatttgtgattatatatagtttggaatcattttttcaagaggtccagg

SEQ ID NO: 112651 - DNA, 601 bp, Human
tcctaatgtaagtgctggcaaaaagagggaaaaaggaataggaaatataaaggatgtattaaaagctacaacaggattttaagtctttgggctatctcacaatgtggtattaatttcttcttctctgctaaaatatagagctaaggaacaaactatgtgtgtccaagtgagtgcacatttgtgattatatatagtttggaatcattttttcaagaggtccaggatcttcctcactctccaacatgtaaatggataatccttctacctcttcctcatgtctccctgcagccatatgtgtcaytggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccgtaagttggagtacatgtgcgtaggcttccagggacagtatagatttggttttgagacagggtctcgttatgttgtccaggctagtcttgaactcctgggctcaagtgatcctcctgtctcagtagctgggattacagatgcatgc

SEQ ID NO: 112652 - DNA, 601 bp, Human
ctactaaaaaagtcagtgagatgccgccaaggagtgaaaacaaatcaatcatcatatgttctttagggatggaaggagagatgggaaaattgcttgtttggggtattattctcaaattcattccctgacaactattttcagttagctcttgtacttctgactttgttagtgatttctgttctgtctctttaatattttcaccctcctggagtggaatgtagaggcttttttctagtggaacgcttctaatataatccctgatctgtgatacactactactcaagttttagaagttccacaygactctgctaccaaagtataattttcaaaaagttgaaaaacacaactgttaggctgggcacagtgcctcacacctgtaatcacagcactttgggaggctgaggcaggtggatcacttgaagtcaggagttcgagaccagcctgaccaacatggtgaaacaccatctctactaaaaaataccaaattagctgggtgtggtggcgcatgcctgtaatcccagctactccagaggctgaggcaggagaatcgcttgaacccgggaggcggaggttgcagcgagccgagatcacgccactgcac

SEQ ID NO: 112653 - DNA, 601 bp, Human
ctggacaacatggtgaaaccccatctctactgaaaatacagcaattagccaggcgtggtggctcatgcctgtaatcccagctacttgggagctgaggtaggagaatcgtttgaacctgggaggaggaggttgcagtgagccgagattgcaccactgtactccagcctgggcaacagagcgagactccatctaaaaaaacaaacaaaaaaatccttctgaattatatgccaagaaccaaggtgttctgtcatcaaaattgattttttatgtgtgaattgacaacttgctaaagtcccccaamtttgttgtttctaaagaattggaaaccatttgagaggagctattgtaagaggggacttcagccttgatcattagccgtcaggagctctccctcaggaagatcagatttaacagtttttgagaaacttgagattctgaaatgctccacggcctgcttaccctttggaaagactgtaaggggtagaagtacccaacagaagaccacagctctacgatacctaatgtgtggttttctctaaaaggctcaatttaaggacttttaacaatatcttcttttggctggttgcggtgactcatgcct

SEQ ID NO: 112654 - DNA, 601 bp, Human
ctgctggtccagggaccatagtgtgggaatcactagtttttgccatataaaagtttaaaatttggccaggtgtgatggctcatgcctgaaatcccagcagtttgggaggcagaggcaggcagatcacttgagctcaggagttcgagaccagcctgggcaacatggcaaaacccctgtccctacaaaaaatacaaaaattagccaggtgaggtggtgcgtgcctgtaatcccagtaactcaggaggctgaggtgggagaattgcttgagcccggagattgaggtttcagtgagctgtgatcrcgccactgtacttcatcctgtgcaacagagcaagaccatgtctcaaaaaaaaaaaaaaaaagtttaaaatttctatatagttaaatttgtctttttcttttataaataacttttgaggccaggcacggtggctcacgcctataatcccagcactttgggaggccgaggagggcggatcacaaggtcaggagatcgagaccatccagactaacacagtgaaaccccgtctctactaaaaatacaaaaaattagccgggcatggtggtgggcacctgtagtcccagctgctggggaggctga

SEQ ID NO: 112655 - DNA, 601 bp, Human
ggtacagggtggtgagaaaggggaattgcatagaaatgtaagttcaactctatccagaggcagcctaggggatcccttatccctaacccctgccctcttgcctcagggtccatcaacattgaactttcttgtttactttccagagaatggagatgacccagctcacctgacttagtatgttaccttcctcctgctatcacagccttgctgctttctctccagggcagcaatcctaggggctttcccacctcttctgctttctcttctatgcctgaaactgcctctggggtcccctgccctwtggggagtaacgtcactccccactagcgacaaaattgagtgtacctgctgctggagaggttgcagaaagatggggtggagaatgggactattgagggccctgctgagattggggaacattttctagtggggagggcacccccagacaaatacagctcacagaataaggctgacttcctccctccctttttcctgaccttcctccacacacccccttgagccggcatattaccagttactagagtaggtacagtggaagtgagttatgaagctggggtgttagcttcctggatccctgaga

SEQ ID NO: 112656 - DNA, 601 bp, Human
catccccttggcaatctctggactgagcccccttcctggcttttctggctgtctgtctgtctttctgtctgtctgtcattagtgtgcgctgtcttggctttttagaacctctctgtctctcaccctctcagttcatctcttactgccgaacctttgtgacattctctgccctgctttctgcgtctctgtcacttgtcttatttttctctgcctgtctccatttacccccatccaggcctcttggtatcccaaaagcttcttgggagcaagagtctctctgggctttcccactcaccccctrgctccctcccctctgttttggctatttttcccccttcctggccagacccagtgtccagttcagcaccaaaagtttcctctccactttcctccgacttcctctttcttcttccccctccactaatttggggaatgggttttggagagaatgtttctggaagaaaggaacttgataccctttgtgggctaagagggagaaaggaggtatttcagaaggaaggagggaggttagacttctggcagaacttcctcctgaccaggagcctaagaactggagaaagatgtaaggagtgagtcaaga

SEQ ID NO: 112657 - DNA, 601 bp, Human
gtgtggctggggtggggggagaaggagaggaggcttagaaatgcctggtgagtgatatggtgacctctggaggccttctgggggtctggcttttatttgtggggaaaggaaaagctggtgggggaggtcacgggtcaggctaatgtcctgctgcatcaatattgactcagaatggaagcggagacccttcccctcccctggctgtccaagccaccctgtctgtctgtctgtccaggccgcaaagcagaggcccagactcaggaatgacaaaaatgtgtctgagcctcaggaaagagccacygggcaacacccaaaatacaaaaaattcagtgaaaacctctcggtttgggtttgggaggcccttgctgccccacccccataaggtcgaaaattcagattcctgcaggctctgtccccgcgccgcccccccaccccaccccccgcaccttgagcatcctcctcccactctgttcccttagctatatcatgtggttccctttagagaacccccctctcacctagctcagaggggagcctatctctccttctgctgtgtccactcttaaaaagggccccaagagtccctgtcatgcttttgcag

SEQ ID NO: 112658 - DNA, 601 bp, Human
gggctgggtgcctgggtttgggggggtggggcagggtgttggccaagttagcatggcagtcacattcatcttcaggcaaagccgagaacagacggcccctgtgtcctggtgttcttcctccaaactcgctctctctccttcctctctagatctctccttcttcttctcctgcctgtcttccccttcttctgtcccattcttgctcctctctgtctcccctatgcccttccctcctctctgaggagccctgaaggccaccccttaaaatcctctccccactgccagggccagagaacgacarcgttctccctgcaatttcccttccttgttttttgtttttgttttgttttgtttttgagacacagtctcactccatcacccagactgaaatgcaatggcgtgatctctgctcactgcgacctccgcctcctgctaatttttgtatttttagtagagacagggtttcaccatgttgcccaggctggtctcaaactcttgacctcaagtgatccgcccatctccgcctccacctcccaaagtgctggtactacagacgggagccactgcgcccatctggtttcctttctttctttcttttttt

SEQ ID NO: 112659 - DNA, 601 bp, Human
tggtctcaaactcttgacctcaagtgatccgcccatctccgcctccacctcccaaagtgctggtactacagacgggagccactgcgcccatctggtttcctttctttctttcttttttttttcttttgagatggaatctcgctctgttgcccaggctggagtgcagtggcgcgatctcagttcactgcaagctccgcctcccctggttcacgccattctcctgcctcagcctcctgagtagctgggactacaggcgcctgccaccacgcccagctaatttttcatatttttagtagagacrgggtttcaccgcgttagccaggatggtctcgatctcctgacatcatgatctgcctgcttcggcctcccaaagtactgggattacaggcatgagccaccatgcccggcctggtttcctttcttaacccggctgcatcccatgacctatgaggaaaccacctgctcagttaccagtcaccctgtgcctcagctcccccatgtgtgagaggggggccgcaagggcacccacctcacagggttatagtatctaagtgagttaatagtcaccgtatttccaatcagtggctggtggttagcaagg

SEQ ID NO: 112660 - DNA, 601 bp, Human
gctaggccatccttgatgtgtttcctgaactcggtcattttggccaggggcctgagtgccgtctcccctgccagcggtgggggttaggagggaagacatctcagtgaggctcccatcagactccctccctcctaagagccccccccccccgccattttccttatacttctgtctctgccctgcatttgcattagttgggtacagctgtcttctcaggcgactctggctcctgcagggcagagggtcatctcaccctccttggcaccctgatgcctagtgcagtgcctggcatagagctggmcttcagtgtgtgccagcagaatagaaatgtgatggcacagtctgaggaaaagccacgaaaggccaggagactgggagctcagccttgggtgggggagaaggggtgggtgactgttcctcctgtggaggatgtggtgatagaggttgggaggagtgggaattcggaggactggtgtggatttcactggttcagagcttggagtcagcttagctggttttgtcacttgccagctatttgaccctggccaagtcacctggctcaatttcttcatctgtgaaatggtggtattagttgtcccta

SEQ ID NO: 112661 - DNA, 601 bp, Human
tgtggatttcactggttcagagcttggagtcagcttagctggttttgtcacttgccagctatttgaccctggccaagtcacctggctcaatttcttcatctgtgaaatggtggtattagttgtccctatttgtcatactgtggagggaattaaatatgatgatacatggaaaaaactgctttaccacagttcctggcacatactgagcccacaataagagttagttgtcagccgggtgcggtggctcacgcctgtaatcccagcactttgggaggctgagatggatgtatcagatgaggtygggagttcgagaccagcctgaccaacatggagaaaccccgtctctactaaaaatacaaaattagccatgcgtggtggcgcatgcctgtaatcccagctactctggaggctgaggcagaagaatcacttgaacccgggaggcaggggttgcagtgagccaagatcgtgccattgcactccagcctgggcaacaagagcaaaactctgtctcaaaaaaaaaaaaaaaacaacagagttagttgtcaccattcttaattcctccttgggggatgagggaagagaatggggtaggagtggaaga

SEQ ID NO: 112662 - DNA, 601 bp, Human
agcctccctgacccttgatgattggccccaggtcttgtcggatcctcagatcttcctctgtcctttggctcccaggccagaggccactggcacttgctcagccccataccagaagccccacccctgtgctcttcccgctacccccgccttcccctgcccccagtaagtggtgtaatcggaggcagctgttttaactgggagaaaggtccccgcccagcttttgccctgccaagggaagtggagaacttgttggtgggaccccagagtcctgggtagctggcacagtcctggtggctccacytttagcctctcccctgcttggttaatctgggccagggtcaaagcgcccctgcattcctaggtccgtctctgttctctctcttgggctttatcctgctccagtcccatctggtgtcctgtccccacacccccacccgtaattatcaggggtaattttagggctggaaagggagccactagtgggctctgcctcacccctacactctgccctggagggtgggggccaggggtattcagcaagtatatctacggcatggtgcttcagcctggagtctcttcttgtctggtgccacctgcaccc

SEQ ID NO: 112663 - DNA, 601 bp, Human
cctgtttgcctacaggtgtgtggctactgtggggaatattgtaaaagagttccaggtggaagagtctaactagccccgaggcctcctgagatctgaaaccccagttttatctcccctcatccccagtgaacagctgaccagagagccaccatagccagcttgttcatgcccacccttctgtctgccctcaggtccacagagtaaggcccagcgatgccagccaaacgagcataactgcctgggtactgagctgtgtgttcccatgtcccgcctctgcaatggggtccaggactgcatggayggctcagatgaggggccccactgccgaggtaaggacttttccactctctactctcccgtctggatgcagcatattatcagcccaccttccgaggactgtcctggcaccttcagtggggatgaggccttgtcctggtcccctgcctagatttaccttcagagagcagatgaaattgatgtgccccttgggcctggagcttggtcagacagccctgtgggcctcagccgtgggctgtagcctgggcacttccctctggctatgtgttcttggactagtcactacctctctccaggtggcagt

SEQ ID NO: 112664 - DNA, 601 bp, Human
gccatcgtttccctcggggaccattgccaatggactctctgctgccatcgggggagggcagtactgaggttatttctctgtggctttgtggcagtgaatgaggctgggagaggagcgtgagccacatgagattttagaatatcctggatgcttccattcaggcttctccctaggctacacttttgctatcctagttgtggaagaaggggtgtcacagaaaggggcacgagcatagctgggtgtagacccactgccgggaacagccctgcccatctcagaggctgttacaccagcaaccttaaaagtcaacatctggcagcatcacatttccaaagaaatgcaccacagggctgagaggaagaatctggcctgtggttgatctgaccccctaagggagattaacttgatctgtaactgtttagtaaaccagaattcccatctctgccttggtttcctaatctgcataatgggtttgagcttgtctgtctagatcagattaactggagtgaaagccagtggtaaaggacagcacactttgaagttgaggattgtgaaccttgggcctctctagaagatcttcaagtttctttatttggttctt

SEQ ID NO: 112665 - DNA, 601 bp, Human
ggctcctccagagcatccctgatagcgtccttgggctgctgctgtccacagctcacctgtgatcagacatgtgtcctccttggggtgctgagctgggggctgtcaagcctggttggctgagctcttaacgagtgggcgactcagggaaccccatggctgatggggtgggattggtgctagaccctcttgtgcagctgccctccccctgttccttgtccactgacctactcaacaggcctgtctgggcagacagcttgtcagtttcctccccagccctgcatcttgccatacagtgggcttstgggtaggtggctatggggtgtcctggaggtaaccttctcaacttctactctggcctcatctccttatctgacttcctccccaggagaagctggtagccctcccttggcaaacagatttgccttgcctcccagtctgctaaactcactgggcctctcaggggcagagtccaggaggctagaagagtccaaggggaaatgcttgtggggtaaatgagtgggtttctctcatcccagcttctgtcccttcctccctgccctccccctgctccacgtccctgccgcctgaatgtctggctgtc

SEQ ID NO: 112666 - DNA, 601 bp, Human
ggctgtcaagcctggttggctgagctcttaacgagtgggcgactcagggaaccccatggctgatggggtgggattggtgctagaccctcttgtgcagctgccctccccctgttccttgtccactgacctactcaacaggcctgtctgggcagacagcttgtcagtttcctccccagccctgcatcttgccatacagtgggcttctgggtaggtggctatggggtgtcctggaggtaaccttctcaacttctactctggcctcatctccttatctgacttcctccccaggagaagctggtasccctcccttggcaaacagatttgccttgcctcccagtctgctaaactcactgggcctctcaggggcagagtccaggaggctagaagagtccaaggggaaatgcttgtggggtaaatgagtgggtttctctcatcccagcttctgtcccttcctccctgccctccccctgctccacgtccctgccgcctgaatgtctggctgtcaccctgaggatggttgttttgctctctcccacaaactaattatgggtcccaaactgaggacgtcagtgtctctcccctagcccctcccccagtttct

SEQ ID NO: 112667 - DNA, 601 bp, Human
gagtgggtttctctcatcccagcttctgtcccttcctccctgccctccccctgctccacgtccctgccgcctgaatgtctggctgtcaccctgaggatggttgttttgctctctcccacaaactaattatgggtcccaaactgaggacgtcagtgtctctcccctagcccctcccccagtttctgggtcatccccctccccaggagatgctgactggcctgccctggtgtgtagggtggctggtcccaggcactcacctgcacagtggctgctggcctgtaattagctccccaaggaggaygaagaagaaaggctgcagctttcccctgctttcactctgccctccagggcagccctccctgcaagccttccattctgtgctgtgactgtgacctctgttggacccctggggctgagcctcatgcagcaggggtgcacacagagggaggagtctgacaattgaggggtgttcgagccagcgaggccagcccgctggtgcaggcagaagggggagcctgccccagagaaaactctggaagcagaaatagaatagaaagaaggaaggaggccaggaaatgagcctggttcacatgtgtcctgg

SEQ ID NO: 112668 - DNA, 601 bp, Human
tactgcctatagggcagccctggaggcaaggttcctcctctccctttgagcccatctctctacactggccttggagtggtggccaagtgtatgtgtgtgtgtgtgattgtgcgtgcatttgtgtgtgcatacgtgcgtatgtgcgtgtgtgtgtggtggggcaggcagaggaatctgaactttaggagagagaaaaataatgtggtgcagggggttggataacaaaggatttttgcttgcaactaatagtctccagctgcaaaaataccaaaggggaggccaggcaggccgaggactccarttcttgccaactcctcaccggcctgctgagtggggccctgcctggcctttggggaggtggaagggagaccggccaagggtaaatatctgagagcagggatgatctctctgccttccttcccggaattgggagggaatccaggccacatcctgaggctgggggggctgattgtggagctgcacctgggatagcggcatcagatctctgcaggtttcttccttctctctcttgccaagagaagggtggatagggggagcaggggcagggtattgccagccctagggctgggcagtgactcag

SEQ ID NO: 112669 - DNA, 601 bp, Human
gcgttcctgttctttttgcccccaccccaccctcacccactgttagggagcagcccctgaatccctgtggggaggagggggaattagggaggggtcaagcagaacagcaagtcattatacctgtagctgtgtgggggcagaagaatccctactgggttgagtatgggtaatggaggatgagtttcagcccaaagcaggtagcccaaagatttctttacttgttggggaaactgttggagatggagttccaggcaggggtcccagaaagtcactgccttaggagtttcccagtttgcaagargcaccatctctgatggtggtagttgaagggggtagtgagtagatggaaggaagccagtggtcctggagaggaggagcccagaggaggccagcatgtgtccctgtccccagacttcctgcctccttgacttccggccacccttgccctgcctctctttcctttggctcttcttggcttcttccatctcctccagaaccatgcctgaaactgagtctaggcagctgggctccatctccttcccccactcccatcatccttaagccccatctctttctgagccatgcctcagtttgccctgag

SEQ ID NO: 112670 - DNA, 601 bp, Human
tgccatcttcacttctgctggtgggaccgatgaaactgtgaaataaaaagtccagggaccggggcagggccctggggttcccggagatgacttccaaggggaagttcatggagaagtcagggaaggagtggggagagcctgttcggtggtgacagaggtatagaggccatgggctctcttggacaccatttgattctcaggtcacactgaagtacagtaagcattaagtagagtaaacatcactattgttgcttgggaaagaattgcagtttccatccagataatttgtttcatgaggaaktttgtactagaaaaaattactttgtattattaaaaaatagtaaaacaaacaaaaatggtgcaaagggcttagtacttgtcccacgaccggggtctgactttccccctcacgatcctgtggtgcccacagcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccgtgagtcacacgccctgccccaccctgttg

SEQ ID NO: 112671 - DNA, 601 bp, Human
aaaaatggtgcaaagggcttagtacttgtcccacgaccggggtctgactttccccctcacgatcctgtggtgcccacagcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccgtgagtcacacgccctgccccaccctgttggatggcaggcctgcagggcagctcggctctggcagtgcctatactggagcrggcaggaagctgggggcacccaacttctcgctgacccctgactcattccctccccagatcagcacacctgcccctcggaccgattcaagtgcgagaacaaccggtgcatccccaaccgctggctctgcgacggggacaatgactgtgggaacagtgaagatgagtccaatgccacttgttcaggtgtggagcggggctcagatcacacgaggcacccctcagtcaaggaggcaggggagacgagggggccaggttcagtggctcatgcctataatctcagcactttgggaggccaaggtg

SEQ ID NO: 112672 - DNA, 601 bp, Human
agccgaggcactgctgcggggccttccccacccttcctgactgggctaagggctgctggttatgggagggccgctgcactcacctgcccagtactgtgatgctgtgtaatcgtgaaggccctactcagctactctttcttcctcacagcctatcccacctgcttccccctgactcagtttacctgcaacaatggcagatgtatcaacatcaactggagatgcgacaatggtaagagcttgctctcctcacctgctgattcctaagacagctagaggctacagccaggccctccagggaagkcaaagggcttcagaatccagcagggcctccctccaggacactgaatccctgctgggttgcctgggagaaaacaggagaagtcagaaatgcctggagggagccacgatggaccaaggggagaccatcaccttttagtgtcattcctaccccaggcagggcctgagctgcccaccctctagtagggctcggaggccagggagagatgagtgagatgggccagagaggcagagcaaggagaaaccggtgcctgactcctttctccttgcaaacccccatttcctggagtccttggtgcacccc

SEQ ID NO: 112673 - DNA, 601 bp, Human
gctgcactcacctgcccagtactgtgatgctgtgtaatcgtgaaggccctactcagctactctttcttcctcacagcctatcccacctgcttccccctgactcagtttacctgcaacaatggcagatgtatcaacatcaactggagatgcgacaatggtaagagcttgctctcctcacctgctgattcctaagacagctagaggctacagccaggccctccagggaagtcaaagggcttcagaatccagcagggcctccctccaggacactgaatccctgctgggttgcctgggagaaaayaggagaagtcagaaatgcctggagggagccacgatggaccaaggggagaccatcaccttttagtgtcattcctaccccaggcagggcctgagctgcccaccctctagtagggctcggaggccagggagagatgagtgagatgggccagagaggcagagcaaggagaaaccggtgcctgactcctttctccttgcaaacccccatttcctggagtccttggtgcacccctcaggctctgggcttcaggctcagaagcccacctggcagatagccatggaccaggtgatgtcagccttgagc

SEQ ID NO: 112674 - DNA, 601 bp, Human
ggccgtggtcttgcctcctctcagcttctgaccctgggtctgttccatgcctgcccctcccctagaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgycgcagcctgggtgagacaacagtgaggtgtggtggggcaggccgaggcaggcctctgagctgcagtgggttgggcttggtggccaggtgccaaaggctgagttttccaccctagcccccagtgcccggaccagcagagacctgcctgcgccaggacgggtggcacacaggcagctagccccttgctgaccccatcacatccctcccatcccagaccccttcaagccgttcatcattttctccaaccgccatgaaatccggcgcatcgatcttcacaaaggagactacagcgtcctggtgc

SEQ ID NO: 112675 - DNA, 601 bp, Human
cggagaaagggtgaggagctggaaagactggccttgtcattctgcccatggcccatgctgatgaggccctgtctcctccagggtctgaggactgacccccacttccacccccaccctacaggtacttgttctggactgagtggggtcagtatccgcgtattgagcggtctcggctagatggcacggagcgtgtggtgctggtcaacgtcagcatcagctggcccaacggcatctcagtggactaccaggttcgcacgccaacttggccttggatccgatggtagacccctgacccaggctyctgttccctgtgatgagcccattctgggaggacttggagcccaggggaagtcacagggtctcccagcccagccctccacccagagtaggactcctgctaccacagagatgatgggcaggggtcgctcagaagtggggagtgggggagtggagagatgcctggaggtcaccttatcagcagggcagtgggcaggagtgtatgcaggaggcaggagtgagttaggggaggctgaactgagggcctcactctggcccaggcactccctgctgccccagacatggggctggcagcgagctcagc

SEQ ID NO: 112676 - DNA, 601 bp, Human
tcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaagtgagcccagaccctaagtcttcccaggaagtgggwcatggggcggggagcagcacagactcttagaccccagccaggcactctaccctaggtctgaatcccagcagctacaactcagctgaatccaactgcacccccgcagttacatgactcctgatttggagtcagcgtcagcccccgacttcctcccgccactggtcctagttctgccttcagagctgcacagaacaagcgagaggtctctgtggagcccaacgctcacaaacccaggctgcagacatggggctgagctccagtcacttgggctttcaataacttgggtcagtttcctgctct

SEQ ID NO: 112677 - DNA, 601 bp, Human
cagtgatgctggggacggagtgtgtgctctggaaagagcagttacagtgtcagggctgtcatcacaggacagcctttcagctctttgaaaactgcatcctgctacattttctcttcttcagcctggttaccaccgggtcccttgactcattcatttgctcatatattcattcagctggtccataaagacctgccaggcaccgaactaggtgctacgtatacagacctgtcctttcagccttttctgggacattttctgctgcacgtagtccagcctgcatgtctgtctaaaaatgtagcayccgaagctaaactcggtactccatgctcgtagcttgatcaggagagactggcacatcaatccccagacccctggaagggatgtcccctcacctccggctgtctgcaggccataccacagcatggccctttggcagccaccatcgcttatagccactaacactctagtcttttctcttacactgctgttcggctgtgtctctcactgtgccttggttctttaacctgagtttaagatgtctgctttataaaataatcaatccagctcagggtctttttaagtagggggctccccagtacag

SEQ ID NO: 112678 - DNA, 601 bp, Human
ttctcttcttcagcctggttaccaccgggtcccttgactcattcatttgctcatatattcattcagctggtccataaagacctgccaggcaccgaactaggtgctacgtatacagacctgtcctttcagccttttctgggacattttctgctgcacgtagtccagcctgcatgtctgtctaaaaatgtagcacccgaagctaaactcggtactccatgctcgtagcttgatcaggagagactggcacatcaatccccagacccctggaagggatgtcccctcacctccggctgtctgcagrccataccacagcatggccctttggcagccaccatcgcttatagccactaacactctagtcttttctcttacactgctgttcggctgtgtctctcactgtgccttggttctttaacctgagtttaagatgtctgctttataaaataatcaatccagctcagggtctttttaagtagggggctccccagtacagcccaagcaggatttgatttacagaaatctacattgcactcagctcagcagaactgcagctccaggaaagtgcaaacacaccagaaagcccgattgccctcagtgggag

SEQ ID NO: 112679 - DNA, 601 bp, Human
atgtattaatacaattatatattttacatttacaaatatataggtataaaaattaaaaatgaatgtacttccaaacaagattgcacataaaaattacttcagaaaattgttaagatacacagaaaaaattgaagcatcataaaaaggaaattataatagtttacatatctagaaatagagtgcaaagttctaccaagaataagaataaattaatattaagcaatggtttgtgattttataatacacttacagaaattttattccactttatttacaactcagatatctaaaaaatagattkcttttgaaatacaaatgcaagaaacaattggagaaatctaaaatcataattagaagagagtagtgttttctttatcagccatctgatataatgttacacatcagtgggtgtagtaacggcttaggactctgagcgccgctgttgatcaactctaagcgaaaatcaggactccatccggatttccagttctgcggctacacaaaacccggcagataccacaaacctgctcccaggctgcagcaaaactcagcctctttcttctaaggaaaagatcaccatactttgcagggtggaagaaag

SEQ ID NO: 112680 - DNA, 601 bp, Human
ctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagaygcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtc

SEQ ID NO: 112681 - DNA, 601 bp, Human
cagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagaygcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgccc

SEQ ID NO: 112682 - DNA, 601 bp, Human
cacctcatggtggggaggatttgacttcacatcctgagactctgacttcggtgagtttctcttttttgtgtgtgatttatctaatagtctactagtttctcatattttaggcatactactttattttcatatctagaatcatatgtttaaaatccatagctttttacaatattttctcaatgttttttcaattatagttttcactatgtatttggttcataagttgctctatctttttgtaaaataatgtcaccagactgaagatattttgtctttgtcttttttttttttttttttttttgagatggagtctcgcactgttgcctaggctggagtgcagtggcgtgatctctgctcactgcaacctccgccttctgggttcaagcgattctcctgcctcagcctcccaagtagctgggattactggtgcccctcaccacagctaaattttttgtatttttagtagacatggggtttcactatgtcgaccaggctgttcagaaactcctgtcctcgtgatcctcccaccttggcctctcaaagtgctgggattacaggcgtgagccacaatattttgtcaagttctgactatcgaacagaa

SEQ ID NO: 112683 - DNA, 601 bp, Human
agtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgrtcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagcc

SEQ ID NO: 112684 - DNA, 601 bp, Human
atagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtggaaggaaagcacactctttagggtcatagttattaactattaaaccattgaaactattattttatatttgtgttaatgagagtcaaaattattgtgcattcatctcaaataattctattattttgaaaaatacaggtttttttttwaaaaaaaactgctcttgacattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggaga

SEQ ID NO: 112685 - DNA, 601 bp, Human
ggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtkagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagc

SEQ ID NO: 112686 - DNA, 601 bp, Human
agcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacsgccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccag

SEQ ID NO: 112687 - DNA, 601 bp, Human
cttggtaaagttttaacgtcacataatgtaagtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatrtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagaggga

SEQ ID NO: 112688 - DNA, 601 bp, Human
agaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcrcgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggac

SEQ ID NO: 112689 - DNA, 601 bp, Human
ctccagttttctctgataaaactaggaggaaaattatctgcacatcagattgaaaataatactgcatatcatttcatagtggtcaaaattttcccataccacttgatggggatgttttcccacaaggtttttgttctacaacaggagagaagactttgcctagttcttccaatatgtgcattgcttctgcttagaaaaaaacaaacttttaaattctctttgctgggttaatgactgttctatagattcccatctctaaggaatcttctttggtagtaaacactggaaaacagtcactacsaaaactcataaaatgtctagtttcctatacattagtccaacacatcagtctaattctgaatcccattgaattagcaaaggcttccggctgcagttttctaaatagactcagagccctgctgttggccaatgtgctgcaagaactggagcctgggatctaccaggacgatattctgttcagtcacagaagcaagtcggagagtggccaagacttgggctttctgctcctgcaaatctgattccatacggattggggtgccctcaaactgggagcattgagttttctatgtatggaagtaaa

SEQ ID NO: 112690 - DNA, 601 bp, Human
cagaaccctggacggtgatcactctgttcaaaacacatgataaagattcgagagaaaatggggaggttacatgcctcataaacgaaagagttccttttagaatcgaatcttccgccaataatgactataagcttgtaacagatgggaccctggattgggagcggatcccggagtacaacgtcaccatcactgccactgacaagggcaagcctccgctctcatccagcacaagcctcaccctacgcattggtgaagtcaacgacaatgctccggttttccaccaagtctcctacgtggtccmcgtggccgaaaacaaccttcccggagcctccatcccacaagtcagcgcctctgacctggacctagggctgaatggccaagtctcctactccatcgttaccactgacttggagctgcgggcactgtcgtcctacgtgtccgtgagcgcacagagcggggtggtggtcgcgcagcgtgccttcgaccacgagcagctgtgcgccttcgagctcacgatgcaggcccacgaccagggctcgcccgcgctcagcgccaacatgagccggcgcatgttggtgggcgacctcaatgacaatgtgcc

SEQ ID NO: 112691 - DNA, 601 bp, Human
gcaagttggaatgcttctactttatgctaaaaatattaatgtttctttttcacttgggttcttgttaagtgtgattctgataatgtatacaatcacatatcatttttaggtttccataatatcatgaaaatttgatttttaagcgttacatgtcaacaacctggtaaagtaatccttccattcaggatcattcaaggaatctatttaaaaatattttccccaaattatagctgaatcagaaagtttaaattattatattatatgatttgtcaaaaagagaaactcctagggagacatctccataataggtgtgttgggggaacagtaatctcaaagcagatgcactaacattataagattaaaatcattgtttatagaaacttccaattcatttaaaagctcattggggaaaaaaaagctcattgggaaaaaaaaaaaaagctcactaaagtttctattaaagcgaatacggtagatttccatccccttttgaagaacagtaggtggagctatttaagatataaaaacgaaatatcctttctgggagttcaagattgtgcagtaattggttaggactctgagcgccgctgttcaccaatcg

SEQ ID NO: 112692 - DNA, 601 bp, Human
gagagctttgaaaaaagcgagccccttttgctgtcaggtgattcggtattttctaaagacagtcatgggttaattgaggtgagtttatatcaaatcttctttcttttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctactactttcttgtacagacaggagtctcactatgttgagcaggctgatctgaaacttgggctcaggctagcctcctgcttctccctcccaaactgctgggattacaggcgtgaaccacagtgccccgcccttatcagatattcttttctggctgggcgcggtggctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtg

SEQ ID NO: 112693 - DNA, 601 bp, Human
gagggcaaggaacacctggcccgcccagggcagaaaactgcttaaaggtgttcttaaaccacaaacaatagcatgagtgatctgtgccttaaggacatgcccctgctgcagataactacctcaatccatccctttatttccgcccatctcttcgtttcccataagggatacttttagttaatctaatatctatagaaatgatgctaatgactggcttgctgttaataaatatgtgggtaaatctctgttcagggctctcagctctgaaggctatgagacccctgattccccacttcacacytctaaaaaaaaaaaaatttttttttctgagcttggagaaatatatcccttagtacacttggcatttataaagcagacatcaataaatttatatatatgtgacagataccaacaacaatccagtccccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgta

SEQ ID NO: 112694 - DNA, 601 bp, Human
ttgcccatttcctacactaatgatactaatgatgactttgtggaatattcagaattaacaaaatgtgttttgagtgctttttttagtactggggcaaatttgcagtaatatcgcctgctttttacattaaattccccataacttttacaactatgggaaaatttctgaaacgtgcacagattccaagtgttttctgagaactttatgcttattgtagagtggttacagacactgaatgctaaagtgtattactctttgaaaagcattgcttgatttcttttggtgaattctgtaaaggtgyagggaaacataacgtcccaattattttttctttcttctttgtttgctgcctatctactttgaaagatacaatagttaaaacccagaaaagagattggaaaccccttagagaatgaaagacatccaagggctctaaaatgcggcagttgctgcttctgagaccaaaaaagggggcaaaatatagagtgtgtggttctacttgtgtgattttttgaaagaaagtatttgaatttatctaaaaatactaaatttgtatttacattagttttcaaatagaatttaataagtacagtgttctata

SEQ ID NO: 112695 - DNA, 601 bp, Human
tgtaatcagtcagaagacattcatccactgctttcattccagaagtattatgctttttgaagcagcaatagcataggaatgttgaggagactatactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagrgatgttgatcaaactgatgaggctaaatctcaagaaagagacacagttaccctctaatgttacactttgagttcacctttttttttttttttgagacagagtctcaatctgtcgccaagctggagtgcagtggcactatcttggctcactgcaacctctgcctcctgggttcatgctattctcctgccttagcctcccgagtagctgggactacaggcacacgccaccacacccagctaatttttgtatttttagtagagatggggtttcaccatattggccagaatggtcttgatctct

SEQ ID NO: 112696 - DNA, 601 bp, Human
atactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagagatgttgatcaaactgatgaggctaaatctcaagaaagagacacagttaccctctaatgttacactttgagttcacctttttttttttttttgagacagagtctcaatctgtcgccaagctggagtgcagtggcactatcttggctcactgcaacctctgcctcctgggttcatgctattctcctgccttagcctcccgagtagctgggactacaggcacacgccaccacacccagctaatttttgtatttttagtagagatggggtttcaccatattggccagaatggtcttgatctcttgatcttgggatgcacccaccccacctcagcctcccaaatagctgagattacaggtgtgagccaccatgcccgaccactttgagttcacttt

SEQ ID NO: 112697 - DNA, 601 bp, Human
atccacctgccttggcctcccaaagtgctgggattataggcatgagccaccgcaccctgccaactgtctgacttatcttaaaaggctaaggacctggtttgtttgtcaaattttgaaaatagatgcctcagttcataagatttccatattgtgtggcaggcgcctgtaatcccagctactcaggaggctgaggcaagagaatcacttgaacccgggagacagaggttgcagtgagctgagatcacgccactgcactccagcctgggcgacatagtgagactctgacaaaaaaaaaaaaaaatccatatgtgaaaattcttagaagcttcctatacaatttcagctgaagattcagccaacagttcattctgagactgtgttccatggaaaaagtaaagcccaggcatggaagtgggaatggaaagaaagattctaagcctacaaatactcaaacatcaagaagaaataaaaataagtcatcacttcgacttcatgtgctaacatcactgaggttataaattcccaggaatattttattgcgggagcaagactgcactgctgcctttcagcttgcaaattccagtgagaaacgtctttctct

SEQ ID NO: 112698 - DNA, 601 bp, Human
cctaaactttgaaaattattgttccactgaagagcgtcttatgactgagtgttccagtctccttctcaagctgaaccttgcttttcaaaccagattaagaacactatcataagttatactgcattttatttccctacccatgtccactgcatcattctctatagtacaaagagcttgtctcgccaggcgcatctataatcttagcactttggggcgccaaggcgggtggatcacttgagcccaggagtttgagaccagcctggacagcatggcaaaaacccatctctacaaaaaaaaaaaacaaaaattaacaaggtttagtggtccatgcctgtggtctcagctacttgggaggctgaggtgtgaggatcacctgagtctggggagattgaagctgcagtgagctgtggttgcgctcctgtactccagtctgggtgacagaattagaccctgtcccaaaacaaacaaacaaataaagagcttctctccttatgacttatttaaagcttgggaaattgttccaattcaaatgctttaaatggacttgagctaaaacagaatgtggtatatgaaatgttcttataatcaggtgattgtaaaa

SEQ ID NO: 112699 - DNA, 601 bp, Human
ctgtggttgcgctcctgtactccagtctgggtgacagaattagaccctgtcccaaaacaaacaaacaaataaagagcttctctccttatgacttatttaaagcttgggaaattgttccaattcaaatgctttaaatggacttgagctaaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttycctatcagtgaattggaagcttacaatatacaatattaccaaaaagacaaaaaaaatgaaaaggaaacagttacctttggaaaacataattaggtaaaatgggtaatatggaaagtctgaaaactgaaaaaattactgataagtcaagagaaaaggaatattagtaggaaaattcataaaagtgtgtctgactactcacagcaggtttccttattggtatgtattctgtggtccatctaagctatgttaattttattttaaatgctacctgggtattggcttctaaaaggaattcagtaa

SEQ ID NO: 112700 - DNA, 601 bp, Human
cttaagcgatcctcccacctcagcctcccaaatagctggggctgcaagtgcacaccaccatgactggctaattttttaattatttatttatttatttatttattttagagatggggtctcactatgtttccccaggctgaccctgaactcctggggtcaagtgatcctcctgccttagcctccaagtgctggtattacaggcataagccaccacacctagcctagtattcttttttgaatatgtaaaacattaacataaagtcaaaactattaaaaaaaggtgtactcagaaaattgtcaytcctcccctataccttctgcctcattcacaccacactctgtagataatcgatttcattagtttgtggtttatcctcactgtgtttctttttgcaaaacgcaaaaacaaaacctatacatatttatattttcttatgtcctcttctttcttacacaaaaggtaacacactatgtaggtagtcctggctttgaacagtttcactataaaaatatttgttactacagcttaaataacataagtctcctaaaaataattcaaattttagttaccatggtatattaactttgagtagttccataa

SEQ ID NO: 112701 - DNA, 601 bp, Human
ggggttgatctaagggtcctcggaagaatggcgtccatgtgtggttcagtttacagcaccgtttggagtttgattgcttctaggcgagaagaaacaattcaagttatagtattgagtatacagagtccaaatatcaatacaagacatataagcaagagagtgcttaataaaggggttaaccaattccataaagaagactggaagtaattaaagagggattgtagccactcggggctgaagcccacattttccctgagcctgtcaataattttgatttgatttttaagtccctgtagatttkcctcttctttactacaggtgttaatcccaaagaagcatgtttcatttaaaaatgcattactggccaggcgtggtggctcgcgcctgtaatcccagcactttgggaggctgaggcgggagcatcatgaggtcaggagtttgagaccagcctggcctacatggcaaaaccccatctctactaaaaatacaaaaaattagccatcgtggtagtgggcgcctgtaatcccagctaattgggaggctgaggcaggagaatcgcttgaacccgggaggcagaggttgcagtgagccgagatcgcac

SEQ ID NO: 112702 - DNA, 601 bp, Human
ttaatcccaaagaagcatgtttcatttaaaaatgcattactggccaggcgtggtggctcgcgcctgtaatcccagcactttgggaggctgaggcgggagcatcatgaggtcaggagtttgagaccagcctggcctacatggcaaaaccccatctctactaaaaatacaaaaaattagccatcgtggtagtgggcgcctgtaatcccagctaattgggaggctgaggcaggagaatcgcttgaacccgggaggcagaggttgcagtgagccgagatcgcaccactgcactccagcctgggcmacagagcaaaactccatctcaaaacaaaacaaacaaacaaacaaacaaaaactgcattactaaatccaataaaaagtcctagtagactcagtgatagtaaaactttcatgcttcctttttgccagtaactattatccctgctataaggatactaattaagcaaaatacgacagcaatggaaactctgtccaatatttcagttagaaggtgctaccatggataaccctattgcaaatagtagagtgaggaaagcagttcccacaaatgtggtgtggtaggtaatttccatctaaaatttta

SEQ ID NO: 112703 - DNA, 601 bp, Human
caggagaatcgcttgaacccgggaggcagaggttgcagtgagccgagatcgcaccactgcactccagcctgggcaacagagcaaaactccatctcaaaacaaaacaaacaaacaaacaaacaaaaactgcattactaaatccaataaaaagtcctagtagactcagtgatagtaaaactttcatgcttcctttttgccagtaactattatccctgctataaggatactaattaagcaaaatacgacagcaatggaaactctgtccaatatttcagttagaaggtgctaccatggataaccytattgcaaatagtagagtgaggaaagcagttcccacaaatgtggtgtggtaggtaatttccatctaaaattttacttgccaacatatagaattcccctctgtgggcctacgaagttccttggttttattttcccaaacaaagaaacctccgggttacaggtaccttacttactttcattacctggcacaatttgcaaaataattgcccagaactagcatattgattcacattttcacattacccatccctttttcccccccaccaagctgcagaagatcaccacttgattcacaggaata

SEQ ID NO: 112704 - DNA, 601 bp, Human
tgtgttgtctatttgtatatcttcttgaagcattcgttcatctttaactgagctgaacgccttcttaaaattgagctatgggagttttaaaatatatccttgtagctgggcgtgatggcaggtgcctgtaatcccagctactcaggaggctgagacaggagaatcgcttgaacccaggaggcggaggttgcagtgagccgagactgcaccactgcactccagcctgggcaacagagtgagacttcatctaaaaaataataattatacatgtaattatatatgatttttatatatgtaatayatatattcttgatgtgagctctttgtcacatacatattttgtggatattttatcccagactatgacttgtcttttcattttcttagttgtgtcttttgaagagcagaagatgtaattttgataaagcccaatttattttttcttttatagtttgtatttcttatgtcctattcaaaaactccttgcctactgaaaacttatgatgattttctcctatattttcttttagaagttttatagttttaccatttataatttggtctatgaatccttttgagttgatgtttatgtatggtgtat

SEQ ID NO: 112705 - DNA, 601 bp, Human
cctactgaaaacttatgatgattttctcctatattttcttttagaagttttatagttttaccatttataatttggtctatgaatccttttgagttgatgtttatgtatggtgtatggtgtgaggtaacaatgaagattcatatttttttccaaaggaatatccaattgtctctttggaaaaatatgctgagaaggctatcttttccccaccaaataatcttagcaccttaatcaaaaatcatttggccatggacatatgtaggtgtgggttttttctgggctctctgtgttagatggataratagacagatacagatatataactgtgtttacacatatgtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgta

SEQ ID NO: 112706 - DNA, 601 bp, Human
tttagaagttttatagttttaccatttataatttggtctatgaatccttttgagttgatgtttatgtatggtgtatggtgtgaggtaacaatgaagattcatatttttttccaaaggaatatccaattgtctctttggaaaaatatgctgagaaggctatcttttccccaccaaataatcttagcaccttaatcaaaaatcatttggccatggacatatgtaggtgtgggttttttctgggctctctgtgttagatggatagatagacagatacagatatataactgtgtttacacatatrtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgta

SEQ ID NO: 112707 - DNA, 601 bp, Human
agatagacagatacagatatataactgtgtttacacatatgtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtgtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatac

SEQ ID NO: 112708 - DNA, 601 bp, Human
atatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtrtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatactgttttccatagaggttgtactaatttatattcccagcagcaatgtgtaagtgttctcttttccccac

SEQ ID NO: 112709 - DNA, 601 bp, Human
tatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtgtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatactgttttccatagaggttgtactaatttatattcccagcagcaatgtgtaagtgttctcttttccccaca

SEQ ID NO: 112710 - DNA, 601 bp, Human
atcccggctcccagattcaagcgattctcctgcctcagcctcccaagtagctgggattacaggtgcccaccaccacacccagctaatttttttttcttttttttttgagacagagttttgctcttgttgcccaggctggagtgcaatggcacgatctcggctcactgcaacctctgcctcctgggttccagcaattctcctgcctcaacctcctgagtagctgggattccaggcatatgccaccacgccaggctaattttgtatttttaatagagacggggtttcttcatgttggtcaggygggtcttgaactcccgacctcaggtgatctgcccgccttggcctcccaaaatgctgggattacaggcatgagccactgcacccagtccaattttttgtatttttagtagagatggggtttcatcatgttggccaggctggtcttgaactcctgacctcaggtgatccgcctgcctcggcctcccaaagtgcagggattacaggtatgagccaccatgaccagcctaaagtgtattgtttagtcaccaaatatgtaagtattacccaaatatatttgtcactgatttctaatttaattgta

SEQ ID NO: 112711 - DNA, 601 bp, Human
agctgggattccaggcatatgccaccacgccaggctaattttgtatttttaatagagacggggtttcttcatgttggtcaggcgggtcttgaactcccgacctcaggtgatctgcccgccttggcctcccaaaatgctgggattacaggcatgagccactgcacccagtccaattttttgtatttttagtagagatggggtttcatcatgttggccaggctggtcttgaactcctgacctcaggtgatccgcctgcctcggcctcccaaagtgcagggattacaggtatgagccaccatgmccagcctaaagtgtattgtttagtcaccaaatatgtaagtattacccaaatatatttgtcactgatttctaatttaattgtattgtgatccaaaaatatacattgtatagtttctattcttttaaattcgttaacatttcttttatggcacagaatatggtctatcttggtgagtgttgcttacacacaactgtgtaactgaaaactgtgtattctgcttctcgtggttgttgtatcctataattgtcaactagatcaagttagtaagagtgttgttcagtgatcttttcttcttcagtg

SEQ ID NO: 112712 - DNA, 601 bp, Human
ttgtaaaaaccaggtgcagtggctcatgcttgtaatcccacactttgggaggccaaggcgggtggatcacctgaggtcaggagttcaaggccagcctggccaacatggtgaaactccgtctctactaaaaatacaaaaattagctgggtgtggtggtgggcgcctgtagtcccagctacttggaaggctgaggcaggagaattgcttgatttcaggaggcggagattgcagtgagctgagattgcgccactgcactccagcctgggctacagagcgagactccgtctaaaaaaaaaaaaaagcaaaaaaaaaaactccattgtatgtgcacatatcattatctgttcaacccatctatgacttgtcatttaggtagtttccatccaatatttttgcaatataaaaaatgctaatgaagaacctgagatatatatatatctatatatatagatatatatgtttgttgttgttgttgttatttttgaagtatgtacgtataataaattcctaatagtgtgattgctgcatcataaggtaaaggcatatgtagttttgttaaatatagctattccccatcttgcattcctacaaatagatgaga

SEQ ID NO: 112713 - DNA, 601 bp, Human
ggcatatgtagttttgttaaatatagctattccccatcttgcattcctacaaatagatgagaatgtccattgtcccatagtctcctttgcagagtatattgtcaagctttttaattgttgccaacctgatgggtaaaaagatatctccaaataattttaattaaaatttctcttattatgaatgaggttaaatagtttttcatatgtttaaaagccagtttatatctttttgtttttttagagacaggaatcttgttctgttgcccaggccaaattgcagtgatgcagtcatagctcactrtagcctcgcactcctgggctcaagcaatcctcctaccttagcctcccaagtagctaggactacagatggatgccaccatgtccagctaatttttttatttttttgtagagatgtgaggtctcactatgttgcccaggcttgtcttgaactactggcttcaagtgatcctcccacctcagcctcccaaagtgctaagattacagccatgaaccaccacaaatgaccctatatatttttttgaattgtctgttcatgtcttattttcatttttctagtagttttttttttaagtgttttagc

SEQ ID NO: 112714 - DNA, 601 bp, Human
gtctgcttttgcattggtcaaatgccaccacttccacctcttgtgctttgttttcaggatcagactggtaaagtcatgtttcatctcttgttacagtttttttttttttaagaaacccttcaggatcttgatcacatttgtttaaaatttcaactgaggctgggcccagtggctcatgcctgtaatcccagcactttgggaggccgaggcgggcaaatcacgaggtcaggatttcgagtccatcctggctaacatggtgaaaccccatctctactaaaaatacaaaaaattagccgggcayggtggcaggcacctgtagtcccagctactcgggagggtgaggcaggagaacggcatgaacccaggagacggagcttgcagtgagctgatatcatgccactgcactccagcctgggcaacagagtgagactccagctcaaaaaaaaaatcaagtgaaaactctggtcttaaactgcagctgatctattttatttttattttttttcagacacagccttgctctgttacccaggctggagtgcagtggcaccatcatggctcaatgcagccttggcctcgtgagctcaagcaatcttcccac

SEQ ID NO: 112715 - DNA, 601 bp, Human
aaattaaagcaagttatttctgaggagaatgtaggtctcatggaagattttcatgtggacaaatttagtaaattttttgcaggtagtttcctgacatatttaacatttgtgatatagtaaacaataagaaggtactaaaggctgggcgcggtggctcacgcctgtaatcccagcactttgggaggccgaggtgggcggatcacaaggtcaggagatcaagaccatcctggctaacacggtgaaaccccgtctctactaaaaatataaaaagttagctgggcgtggtggcgggtgcctgtaktcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaagg

SEQ ID NO: 112716 - DNA, 601 bp, Human
atcaagaccatcctggctaacacggtgaaaccccgtctctactaaaaatataaaaagttagctgggcgtggtggcgggtgcctgtagtcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaaggtgggaggattgcttgagcctaggagtttgagaccattctaggcaacaaagcaagaacctgtctctaaaaaaatttaaaaattagccagaaatggtggcacatgtctgtagtcccagctacttgggaggctgaggcaagaggattgcttgagccttttgaagttgaggcttcagtgagccatgatcaccccactgcactccagcttgggcaacag

SEQ ID NO: 112717 - DNA, 601 bp, Human
agtcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaasgtgggaggattgcttgagcctaggagtttgagaccattctaggcaacaaagcaagaacctgtctctaaaaaaatttaaaaattagccagaaatggtggcacatgtctgtagtcccagctacttgggaggctgaggcaagaggattgcttgagccttttgaagttgaggcttcagtgagccatgatcaccccactgcactccagcttgggcaacagagcaagaccccatctcaaaaaataaaacaaaatagactgggcacgatggctcacgcctgtaatcccaccactttgggaggctgag

SEQ ID NO: 112718 - DNA, 601 bp, Human
aaaaaatattaaaaattacttctgaaattctggctggaatagaagtgccacttaccaggtaaggaaggttggagacataacatatttgagggtgtggtcaaaagatgagtttgacattatgctatgtcatataaaagacatataaaagactacctattttataattcctttttaataaaatattcagaaaaagcaaaactgtggttgcctgaggctgaagctaggaagattgactacagacaagcatgagggaaattttgggggtgatgagagttttctaaaactggattgtggggttggytgcattactgtataaatttattaaaaatccctgcatcgtataggggcactatattgtatgtagaaagctgtgaaaagattttaaaaatgattgacatgtctgtggttatatcaatgagtactattattattcccattttatacataaagaaaataaaagagaagttaaaaataaaagtttcatggttacatagctactaggtgtaatatccagtattggaatttgaatctttttgacactaagaccttactctcgatcatataatacattcactttctattttaaagttatattatagcc

SEQ ID NO: 112719 - DNA, 601 bp, Human
tgatacaacaagttacagcatctttgtttattatccactgtgagttgtattaccacactttacttggctctttggcaaactatattatctcttcagatcactagggctaggaaggcccactggtaacttgaaggagtaaatgtatcttctaaaaaatgcttacttccagggagattggatccacacaagtgaatacatatatagtccttagtgtatgctatgattattttactatgtcagtagcataaagattgctatattaataagcattaagtgcctgctgtgctagacagtgaggatrcaagtggccaccaaaatagcatggtccctgccctcctggagcttctttttttcttcttcagtgggggaagcagatactttgcttatgcaaaaataattataaaatttaaagttgtgccaagttcaatggaaaaaatataaggtgttctgagagagcataacaaaggatcctggttttaactggggcctaatggaagacctctattaggaaataacatttaaactaagaccagacagacctgtagaaattagcaaagcaaagggagggaggaaaaagcagctttcctggcaaaggaacaat

SEQ ID NO: 112720 - DNA, 601 bp, Human
agtggccaccaaaatagcatggtccctgccctcctggagcttctttttttcttcttcagtgggggaagcagatactttgcttatgcaaaaataattataaaatttaaagttgtgccaagttcaatggaaaaaatataaggtgttctgagagagcataacaaaggatcctggttttaactggggcctaatggaagacctctattaggaaataacatttaaactaagaccagacagacctgtagaaattagcaaagcaaagggagggaggaaaaagcagctttcctggcaaaggaacaatttrtgtgaaggccctgagacagggaagggctggggttctgaccaccctccaagtggtgcaatggaatatagtgagagagggagaagacatgagaacttggatactatgcaaaggatttggtattttaattcaagagcagtatgatgctactgaggagcagctggacaattgtgtgatccaattaaaattttaggaagatgaacctcgctattgtggagaatgcatacacaagggttctgttggttcatgaagaggtcttaagaaaactatgagctgggtgcagtagctcaggcctgtagtccc

SEQ ID NO: 112721 - DNA, 601 bp, Human
agcccaaggagctggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagaycagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacat

SEQ ID NO: 112722 - DNA, 601 bp, Human; identical to SEQ ID NO: 25330

SEQ ID NO: 112723 - DNA, 601 bp, Human; identical to SEQ ID NO: 25331

SEQ ID NO: 112724 - DNA, 601 bp, Human
ggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaaktcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaa

SEQ ID NO: 112725 - DNA, 601 bp, Human
gatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggaraatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatgg

SEQ ID NO: 112726 - DNA, 601 bp, Human
ttcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaawaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaata

SEQ ID NO: 112727 - DNA, 601 bp, Human
caccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataac

SEQ ID NO: 112728 - DNA, 601 bp, Human
accaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaawatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataact

SEQ ID NO: 112729 - DNA, 601 bp, Human
aatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccartataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaa

SEQ ID NO: 112730 - DNA, 601 bp, Human
gtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacsgtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcg

SEQ ID NO: 112731 - DNA, 601 bp, Human
cggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgygtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaac

SEQ ID NO: 112732 - DNA, 601 bp, Human
gttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgagscttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctgggg

SEQ ID NO: 112733 - DNA, 601 bp, Human
cacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgwttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatga

SEQ ID NO: 112734 - DNA, 601 bp, Human
gaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctaccct

SEQ ID NO: 112735 - DNA, 601 bp, Human
cagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaractccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggact

SEQ ID NO: 112736 - DNA, 601 bp, Human
gctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaaytgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaata

SEQ ID NO: 112737 - DNA, 601 bp, Human
cctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccrgacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctac

SEQ ID NO: 112738 - DNA, 601 bp, Human
gctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagrctgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgagga

SEQ ID NO: 112739 - DNA, 601 bp, Human
ggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggacccygaggaaatgcccaaatccagtgacttcctcatacaccctcctgagcgttcagaccttaccctttacctcattgtggctctagcgaccgtcagtctcttatccctagtcaccttcacctttctgtcagctaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagc

SEQ ID NO: 112740 - DNA, 601 bp, Human
ctcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtmaccttcacctttctgtcagctaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgcc

SEQ ID NO: 112741 - DNA, 601 bp, Human
agccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagckaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacg

SEQ ID NO: 112742 - DNA, 601 bp, Human
tggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgkgtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgacc

SEQ ID NO: 112743 - DNA, 601 bp, Human
tacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatrggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaag

SEQ ID NO: 112744 - DNA, 601 bp, Human
acttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtrttgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgc

SEQ ID NO: 112745 - DNA, 601 bp, Human
cttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagcygagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccat

SEQ ID NO: 112746 - DNA, 601 bp, Human
ggtgacttcctagatttctcagttttttgagcatgatgtagggagtattttattatagtccagtctatgggatattcccttatacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcckccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcac

SEQ ID NO: 112747 - DNA, 601 bp, Human
gcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcactygaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgg

SEQ ID NO: 112748 - DNA, 601 bp, Human
ttgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccakctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaata

SEQ ID NO: 112749 - DNA, 601 bp, Human
aacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggcsgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaa

SEQ ID NO: 112750 - DNA, 601 bp, Human; identical to SEQ ID NO: 25332

SEQ ID NO: 112751 - DNA, 601 bp, Human; identical to SEQ ID NO: 25333

SEQ ID NO: 112752 - DNA, 601 bp, Human; identical to SEQ ID NO: 25334

SEQ ID NO: 112753 - DNA, 601 bp, Human
cgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgccycgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaag

SEQ ID NO: 112754 - DNA, 601 bp, Human
atagtggaacattatttgctgtattggagattaattttttttatataattcatgctttctccatttgttttcaaattctgttttgggaagtctagctgatatctgtagacttaagtgaaacaaataccttaaaggaaagtggttaaatataatcattttacccaaatattttgttatattggaactgcagttctattaatagaaaagatgttttatttattcaaattgttagatatattgttctcttttgagtgtctgcctagacaccattagtgaatgtgttttggaaaggataatgtayaggactgatattttagtctacctgaaatttgtttaaggaaataatttacagtatttacataaatcagtggaaaggtacagagaacttctgggtcataaatatcagaaaagaggccgggtgcggtggctgacgcctgtaatcccagcactttgggaggctgaggtgggcggatcacgaggtcaggagatcgagaccatcctggctaacacggtgaaaccctgttctactaaaaatacaaaaaattagccgggcgtggtggcaggcgcctgtagtcccagctactcggaaggctgaggcagg

SEQ ID NO: 112755 - DNA, 601 bp, Human
gacgcctgtaatcccagcactttgggaggctgaggtgggcggatcacgaggtcaggagatcgagaccatcctggctaacacggtgaaaccctgttctactaaaaatacaaaaaattagccgggcgtggtggcaggcgcctgtagtcccagctactcggaaggctgaggcaggagaatggggtgaacccgggaggaggagcttgcagtaagccgagatcgcgccactgcactccagcctgggagacagaacgagactccgtctcaaaataaataaataaataaataaataaataaataaatatcagaaaagtagataaaatttatattaatgataacatgtagcattctaaagtctggaaagtttgtgttaagccatgtagttattggatatgtgggcttgttgagagaagaaatcagtgtaaaggaaccttaaggttgggcttcgttctgtgatgtaaagcctccagagagttacatactgctgcactcaataaatgtaaatatgtcacacacctggcatcttctgttatagataaaccctttacttattagaatcaatacctactgcaatgttagcgtttctttaagtgtaggtgcaatt

SEQ ID NO: 112756 - DNA, 601 bp, Human
ccacatgaaaggttaattgacacattaaagaacctaagaccacttgatttttattttttaaacactgttaaagagcattcaagtatatctatatctatatacatatacacacacatatatatacacacatatatatacacacatacacacacacaaacacacatacatacacacatggacattctgaccaaaatgtaaaatgtacaaactcaccgaatagtgaatgcatccaaagagtaacaagagaatctatacagtaggtgtcgacattattcactcctatgtgaaaacttgcttttcmattttttttaaaagaaaatgttatatgcttcttagggtaaggtgtttgggaaaaaagtaaaggttatagatttgggtacatttcttctgagttaaatgttttgtgcaatggaaaaatatctttaaaccctctataaactactaacagactataaaatgcttgatccatacattttgaatgtatgtactgtatataccatatacttttaaatatctgaatctttagttttatatgtgttctgaagaataatttttcatactaattgaagtgttcatacaatgaacacttggcattgtgttg

SEQ ID NO: 112757 - DNA, 601 bp, Human
aggttaattgacacattaaagaacctaagaccacttgatttttattttttaaacactgttaaagagcattcaagtatatctatatctatatacatatacacacacatatatatacacacatatatatacacacatacacacacacaaacacacatacatacacacatggacattctgaccaaaatgtaaaatgtacaaactcaccgaatagtgaatgcatccaaagagtaacaagagaatctatacagtaggtgtcgacattattcactcctatgtgaaaacttgcttttccattttttttaaaagaaaatgttatatgcttcttagggtaaggtgtttgggaaaaaagtaaaggttatagatttgggtacatttcttctgagttaaatgttttgtgcaatggaaaaatatctttaaaccctctataaactactaacagactataaaatgcttgatccatacattttgaatgtatgtactgtatataccatatacttttaaatatctgaatctttagttttatatgtgttctgaagaataatttttcatactaattgaagtgttcatacaatgaacacttggcattgtgttggaaggcact

SEQ ID NO: 112758 - DNA, 601 bp, Human
cgaccagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagkgaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagact

SEQ ID NO: 112759 - DNA, 601 bp, Human
aagatcaagatcttggttttagctagcatggtggttcacgcctgtaatcccacctcttcaggaggctgaggcaggaggatcccttgagaccaggagtttgagaccagcctgggtgactctgtctctaccaaaaagaaaaaaaagtagccagatgtgtggcgtacacctgtagtcccagctactcgagaagctctgataggaggattgcttaagtccaggggtatgaggctgcagtgagatataattgtgtcactgcaccctagcctgggagacagaatgagactttttctctctctctcttaaaaaaaaaaaaagattttgttttttctcagtgttacttgataactataaacgacagacgttcatacaagagatctttcacctttactacttaggaatcaaaaattatttttgaaaagataagaatcattggtaactgcagcaggggacaccagatctttggtgttaaaagacctgaataacattcctgtaactatctgttatttacttgggccagttacaatcgccattatcttccaattaaaattaagatttaaaagacttctcttatcagagataggatccccctctgttgcccagt

SEQ ID NO: 112760 - DNA, 601 bp, Human
agatcaagatcttggttttagctagcatggtggttcacgcctgtaatcccacctcttcaggaggctgaggcaggaggatcccttgagaccaggagtttgagaccagcctgggtgactctgtctctaccaaaaagaaaaaaaagtagccagatgtgtggcgtacacctgtagtcccagctactcgagaagctctgataggaggattgcttaagtccaggggtatgaggctgcagtgagatataattgtgtcactgcaccctagcctgggagacagaatgagactttttctctctctctctcmaaaaaaaaaaaagattttgttttttctcagtgttacttgataactataaacgacagacgttcatacaagagatctttcacctttactacttaggaatcaaaaattatttttgaaaagataagaatcattggtaactgcagcaggggacaccagatctttggtgttaaaagacctgaataacattcctgtaactatctgttatttacttgggccagttacaatcgccattatcttccaattaaaattaagatttaaaagacttctcttatcagagataggatccccctctgttgcccagtc

SEQ ID NO: 112761 - DNA, 601 bp, Human
gctgttcaccaaccagggaaaaatggtgcgagagatcccacagaaaccaccgagttttacagcacagagaaacgacagattgcgataagccctcttccaggctgcactaaactcaagcctctatcctgctggattctgagctccccttcctaagacagaggggtccacccggatacacccgcattctgaagcacttcccgagatcggcgcctaagcaagagaagcaggacgactatggcggctcagccgaggggcggggactacagaggattcttcctgctctccatcctcctggggaccmcctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaa

SEQ ID NO: 112762 - DNA, 601 bp, Human
gcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgraactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaact

SEQ ID NO: 112763 - DNA, 601 bp, Human; identical to SEQ ID NO: 112679

SEQ ID NO: 112764 - DNA, 601 bp, Human; identical to SEQ ID NO: 112680

SEQ ID NO: 112765 - DNA, 601 bp, Human; identical to SEQ ID NO: 112681

SEQ ID NO: 112766 - DNA, 601 bp, Human; identical to SEQ ID NO: 112682

SEQ ID NO: 112767 - DNA, 601 bp, Human; identical to SEQ ID NO: 112683

SEQ ID NO: 112768 - DNA, 601 bp, Human; identical to SEQ ID NO: 112684

SEQ ID NO: 112769 - DNA, 601 bp, Human; identical to SEQ ID NO: 112685

SEQ ID NO: 112770 - DNA, 601 bp, Human; identical to SEQ ID NO: 112686

SEQ ID NO: 112771 - DNA, 601 bp, Human; identical to SEQ ID NO: 112687

SEQ ID NO: 112772 - DNA, 601 bp, Human; identical to SEQ ID NO: 112688

SEQ ID NO: 112773 - DNA, 601 bp, Human; identical to SEQ ID NO: 112689

SEQ ID NO: 112774 - DNA, 601 bp, Human; identical to SEQ ID NO: 112690

SEQ ID NO: 112775 - DNA, 601 bp, Human; identical to SEQ ID NO: 112691

SEQ ID NO: 112776 - DNA, 601 bp, Human; identical to SEQ ID NO: 112692

SEQ ID NO: 112777 - DNA, 601 bp, Human; identical to SEQ ID NO: 112693

SEQ ID NO: 112778 - DNA, 601 bp, Human; identical to SEQ ID NO: 112694

SEQ ID NO: 112779 - DNA, 601 bp, Human; identical to SEQ ID NO: 112695

SEQ ID NO: 112780 - DNA, 601 bp, Human; identical to SEQ ID NO: 112696

SEQ ID NO: 112781 - DNA, 601 bp, Human; identical to SEQ ID NO: 112697

SEQ ID NO: 112782 - DNA, 601 bp, Human; identical to SEQ ID NO: 112698

SEQ ID NO: 112783 - DNA, 601 bp, Human; identical to SEQ ID NO: 112699

SEQ ID NO: 112784 - DNA, 601 bp, Human; identical to SEQ ID NO: 112700

SEQ ID NO: 112785 - DNA, 601 bp, Human; identical to SEQ ID NO: 112701

SEQ ID NO: 112786 - DNA, 601 bp, Human; identical to SEQ ID NO: 112702

SEQ ID NO: 112787 - DNA, 601 bp, Human; identical to SEQ ID NO: 112703

SEQ ID NO: 112788 - DNA, 601 bp, Human; identical to SEQ ID NO: 112704

SEQ ID NO: 112789 - DNA, 601 bp, Human; identical to SEQ ID NO: 112705

SEQ ID NO: 112790 - DNA, 601 bp, Human; identical to SEQ ID NO: 112706

SEQ ID NO: 112791 - DNA, 601 bp, Human; identical to SEQ ID NO: 112707

SEQ ID NO: 112792 - DNA, 601 bp, Human; identical to SEQ ID NO: 112708

SEQ ID NO: 112793 - DNA, 601 bp, Human; identical to SEQ ID NO: 112709

SEQ ID NO: 112794 - DNA, 601 bp, Human; identical to SEQ ID NO: 112710

SEQ ID NO: 112795 - DNA, 601 bp, Human; identical to SEQ ID NO: 112711

SEQ ID NO: 112796 - DNA, 601 bp, Human; identical to SEQ ID NO: 112712

SEQ ID NO: 112797 - DNA, 601 bp, Human; identical to SEQ ID NO: 112713

SEQ ID NO: 112798 - DNA, 601 bp, Human; identical to SEQ ID NO: 112714

SEQ ID NO: 112799 - DNA, 601 bp, Human; identical to SEQ ID NO: 112715

SEQ ID NO: 112800 - DNA, 601 bp, Human; identical to SEQ ID NO: 112716

SEQ ID NO: 112801 - DNA, 601 bp, Human; identical to SEQ ID NO: 112717

SEQ ID NO: 112802 - DNA, 601 bp, Human; identical to SEQ ID NO: 112718

SEQ ID NO: 112803 - DNA, 601 bp, Human; identical to SEQ ID NO: 112719

SEQ ID NO: 112804 - DNA, 601 bp, Human; identical to SEQ ID NO: 112720

SEQ ID NO: 112805 - DNA, 601 bp, Human; identical to SEQ ID NO: 112721

SEQ ID NO: 112806 - DNA, 601 bp, Human; identical to SEQ ID NO: 25330

SEQ ID NO: 112807 - DNA, 601 bp, Human; identical to SEQ ID NO: 25331

SEQ ID NO: 112808 - DNA, 601 bp, Human; identical to SEQ ID NO: 112724

SEQ ID NO: 112809 - DNA, 601 bp, Human; identical to SEQ ID NO: 112725

SEQ ID NO: 112810 - DNA, 601 bp, Human; identical to SEQ ID NO: 112726

SEQ ID NO: 112811 - DNA, 601 bp, Human; identical to SEQ ID NO: 112727

SEQ ID NO: 112812 - DNA, 601 bp, Human; identical to SEQ ID NO: 112728

SEQ ID NO: 112813 - DNA, 601 bp, Human; identical to SEQ ID NO: 112729

SEQ ID NO: 112814 - DNA, 601 bp, Human; identical to SEQ ID NO: 112730

SEQ ID NO: 112815 - DNA, 601 bp, Human; identical to SEQ ID NO: 112731

SEQ ID NO: 112816 - DNA, 601 bp, Human; identical to SEQ ID NO: 112732

SEQ ID NO: 112817 - DNA, 601 bp, Human; identical to SEQ ID NO: 112733

SEQ ID NO: 112818 - DNA, 601 bp, Human; identical to SEQ ID NO: 112734

SEQ ID NO: 112819 - DNA, 601 bp, Human; identical to SEQ ID NO: 112735

SEQ ID NO: 112820 - DNA, 601 bp, Human; identical to SEQ ID NO: 112736

SEQ ID NO: 112821 - DNA, 601 bp, Human; identical to SEQ ID NO: 112737

SEQ ID NO: 112822 - DNA, 601 bp, Human; identical to SEQ ID NO: 112738

SEQ ID NO: 112823 - DNA, 601 bp, Human; identical to SEQ ID NO: 112739

SEQ ID NO: 112824 - DNA, 601 bp, Human; identical to SEQ ID NO: 112740

SEQ ID NO: 112825 - DNA, 601 bp, Human; identical to SEQ ID NO: 112741

SEQ ID NO: 112826 - DNA, 601 bp, Human; identical to SEQ ID NO: 112742

SEQ ID NO: 112827 - DNA, 601 bp, Human; identical to SEQ ID NO: 112743

SEQ ID NO: 112828 - DNA, 601 bp, Human; identical to SEQ ID NO: 112744

SEQ ID NO: 112829 - DNA, 601 bp, Human; identical to SEQ ID NO: 112745

SEQ ID NO: 112830 - DNA, 601 bp, Human; identical to SEQ ID NO: 112746

SEQ ID NO: 112831 - DNA, 601 bp, Human; identical to SEQ ID NO: 112747

SEQ ID NO: 112832 - DNA, 601 bp, Human; identical to SEQ ID NO: 112748

SEQ ID NO: 112833 - DNA, 601 bp, Human; identical to SEQ ID NO: 112749

SEQ ID NO: 112834 - DNA, 601 bp, Human; identical to SEQ ID NO: 25332

SEQ ID NO: 112835 - DNA, 601 bp, Human; identical to SEQ ID NO: 25333

SEQ ID NO: 112836 - DNA, 601 bp, Human; identical to SEQ ID NO: 25334

SEQ ID NO: 112837 - DNA, 601 bp, Human; identical to SEQ ID NO: 112753

SEQ ID NO: 112838 - DNA, 601 bp, Human; identical to SEQ ID NO: 112754

SEQ ID NO: 112839 - DNA, 601 bp, Human; identical to SEQ ID NO: 112755

SEQ ID NO: 112840 - DNA, 601 bp, Human; identical to SEQ ID NO: 112756

SEQ ID NO: 112841 - DNA, 601 bp, Human; identical to SEQ ID NO: 112757

SEQ ID NO: 112842 - DNA, 601 bp, Human; identical to SEQ ID NO: 112758

SEQ ID NO: 112843 - DNA, 601 bp, Human; identical to SEQ ID NO: 112759

SEQ ID NO: 112844 - DNA, 601 bp, Human; identical to SEQ ID NO: 112760

SEQ ID NO: 112845 - DNA, 601 bp, Human; identical to SEQ ID NO: 112761

SEQ ID NO: 112846 - DNA, 601 bp, Human; identical to SEQ ID NO: 112762

SEQ ID NO: 112847 - DNA, 601 bp, Human; identical to SEQ ID NO: 112679

SEQ ID NO: 112848 - DNA, 601 bp, Human; identical to SEQ ID NO: 112680

SEQ ID NO: 112849 - DNA, 601 bp, Human; identical to SEQ ID NO: 112681

SEQ ID NO: 112850 - DNA, 601 bp, Human; identical to SEQ ID NO: 112682

SEQ ID NO: 112851 - DNA, 601 bp, Human; identical to SEQ ID NO: 112683

SEQ ID NO: 112852 - DNA, 601 bp, Human; identical to SEQ ID NO: 112684

SEQ ID NO: 112853 - DNA, 601 bp, Human; identical to SEQ ID NO: 112685

SEQ ID NO: 112854 - DNA, 601 bp, Human; identical to SEQ ID NO: 112686

SEQ ID NO: 112855 - DNA, 601 bp, Human; identical to SEQ ID NO: 112687

SEQ ID NO: 112856 - DNA, 601 bp, Human; identical to SEQ ID NO: 112688

SEQ ID NO: 112857 - DNA, 601 bp, Human; identical to SEQ ID NO: 112689

SEQ ID NO: 112858 - DNA, 601 bp, Human; identical to SEQ ID NO: 112690

SEQ ID NO: 112859 - DNA, 601 bp, Human; identical to SEQ ID NO: 112691

SEQ ID NO: 112860 - DNA, 601 bp, Human; identical to SEQ ID NO: 112692

SEQ ID NO: 112861 - DNA, 601 bp, Human; identical to SEQ ID NO: 112693

SEQ ID NO: 112862 - DNA, 601 bp, Human; identical to SEQ ID NO: 112694

SEQ ID NO: 112863 - DNA, 601 bp, Human; identical to SEQ ID NO: 112695

SEQ ID NO: 112864 - DNA, 601 bp, Human; identical to SEQ ID NO: 112696

SEQ ID NO: 112865 - DNA, 601 bp, Human; identical to SEQ ID NO: 112697

SEQ ID NO: 112866 - DNA, 601 bp, Human; identical to SEQ ID NO: 112698

SEQ ID NO: 112867 - DNA, 601 bp, Human; identical to SEQ ID NO: 112699

SEQ ID NO: 112868 - DNA, 601 bp, Human; identical to SEQ ID NO: 112700

SEQ ID NO: 112869 - DNA, 601 bp, Human; identical to SEQ ID NO: 112701

SEQ ID NO: 112870 - DNA, 601 bp, Human; identical to SEQ ID NO: 112702

SEQ ID NO: 112871 - DNA, 601 bp, Human; identical to SEQ ID NO: 112703

SEQ ID NO: 112872 - DNA, 601 bp, Human; identical to SEQ ID NO: 112704

SEQ ID NO: 112873 - DNA, 601 bp, Human; identical to SEQ ID NO: 112705

SEQ ID NO: 112874 - DNA, 601 bp, Human; identical to SEQ ID NO: 112706

SEQ ID NO: 112875 - DNA, 601 bp, Human; identical to SEQ ID NO: 112707

SEQ ID NO: 112876 - DNA, 601 bp, Human; identical to SEQ ID NO: 112708

SEQ ID NO: 112877 - DNA, 601 bp, Human; identical to SEQ ID NO: 112709

SEQ ID NO: 112878 - DNA, 601 bp, Human; identical to SEQ ID NO: 112710

SEQ ID NO: 112879 - DNA, 601 bp, Human; identical to SEQ ID NO: 112711

SEQ ID NO: 112880 - DNA, 601 bp, Human; identical to SEQ ID NO: 112712

SEQ ID NO: 112881 - DNA, 601 bp, Human; identical to SEQ ID NO: 112713

SEQ ID NO: 112882 - DNA, 601 bp, Human; identical to SEQ ID NO: 112714

SEQ ID NO: 112883 - DNA, 601 bp, Human; identical to SEQ ID NO: 112715

SEQ ID NO: 112884 - DNA, 601 bp, Human; identical to SEQ ID NO: 112716

SEQ ID NO: 112885 - DNA, 601 bp, Human; identical to SEQ ID NO: 112717

SEQ ID NO: 112886 - DNA, 601 bp, Human; identical to SEQ ID NO: 112718

SEQ ID NO: 112887 - DNA, 601 bp, Human; identical to SEQ ID NO: 112719

SEQ ID NO: 112888 - DNA, 601 bp, Human; identical to SEQ ID NO: 112720

SEQ ID NO: 112889 - DNA, 601 bp, Human; identical to SEQ ID NO: 112721

SEQ ID NO: 112890 - DNA, 601 bp, Human; identical to SEQ ID NO: 25330

SEQ ID NO: 112891 - DNA, 601 bp, Human; identical to SEQ ID NO: 25331

SEQ ID NO: 112892 - DNA, 601 bp, Human; identical to SEQ ID NO: 112724

SEQ ID NO: 112893 - DNA, 601 bp, Human; identical to SEQ ID NO: 112725

SEQ ID NO: 112894 - DNA, 601 bp, Human; identical to SEQ ID NO: 112726

SEQ ID NO: 112895 - DNA, 601 bp, Human; identical to SEQ ID NO: 112727

SEQ ID NO: 112896 - DNA, 601 bp, Human; identical to SEQ ID NO: 112728

SEQ ID NO: 112897 - DNA, 601 bp, Human; identical to SEQ ID NO: 112729

SEQ ID NO: 112898 - DNA, 601 bp, Human; identical to SEQ ID NO: 112730

SEQ ID NO: 112899 - DNA, 601 bp, Human; identical to SEQ ID NO: 112731

SEQ ID NO: 112900 - DNA, 601 bp, Human; identical to SEQ ID NO: 112732

SEQ ID NO: 112901 - DNA, 601 bp, Human; identical to SEQ ID NO: 112733

SEQ ID NO: 112902 - DNA, 601 bp, Human; identical to SEQ ID NO: 112734

SEQ ID NO: 112903 - DNA, 601 bp, Human; identical to SEQ ID NO: 112735

SEQ ID NO: 112904 - DNA, 601 bp, Human; identical to SEQ ID NO: 112736

SEQ ID NO: 112905 - DNA, 601 bp, Human; identical to SEQ ID NO: 112737

SEQ ID NO: 112906 - DNA, 601 bp, Human; identical to SEQ ID NO: 112738

SEQ ID NO: 112907 - DNA, 601 bp, Human; identical to SEQ ID NO: 112739

SEQ ID NO: 112908 - DNA, 601 bp, Human; identical to SEQ ID NO: 112740

SEQ ID NO: 112909 - DNA, 601 bp, Human; identical to SEQ ID NO: 112741

SEQ ID NO: 112910 - DNA, 601 bp, Human; identical to SEQ ID NO: 112742

SEQ ID NO: 112911 - DNA, 601 bp, Human; identical to SEQ ID NO: 112743

SEQ ID NO: 112912 - DNA, 601 bp, Human; identical to SEQ ID NO: 112744

SEQ ID NO: 112913 - DNA, 601 bp, Human; identical to SEQ ID NO: 112745

SEQ ID NO: 112914 - DNA, 601 bp, Human; identical to SEQ ID NO: 112746

SEQ ID NO: 112915 - DNA, 601 bp, Human; identical to SEQ ID NO: 112747

SEQ ID NO: 112916 - DNA, 601 bp, Human; identical to SEQ ID NO: 112748

SEQ ID NO: 112917 - DNA, 601 bp, Human; identical to SEQ ID NO: 112749

SEQ ID NO: 112918 - DNA, 601 bp, Human; identical to SEQ ID NO: 25332

SEQ ID NO: 112919 - DNA, 601 bp, Human; identical to SEQ ID NO: 25333

SEQ ID NO: 112920 - DNA, 601 bp, Human; identical to SEQ ID NO: 25334

SEQ ID NO: 112921 - DNA, 601 bp, Human; identical to SEQ ID NO: 112761

SEQ ID NO: 112922 - DNA, 601 bp, Human; identical to SEQ ID NO: 112762

SEQ ID NO: 112923 - DNA, 601 bp, Human; identical to SEQ ID NO: 112679

SEQ ID NO: 112924 - DNA, 601 bp, Human; identical to SEQ ID NO: 112680

SEQ ID NO: 112925 - DNA, 601 bp, Human; identical to SEQ ID NO: 112681

SEQ ID NO: 112926 - DNA, 601 bp, Human; identical to SEQ ID NO: 112682

SEQ ID NO: 112927 - DNA, 601 bp, Human; identical to SEQ ID NO: 112683

SEQ ID NO: 112928 - DNA, 601 bp, Human; identical to SEQ ID NO: 112684

SEQ ID NO: 112929 - DNA, 601 bp, Human; identical to SEQ ID NO: 112685

SEQ ID NO: 112930 - DNA, 601 bp, Human; identical to SEQ ID NO: 112686

SEQ ID NO: 112931 - DNA, 601 bp, Human; identical to SEQ ID NO: 112687

SEQ ID NO: 112932 - DNA, 601 bp, Human; identical to SEQ ID NO: 112688

SEQ ID NO: 112933 - DNA, 601 bp, Human; identical to SEQ ID NO: 112689

SEQ ID NO: 112934 - DNA, 601 bp, Human; identical to SEQ ID NO: 112690

SEQ ID NO: 112935 - DNA, 601 bp, Human; identical to SEQ ID NO: 112691

SEQ ID NO: 112936 - DNA, 601 bp, Human; identical to SEQ ID NO: 112692

SEQ ID NO: 112937 - DNA, 601 bp, Human; identical to SEQ ID NO: 112693

SEQ ID NO: 112938 - DNA, 601 bp, Human; identical to SEQ ID NO: 112694

SEQ ID NO: 112939 - DNA, 601 bp, Human; identical to SEQ ID NO: 112695

SEQ ID NO: 112940 - DNA, 601 bp, Human; identical to SEQ ID NO: 112696

SEQ ID NO: 112941 - DNA, 601 bp, Human; identical to SEQ ID NO: 112697

SEQ ID NO: 112942 - DNA, 601 bp, Human; identical to SEQ ID NO: 112698

SEQ ID NO: 112943 - DNA, 601 bp, Human; identical to SEQ ID NO: 112699

SEQ ID NO: 112944 - DNA, 601 bp, Human; identical to SEQ ID NO: 112700

SEQ ID NO: 112945 - DNA, 601 bp, Human; identical to SEQ ID NO: 112701

SEQ ID NO: 112946 - DNA, 601 bp, Human; identical to SEQ ID NO: 112702

SEQ ID NO: 112947 - DNA, 601 bp, Human; identical to SEQ ID NO: 112703

SEQ ID NO: 112948 - DNA, 601 bp, Human; identical to SEQ ID NO: 112704

SEQ ID NO: 112949 - DNA, 601 bp, Human; identical to SEQ ID NO: 112705

SEQ ID NO: 112950 - DNA, 601 bp, Human; identical to SEQ ID NO: 112706

SEQ ID NO: 112951 - DNA, 601 bp, Human; identical to SEQ ID NO: 112707

SEQ ID NO: 112952 - DNA, 601 bp, Human; identical to SEQ ID NO: 112708

SEQ ID NO: 112953 - DNA, 601 bp, Human; identical to SEQ ID NO: 112709

SEQ ID NO: 112954 - DNA, 601 bp, Human; identical to SEQ ID NO: 112710

SEQ ID NO: 112955 - DNA, 601 bp, Human; identical to SEQ ID NO: 112711

SEQ ID NO: 112956 - DNA, 601 bp, Human; identical to SEQ ID NO: 112712

SEQ ID NO: 112957 - DNA, 601 bp, Human; identical to SEQ ID NO: 112713

SEQ ID NO: 112958 - DNA, 601 bp, Human; identical to SEQ ID NO: 112714

SEQ ID NO: 112959 - DNA, 601 bp, Human; identical to SEQ ID NO: 112715

SEQ ID NO: 112960 - DNA, 601 bp, Human; identical to SEQ ID NO: 112716

SEQ ID NO: 112961 - DNA, 601 bp, Human; identical to SEQ ID NO: 112717

SEQ ID NO: 112962 - DNA, 601 bp, Human; identical to SEQ ID NO: 112718

SEQ ID NO: 112963 - DNA, 601 bp, Human; identical to SEQ ID NO: 112719

SEQ ID NO: 112964 - DNA, 601 bp, Human; identical to SEQ ID NO: 112720

SEQ ID NO: 112965 - DNA, 601 bp, Human; identical to SEQ ID NO: 112721

SEQ ID NO: 112966 - DNA, 601 bp, Human; identical to SEQ ID NO: 25330

SEQ ID NO: 112967 - DNA, 601 bp, Human; identical to SEQ ID NO: 25331

SEQ ID NO: 112968 - DNA, 601 bp, Human; identical to SEQ ID NO: 112724

SEQ ID NO: 112969 - DNA, 601 bp, Human; identical to SEQ ID NO: 112725

SEQ ID NO: 112970 - DNA, 601 bp, Human; identical to SEQ ID NO: 112726

SEQ ID NO: 112971 - DNA, 601 bp, Human; identical to SEQ ID NO: 112727

SEQ ID NO: 112972 - DNA, 601 bp, Human; identical to SEQ ID NO: 112728

SEQ ID NO: 112973 - DNA, 601 bp, Human; identical to SEQ ID NO: 112729

SEQ ID NO: 112974 - DNA, 601 bp, Human; identical to SEQ ID NO: 112730

SEQ ID NO: 112975 - DNA, 601 bp, Human; identical to SEQ ID NO: 112731

SEQ ID NO: 112976 - DNA, 601 bp, Human; identical to SEQ ID NO: 112732

SEQ ID NO: 112977 - DNA, 601 bp, Human; identical to SEQ ID NO: 112733

SEQ ID NO: 112978 - DNA, 601 bp, Human; identical to SEQ ID NO: 112734

SEQ ID NO: 112979 - DNA, 601 bp, Human; identical to SEQ ID NO: 112735

SEQ ID NO: 112980 - DNA, 601 bp, Human; identical to SEQ ID NO: 112736

SEQ ID NO: 112981 - DNA, 601 bp, Human; identical to SEQ ID NO: 112737

SEQ ID NO: 112982 - DNA, 601 bp, Human; identical to SEQ ID NO: 112738

SEQ ID NO: 112983 - DNA, 601 bp, Human; identical to SEQ ID NO: 112739

SEQ ID NO: 112984 - DNA, 601 bp, Human; identical to SEQ ID NO: 112740

SEQ ID NO: 112985 - DNA, 601 bp, Human; identical to SEQ ID NO: 112741

SEQ ID NO: 112986 - DNA, 601 bp, Human; identical to SEQ ID NO: 112742

SEQ ID NO: 112987 - DNA, 601 bp, Human; identical to SEQ ID NO: 112743

SEQ ID NO: 112988 - DNA, 601 bp, Human; identical to SEQ ID NO: 112744

SEQ ID NO: 112989 - DNA, 601 bp, Human; identical to SEQ ID NO: 112745

SEQ ID NO: 112990 - DNA, 601 bp, Human; identical to SEQ ID NO: 112746

SEQ ID NO: 112991 - DNA, 601 bp, Human; identical to SEQ ID NO: 112747

SEQ ID NO: 112992 - DNA, 601 bp, Human; identical to SEQ ID NO: 112748

SEQ ID NO: 112993 - DNA, 601 bp, Human; identical to SEQ ID NO: 112749

SEQ ID NO: 112994 - DNA, 601 bp, Human; identical to SEQ ID NO: 25332

SEQ ID NO: 112995 - DNA, 601 bp, Human; identical to SEQ ID NO: 25333

SEQ ID NO: 112996 - DNA, 601 bp, Human; identical to SEQ ID NO: 25334

SEQ ID NO: 112997 - DNA, 601 bp, Human
ataagattggagtccgtcgtaggaaactggaaccgaattcagagaaagcgattcaccgaaaaggaaatgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatycgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttct

SEQ ID NO: 112998 - DNA, 601 bp, Human
tggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgyggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctacttcaggtgagtttatttatttctttgattattaagaacaaatatgagaatgtggttattataaagctttaacacatatgtatttgagaaataaagccatgaggttgtca

SEQ ID NO: 112999 - DNA, 601 bp, Human; identical to SEQ ID NO: 112753

SEQ ID NO: 113000 - DNA, 601 bp, Human; identical to SEQ ID NO: 112754

SEQ ID NO: 113001 - DNA, 601 bp, Human; identical to SEQ ID NO: 112755

SEQ ID NO: 113002 - DNA, 601 bp, Human; identical to SEQ ID NO: 112756

SEQ ID NO: 113003 - DNA, 601 bp, Human; identical to SEQ ID NO: 112757

SEQ ID NO: 113004 - DNA, 601 bp, Human; identical to SEQ ID NO: 112758

SEQ ID NO: 113005 - DNA, 601 bp, Human; identical to SEQ ID NO: 112759

SEQ ID NO: 113006 - DNA, 601 bp, Human; identical to SEQ ID NO: 112760

SEQ ID NO: 113007 - DNA, 601 bp, Human; identical to SEQ ID NO: 112761

SEQ ID NO: 113008 - DNA, 601 bp, Human; identical to SEQ ID NO: 112762

SEQ ID NO: 113009 - DNA, 601 bp, Human; identical to SEQ ID NO: 112679

SEQ ID NO: 113010 - DNA, 601 bp, Human; identical to SEQ ID NO: 112680

SEQ ID NO: 113011 - DNA, 601 bp, Human; identical to SEQ ID NO: 112681

SEQ ID NO: 113012 - DNA, 601 bp, Human; identical to SEQ ID NO: 112682

SEQ ID NO: 113013 - DNA, 601 bp, Human; identical to SEQ ID NO: 112683

SEQ ID NO: 113014 - DNA, 601 bp, Human; identical to SEQ ID NO: 112684

SEQ ID NO: 113015 - DNA, 601 bp, Human; identical to SEQ ID NO: 112685

SEQ ID NO: 113016 - DNA, 601 bp, Human; identical to SEQ ID NO: 112686

SEQ ID NO: 113017 - DNA, 601 bp, Human; identical to SEQ ID NO: 112687

SEQ ID NO: 113018 - DNA, 601 bp, Human; identical to SEQ ID NO: 112688

SEQ ID NO: 113019 - DNA, 601 bp, Human; identical to SEQ ID NO: 112689

SEQ ID NO: 113020 - DNA, 601 bp, Human; identical to SEQ ID NO: 112690

SEQ ID NO: 113021 - DNA, 601 bp, Human; identical to SEQ ID NO: 112691

SEQ ID NO: 113022 - DNA, 601 bp, Human; identical to SEQ ID NO: 112692

SEQ ID NO: 113023 - DNA, 601 bp, Human; identical to SEQ ID NO: 112693

SEQ ID NO: 113024 - DNA, 601 bp, Human; identical to SEQ ID NO: 112694

SEQ ID NO: 113025 - DNA, 601 bp, Human; identical to SEQ ID NO: 112695

SEQ ID NO: 113026 - DNA, 601 bp, Human; identical to SEQ ID NO: 112696

SEQ ID NO: 113027 - DNA, 601 bp, Human; identical to SEQ ID NO: 112697

SEQ ID NO: 113028 - DNA, 601 bp, Human; identical to SEQ ID NO: 112698

SEQ ID NO: 113029 - DNA, 601 bp, Human; identical to SEQ ID NO: 112699

SEQ ID NO: 113030 - DNA, 601 bp, Human; identical to SEQ ID NO: 112700

SEQ ID NO: 113031 - DNA, 601 bp, Human; identical to SEQ ID NO: 112701

SEQ ID NO: 113032 - DNA, 601 bp, Human; identical to SEQ ID NO: 112702

SEQ ID NO: 113033 - DNA, 601 bp, Human; identical to SEQ ID NO: 112703

SEQ ID NO: 113034 - DNA, 601 bp, Human; identical to SEQ ID NO: 112704

SEQ ID NO: 113035 - DNA, 601 bp, Human; identical to SEQ ID NO: 112705

SEQ ID NO: 113036 - DNA, 601 bp, Human; identical to SEQ ID NO: 112706

SEQ ID NO: 113037 - DNA, 601 bp, Human; identical to SEQ ID NO: 112707

SEQ ID NO: 113038 - DNA, 601 bp, Human; identical to SEQ ID NO: 112708

SEQ ID NO: 113039 - DNA, 601 bp, Human; identical to SEQ ID NO: 112709

SEQ ID NO: 113040 - DNA, 601 bp, Human; identical to SEQ ID NO: 112710

SEQ ID NO: 113041 - DNA, 601 bp, Human; identical to SEQ ID NO: 112711

SEQ ID NO: 113042 - DNA, 601 bp, Human; identical to SEQ ID NO: 112712

SEQ ID NO: 113043 - DNA, 601 bp, Human; identical to SEQ ID NO: 112713

SEQ ID NO: 113044 - DNA, 601 bp, Human; identical to SEQ ID NO: 112714

SEQ ID NO: 113045 - DNA, 601 bp, Human; identical to SEQ ID NO: 112715

SEQ ID NO: 113046 - DNA, 601 bp, Human; identical to SEQ ID NO: 112716

SEQ ID NO: 113047 - DNA, 601 bp, Human; identical to SEQ ID NO: 112717

SEQ ID NO: 113048 - DNA, 601 bp, Human; identical to SEQ ID NO: 112718

SEQ ID NO: 113049 - DNA, 601 bp, Human; identical to SEQ ID NO: 112719

SEQ ID NO: 113050 - DNA, 601 bp, Human; identical to SEQ ID NO: 112720

SEQ ID NO: 113051 - DNA, 601 bp, Human; identical to SEQ ID NO: 112721

SEQ ID NO: 113052 - DNA, 601 bp, Human; identical to SEQ ID NO: 25330

SEQ ID NO: 113053 - DNA, 601 bp, Human; identical to SEQ ID NO: 25331

SEQ ID NO: 113054 - DNA, 601 bp, Human; identical to SEQ ID NO: 112724

SEQ ID NO: 113055 - DNA, 601 bp, Human; identical to SEQ ID NO: 112725

SEQ ID NO: 113056 - DNA, 601 bp, Human; identical to SEQ ID NO: 112726

SEQ ID NO: 113057 - DNA, 601 bp, Human; identical to SEQ ID NO: 112727

SEQ ID NO: 113058 - DNA, 601 bp, Human; identical to SEQ ID NO: 112728

SEQ ID NO: 113059 - DNA, 601 bp, Human; identical to SEQ ID NO: 112729

SEQ ID NO: 113060 - DNA, 601 bp, Human; identical to SEQ ID NO: 112730

SEQ ID NO: 113061 - DNA, 601 bp, Human; identical to SEQ ID NO: 112731

SEQ ID NO: 113062 - DNA, 601 bp, Human; identical to SEQ ID NO: 112732

SEQ ID NO: 113063 - DNA, 601 bp, Human; identical to SEQ ID NO: 112733

SEQ ID NO: 113064 - DNA, 601 bp, Human; identical to SEQ ID NO: 112734

SEQ ID NO: 113065 - DNA, 601 bp, Human; identical to SEQ ID NO: 112735

SEQ ID NO: 113066 - DNA, 601 bp, Human; identical to SEQ ID NO: 112736

SEQ ID NO: 113067 - DNA, 601 bp, Human; identical to SEQ ID NO: 112737

SEQ ID NO: 113068 - DNA, 601 bp, Human; identical to SEQ ID NO: 112738

SEQ ID NO: 113069 - DNA, 601 bp, Human; identical to SEQ ID NO: 112739

SEQ ID NO: 113070 - DNA, 601 bp, Human; identical to SEQ ID NO: 112740

SEQ ID NO: 113071 - DNA, 601 bp, Human; identical to SEQ ID NO: 112741

SEQ ID NO: 113072 - DNA, 601 bp, Human; identical to SEQ ID NO: 112742

SEQ ID NO: 113073 - DNA, 601 bp, Human; identical to SEQ ID NO: 112743

SEQ ID NO: 113074 - DNA, 601 bp, Human; identical to SEQ ID NO: 112744

SEQ ID NO: 113075 - DNA, 601 bp, Human; identical to SEQ ID NO: 112745

SEQ ID NO: 113076 - DNA, 601 bp, Human; identical to SEQ ID NO: 112746

SEQ ID NO: 113077 - DNA, 601 bp, Human; identical to SEQ ID NO: 112747

SEQ ID NO: 113078 - DNA, 601 bp, Human; identical to SEQ ID NO: 112748

SEQ ID NO: 113079 - DNA, 601 bp, Human; identical to SEQ ID NO: 112749

SEQ ID NO: 113080 - DNA, 601 bp, Human; identical to SEQ ID NO: 25332

SEQ ID NO: 113081 - DNA, 601 bp, Human; identical to SEQ ID NO: 25333

SEQ ID NO: 113082 - DNA, 601 bp, Human; identical to SEQ ID NO: 25334

SEQ ID NO: 113083 - DNA, 601 bp, Human; identical to SEQ ID NO: 38227

SEQ ID NO: 113084 - DNA, 601 bp, Human; identical to SEQ ID NO: 38228

SEQ ID NO: 113085 - DNA, 601 bp, Human; identical to SEQ ID NO: 38229

SEQ ID NO: 113086 - DNA, 601 bp, Human; identical to SEQ ID NO: 38230

SEQ ID NO: 113087 - DNA, 601 bp, Human; identical to SEQ ID NO: 19827

SEQ ID NO: 113088 - DNA, 601 bp, Human; identical to SEQ ID NO: 19828

SEQ ID NO: 113089 - DNA, 601 bp, Human; identical to SEQ ID NO: 19829

SEQ ID NO: 113090 - DNA, 601 bp, Human; identical to SEQ ID NO: 19830

SEQ ID NO: 113091 - DNA, 601 bp, Human; identical to SEQ ID NO: 19831

SEQ ID NO: 113092 - DNA, 601 bp, Human; identical to SEQ ID NO: 19832

SEQ ID NO: 113093 - DNA, 601 bp, Human; identical to SEQ ID NO: 19833

SEQ ID NO: 113094 - DNA, 601 bp, Human; identical to SEQ ID NO: 19834

SEQ ID NO: 113095 - DNA, 601 bp, Human; identical to SEQ ID NO: 19835

SEQ ID NO: 113096 - DNA, 601 bp, Human; identical to SEQ ID NO: 19836

SEQ ID NO: 113097 - DNA, 601 bp, Human; identical to SEQ ID NO: 19837

SEQ ID NO: 113098 - DNA, 601 bp, Human; identical to SEQ ID NO: 19838

SEQ ID NO: 113099 - DNA, 601 bp, Human; identical to SEQ ID NO: 19839

SEQ ID NO: 113100 - DNA, 601 bp, Human; identical to SEQ ID NO: 19840

SEQ ID NO: 113101 - DNA, 601 bp, Human; identical to SEQ ID NO: 19841

SEQ ID NO: 113102 - DNA, 601 bp, Human; identical to SEQ ID NO: 19842

SEQ ID NO: 113103 - DNA, 601 bp, Human; identical to SEQ ID NO: 19843

SEQ ID NO: 113104 - DNA, 601 bp, Human; identical to SEQ ID NO: 19844

SEQ ID NO: 113105 - DNA, 601 bp, Human; identical to SEQ ID NO: 19845

SEQ ID NO: 113106 - DNA, 601 bp, Human; identical to SEQ ID NO: 19846

SEQ ID NO: 113107 - DNA, 601 bp, Human; identical to SEQ ID NO: 19847

SEQ ID NO: 113108 - DNA, 601 bp, Human; identical to SEQ ID NO: 19848

SEQ ID NO: 113109 - DNA, 601 bp, Human; identical to SEQ ID NO: 19849

SEQ ID NO: 113110 - DNA, 601 bp, Human; identical to SEQ ID NO: 19850

SEQ ID NO: 113111 - DNA, 601 bp, Human; identical to SEQ ID NO: 19851

SEQ ID NO: 113112 - DNA, 601 bp, Human; identical to SEQ ID NO: 19852

SEQ ID NO: 113113 - DNA, 601 bp, Human; identical to SEQ ID NO: 19853

SEQ ID NO: 113114 - DNA, 601 bp, Human; identical to SEQ ID NO: 19854

SEQ ID NO: 113115 - DNA, 601 bp, Human; identical to SEQ ID NO: 19855

SEQ ID NO: 113116 - DNA, 601 bp, Human; identical to SEQ ID NO: 19856

SEQ ID NO: 113117 - DNA, 601 bp, Human; identical to SEQ ID NO: 19857

SEQ ID NO: 113118 - DNA, 601 bp, Human; identical to SEQ ID NO: 19858

SEQ ID NO: 113119 - DNA, 601 bp, Human; identical to SEQ ID NO: 19859

SEQ ID NO: 113120 - DNA, 601 bp, Human; identical to SEQ ID NO: 19860

SEQ ID NO: 113121 - DNA, 601 bp, Human; identical to SEQ ID NO: 19861

SEQ ID NO: 113122 - DNA, 601 bp, Human; identical to SEQ ID NO: 19862

SEQ ID NO: 113123 - DNA, 601 bp, Human; identical to SEQ ID NO: 19863

SEQ ID NO: 113124 - DNA, 601 bp, Human; identical to SEQ ID NO: 19864

SEQ ID NO: 113125 - DNA, 601 bp, Human; identical to SEQ ID NO: 19865

SEQ ID NO: 113126 - DNA, 601 bp, Human; identical to SEQ ID NO: 19866

SEQ ID NO: 113127 - DNA, 601 bp, Human; identical to SEQ ID NO: 19867

SEQ ID NO: 113128 - DNA, 601 bp, Human; identical to SEQ ID NO: 19868

SEQ ID NO: 113129 - DNA, 601 bp, Human; identical to SEQ ID NO: 19869

SEQ ID NO: 113130 - DNA, 601 bp, Human; identical to SEQ ID NO: 19870

SEQ ID NO: 113131 - DNA, 601 bp, Human; identical to SEQ ID NO: 19871

SEQ ID NO: 113132 - DNA, 601 bp, Human; identical to SEQ ID NO: 19872

SEQ ID NO: 113133 - DNA, 601 bp, Human; identical to SEQ ID NO: 19873

SEQ ID NO: 113134 - DNA, 601 bp, Human; identical to SEQ ID NO: 19874

SEQ ID NO: 113135 - DNA, 601 bp, Human; identical to SEQ ID NO: 19875

SEQ ID NO: 113136 - DNA, 601 bp, Human; identical to SEQ ID NO: 19876

SEQ ID NO: 113137 - DNA, 601 bp, Human; identical to SEQ ID NO: 19877

SEQ ID NO: 113138 - DNA, 601 bp, Human; identical to SEQ ID NO: 19878

SEQ ID NO: 113139 - DNA, 601 bp, Human; identical to SEQ ID NO: 19879

SEQ ID NO: 113140 - DNA, 601 bp, Human; identical to SEQ ID NO: 19880

SEQ ID NO: 113141 - DNA, 601 bp, Human; identical to SEQ ID NO: 19881

SEQ ID NO: 113142 - DNA, 601 bp, Human; identical to SEQ ID NO: 19882

SEQ ID NO: 113143 - DNA, 601 bp, Human; identical to SEQ ID NO: 19883

SEQ ID NO: 113144 - DNA, 601 bp, Human; identical to SEQ ID NO: 19884

SEQ ID NO: 113145 - DNA, 601 bp, Human; identical to SEQ ID NO: 19885

SEQ ID NO: 113146 - DNA, 601 bp, Human; identical to SEQ ID NO: 19886

SEQ ID NO: 113147 - DNA, 601 bp, Human; identical to SEQ ID NO: 19887

SEQ ID NO: 113148 - DNA, 601 bp, Human; identical to SEQ ID NO: 19888

SEQ ID NO: 113149 - DNA, 601 bp, Human; identical to SEQ ID NO: 19889

SEQ ID NO: 113150 - DNA, 601 bp, Human; identical to SEQ ID NO: 19890

SEQ ID NO: 113151 - DNA, 601 bp, Human; identical to SEQ ID NO: 19891

SEQ ID NO: 113152 - DNA, 601 bp, Human; identical to SEQ ID NO: 19892

SEQ ID NO: 113153 - DNA, 601 bp, Human; identical to SEQ ID NO: 19893

SEQ ID NO: 113154 - DNA, 601 bp, Human; identical to SEQ ID NO: 19894

SEQ ID NO: 113155 - DNA, 601 bp, Human; identical to SEQ ID NO: 19895

SEQ ID NO: 113156 - DNA, 601 bp, Human; identical to SEQ ID NO: 19896

SEQ ID NO: 113157 - DNA, 601 bp, Human; identical to SEQ ID NO: 19897

SEQ ID NO: 113158 - DNA, 601 bp, Human; identical to SEQ ID NO: 19898

SEQ ID NO: 113159 - DNA, 601 bp, Human; identical to SEQ ID NO: 19899

SEQ ID NO: 113160 - DNA, 601 bp, Human; identical to SEQ ID NO: 19900

SEQ ID NO: 113161 - DNA, 601 bp, Human; identical to SEQ ID NO: 19901

SEQ ID NO: 113162 - DNA, 601 bp, Human
tctataaaacgccccaaaaatcatactagctccccagcaatggatccaaaccaggaagaaatttctgaattgccagataaagaattcagaaggttgattattcagctattcaaggagataccagaacaaggtgaaaatcaacttaaagaaattttaaaaaatacaagatatggatgaaaaattctccagagagaaatagagatcataaagaaaaaacaatcacaaattctggaaatgaaagacacacttagagaaatacaaaatgcactggaaaattttaataatagactagaacaagtaraagaaagtacttcagagctcgaagacaaagctttcaaattaacccaatcagacaaaaacaaagaaaaaaaattttaaaaatgaacaaagcctccaagaaatgtgggattatgttaaacagccaaccctaagaataactggtgttcctgaggaagaagagaaacataaaagtttgaaaaacttatttgaggaaataattgaggaaaagttccctggccttgctagagatctagacatccaaatacaagaagttcaaagaacacctaggaaattcatcacaaaaagatcattacctaggcac

SEQ ID NO: 113163 - DNA, 601 bp, Human
attcaggggcaaggtctgaggagtgagggggtgcaccacagaagtaagaccagcctcaccaactgcatgggagctgggtgaagcctttcattaccagctatcccccacttccctggcaaactatatgacacagcagaggcagccataatcctctctggaacataacctgttggcccaagaaccaccccccatcccctacagtggctacagcaagccccacccaaggagagtctgagcccatatccacctaatccttcccctacctgatggtatttctctacctgccctggttgctgaacayaaaagacagaaattcttgggagctttatgccccacctattgcctgagaaaccagaatactaaccctggccaacttaagacaaacttagatcccccaactagcaccacagctagtgctctcttgaaagcaccacctcctggctgaaagccaactaactcaggccattacagcaactcatgacaaaataatcctgctcccaggaaagataaaataacagctaatataccactgcctgcaacatcctggctaaccagaggtcctgagtctgttcacatgacaacttcactactagcataacca

SEQ ID NO: 113164 - DNA, 601 bp, Human
cttacaaatgagcaaagtggtttcctgatatggaatctagccccagttaagatgtgaatattgctgaagtgacaacaaaggatttagaatattacataaacttgattgataaagcagcagcagggttggggagaattgactccacccctgaagaaagttctaccatggctaaagaaagttctaccatggctaaaatgctacagagaaatctttcatgaagagtcaatctatgtagcaaacttcattgctctctgatttcaagaacttgccacagccaaacagatccgttgaaagaagccasacagtgctgtaaattccacgagacaggcgaaaaaccatgagctcccaaagtgtgagaggggggataaaacctgcctctgaacacacattccccattggggaatctgaaaatccagatcacaggagaaggatttaatcttacctacagctgaaatggatttagagagccgagtgaaatataaaagtagaagcagcagcaggaagagccttgtaggcactcccagtctccagctcaagcccagggaagccattcctgactacatctcacaggggccctcggggaaagcagacagcagaatta

SEQ ID NO: 113165 - DNA, 601 bp, Human
tcctctgatgaatctgggcaaaataaatcaaaaactttctggaaaggattcaccattctagatgccattaagaatattcatgattcataggagaaagtcaaaatatcaacagaatttgaaatgtttattataaccctcatggatgactttgaggagttcaagacttcagtggaataagtaactgcagatgtagtggaaatagcaaaagaactagaattagaagtggagcctgaaagttagccaggcatagtagcacacacctgtagtcccagctactcaggaggcggggatgggagaatcrcttgaacccaggagttcgaggcggcagtgagccatgatcatgccattgcattccaacctggaggacacagtgagatactgtctcaaaaaaatataaataaataactgtttttggtttttttttttttttgagacagggtcttactctgtcactcaggctgaaatacagtggcgcgaccttggctcactgcaatctccatctcccgggttcgagtgattctcctgcctcagcctcatgagtagctgggtttacaggtgcctgccaccatgcccagctaatttttatacttttagtagagat

SEQ ID NO: 113166 - DNA, 601 bp, Human
ggtttaaggaaagaagccatctctctaacataaaggtacaaggtaaagtgctgttatggaagctgcagcaaattatccagaagatatagctaagataattgatgaacatggctccactaaacagcaggaattcagtgtagacaaaacagccttctattagaagaaaatggtatctaggactttcatagctagagagaagtcaatgcctagattcaaagcttcaaaggacaggctgactttcttgttaggagctggtaactttaagttgaagccagtgctcgtttaccattctgaaaatactagggcccttaagaattatgctaaatctactctgtctgtgctctatcaacgaacaacaaaagcctggatgacatcccatctgtttacagaatgttttactgaattttttgaaccccactgttgagacttactgctcagaaaaaaagattccttccaaaatattactgctcactgactatgcacctaggcacccaagaactctgatggaaatgtacagggagattaatgttggttccatgcctactaacatagcagcccatggatcaagggatagtttcaattttcaagtcctatattattt

SEQ ID NO: 113167 - DNA, 601 bp, Human
cttccaggacacaatgaaagactagctttctcagtttctcttgtagttgagtgagggccatgtatctggattctggccaatgggatacgggccaaagttagctatacgactaccaagcctggccataaaaccccctgagagatcacccatgcctgctcctcccctttcatagcaactttagaagtcacatgtttaagatgacagcatcaaagatggaaagactctagcgagttgctaatcagagaagagtagcctgggaaagttgcctgatacaacacattccgatatgagcaagaaatayagtttgattggaactcctgagttttgggcagttgtttatgagagaaactagtattacaggcatactttgctttactgtaattcacagatactgcattttttaataaattgaaagtctgtggcaaccttttgtctatcaagtctatcaagtaatttatccaacagtatgtactcattttgtgtctgtgccacattttggtaatttccacaatagttcaagcttttttattattattatatttgttacagtgatctatgatcagtgatctttgatgttacaactgtaattgttttggagtgc

SEQ ID NO: 113168 - DNA, 601 bp, Human
gaaaaaaaaaacacacacacaaacaaaaaacagaaaagccctgccctcatagtgtttatattctattaggaaaatataaatcatgagcaataaacataataaataaataaataagaagattcatcccatcagactttctctccctcttactactgcctcagaagtccaatcctatttccatcagctctttcagggttccctttccttcttatccaacatcagagcccacagtggatcaacataattagtcccctgtaaatacccttaacctccttgctctgcccccattacccagtcacaytcacctgagaaaaatccagacctcaatgaacttaaccacctgacttctttgtgcctacacatatgtagctgaggcttcctagagcaaatctcacagcacaaaagatgggtgacactatacttcataatcaccaatatcaaaggcaatcctaccacacaccattagctctcctttatgataaatattttacatcttttcctcattcctaaaacatccccttttcaactgacaactttaagttagacttcactgaaaagaaaaaaacaaaagaagccataataattaaagctaattgtgtat

SEQ ID NO: 113169 - DNA, 601 bp, Human
ttgtgagaagctgggagaagggttcacagaattctatgtacaattactgcaacttcccttgagtctattaattattttaaaataataagatttttttaaaagccacctgaagaacaagactgaacaaagtatattaaatcagtgacaaaaataaattttgtttcttacctttaggctctttaggtaatttgagagcatgctgggatggaaccgattttcttcagcaacttgactatcatatcttggtcctaacattgtcttcagaggtaagaatcttcctaaacaacacagataggtaatmatttccataaaaggaaatgtttcagattaaaattctataattaacaattctcaaatatcaccttcttaaaacctttttttttgagaccaagtgtcgctctgtcccccaggatagagtgcagtggtgcaatctcagctcattgaaacctctgcctcctgagttcaagcaattaccttgcctcagtctcccaagtagctaggattacaggtgtgtaccaccaagcccagctaatttttgtgtttttagtagagacagggtttcaccacattgcccaggctggtctcaaactcctgggctcaa

SEQ ID NO: 113170 - DNA, 601 bp, Human
tgtccaccatttcatgaatttttttattatgctgctgaaggattatgaattttttatctgctgctgaaggattattgtgttcctttggagatggcatatttcttgctctttcatgtttgccatgtccttacattgatatctgcacatctggtgtaacactcacttctcctttttttttgagacacggtcacactatcgcccaggctgcagtgggtaatcatggctcactacagcctcaacctcctgggttcaagtgatcctcccacctcagcctcccaagtagctgggactacaggcacayaccaccatgcccggctaatttttttttttaattttttgtagagacagggtctccctatgctgcccacactggtctcaaactcctggcctcaagcaatcctcctgcctcagtctcccaaagtgctgggattacaggcatgagccaccatcccagccccagtttttcttttttttttttcttttctttttttttgagacagagtctcactctgttgcctgggttggagtgcactggtatgtgatcttggctcactgcaacctccgcttcccaggttcaagcgattcttgtgcctcagcctcc

SEQ ID NO: 113171 - DNA, 601 bp, Human
cagcaccatttattaaagagtgtcctgtccccaatgtatgttcttggtgcctttgtctaaatcagttggctgtaaatgcatgcatttatttctggattctctattctgttccattagtctgtttttacaccaatgccatgctgttttggttactatagccttgtaatacactgtaaagtagtgtgatgcccacagctttgttccttttgctcaagattgctttggttattcaggctcatttcaggttccataaaaatgttaggattcaggtggggtgcagtgtctcatgcatgtaatcctrgcacattgggaggccaaggtgggagaactgcttgagctcaggagttcaagaccagcctaggcaacacagtgaaaccccatctttaaaaaaagttttttttaataaaattaaaaagttaggagttttttctatttctataaaaaatgtcattggtattttatagggattgcactgaatatgcagattgctttggaaagtatggtcattttaacaatattaattattccaatccatgggcatggaggtctttctatttgtttgtgttccattcaatttccttcatcactgttctagttttcc

SEQ ID NO: 113172 - DNA, 601 bp, Human
atcatagctcaccactgtaacttcaatcttctggggttaagggatccctccacctcagtctcctgagtaggtaagatggcaggcacatacctcatgcctggctaattttttgaatttttttaaagatggtgtctcgttatgttatcaaggctggtctcaaactcctggcctcaagtaatcctcccatccatctcagcttcccaaagtgctaggattacagacatgagccactgtacctagtcataaatagccattctaactggtgcaagatgatatttcattgtggtttggatttgcatcytcctgatgattagtaatgttgagctttttttcagcattttttcatatatctgttggccatttgtatgtcctcttttgagaaatgtctattcacatctttgcccactttttaatgggatttttttcctgttgtttccagttctttgtatattctggatactaatccctcagaagaatagtttgcaaatatattctcctattcagtaggttgttatttcactctgttgtttcctttgctgtgcagaagcttttttattttattttttgaaacagagtctcactcgttgcccaggctggagta

SEQ ID NO: 113173 - DNA, 601 bp, Human
agtgatcctttcatctcagcctcctaagttctaggactacagatatgaaatcaacttttttggctcccacaggagtgaaactgtggaatttgtctttctgtgtctggcttattttggttaacataataaactcaagttccacccatgtgctgcaaaatgatgatttcattttttcttcatggctgcatagtattccattgtgtatatatgccacattttctttatccattcatccaccctttgataaaattatttctgttcctttggataaatactcagtagtgaaactgctagatcgtayagcagttctacttttagttttctgagaaatttccatactgttttccatggtggctgtactaatttacgttccaaccaacagcatatgagttctcttttctccacatccttgccagcatctgttggtttttgtctttataatagttttgttttgtttttttgagagagagacagggttttgctctgccacccaggctggagtgcagtagcacaatcatagctcaccactgtaacttcaatcttctggggttaagggatccctccacctcagtctcctgagtaggtaagatggcaggcacat

SEQ ID NO: 113174 - DNA, 601 bp, Human
gtggatttttgaagtaagtgaacgtattgtctatttctaaaatgacaaaaatcactatgatttttaggtaccatgtgatgcctaagaatcacaccttgggcagttaaattctaacacatagggtaaaaaagtatgtacagtcaaaattctctcataaattccttaagtaaccaatgaagaacagtatacatggccatatgcatattactggaggcttaatcccatctcaataagtcaaccattgttgcgggaagtcagggacccctaacagagggaccggctgaagccatggcagaagaayataaattgtaaaattcctatgcctgtctttactttaatctcttaatcccatcatcttcgtaagctgaggatgtatgtggcctcaggaccctgtgatgattgtgttaactgcacagatttttcatgaagcatgtgtgtttgaacagcgtgagatctgggcaccttgaaaaaaagaacaggataacagcaatgttcagggaacaagggagatgaccattgggtctaactgcctgggagccaggcaggacagagccatatttcccttattgccaaaaacaggtaagagaaatatcactgaatt

SEQ ID NO: 113175 - DNA, 601 bp, Human
agattcctggcaaaagtgcagtggtgcacgtagtcccagcaactcaggaggccaaggcaggaggatcaattgaggacaggagttcgaggctgtagtgtgctataatcatgcctataaatagacactgcactccaagtgggcaacatagcaagaccctgtctcttaaaaaaaaatctggattcctaacattcatccttagacattttgattacgtaggtccaggataggccctaaaacatacatttctaacaagtatcttcaagtggttctgatacaggcagtccaggagcactcctaaaaraaaaatactcatttatggattctgtctttggtgatatacatggaatatccttctttgtttactccagaattaaataaatatttactattttctcctatattctttttggtccttttaaaaatatttaatacacctaaaattcacttattatgtggttgactaatggaacaccatttggtgaaaaatcacacctttcctctctaatttaaaaacatctcctttaccaccaggaactagtgctatcagttccattgctttaccatatgatttaatgactggaaagaaaaatctcctcattac

SEQ ID NO: 113176 - DNA, 601 bp, Human
ttaataaataagggttcacgcctgtaatcccagcactttgggaggccaaggtgggtagatcacttgaacccaggagttcaagaccagcctaggcaacatggtgaaacagtgtctctacaaaaaatacaaaaattagcagggtgtggtggtgcgcacgcctatggtcccagctactcgggaggctgaggtgggaggatcacttgagccctgcagacagaggttgcagtgagccgaagtcacaccactgcactctagcctgggcaatacggcaagaccttacctcataaaaaaaaaaaaaaaacaactagctgttactatcatcattaatagccaccatactttaaattctgacagcagttctcaaatttaagtctgcataaaagccacctaatacttttcttttgaaaatctagattcctggcaaaagtgcagtggtgcacgtagtcccagcaactcaggaggccaaggcaggaggatcaattgaggacaggagttcgaggctgtagtgtgctataatcatgcctataaatagacactgcactccaagtgggcaacatagcaagaccctgtctcttaaaaaaaaatctggattcctaacatt

SEQ ID NO: 113177 - DNA, 601 bp, Human
atccagagacataattagattcacttttaagactttaggtaagaatattttatagatggtactgtgtattttctttcataccacatcagcaagcacataatgtttggctgtcccacttttagtggtactaacataagtgggttcaagtggtggctgctcatttcttctgttataaagttttccattttgtattttacttaatgattttactgaccattgatgattgttgtttccaggttgtttttttgttaccaagggaagctgtggtgaaattcctttcacataactctttatgtccatytctgactacttccttaaaataagttcgtagtcttgatgagtcaagagaaacacttttaaggatcttgagaaataccaccatgttctctctccacatagccctctgtagagactataccaattaacactcaaaagtgtatgaatgcacccattttatccaatccttgacactaacagacattataatttttttttccaagaaggaaaagtttattgagtcagccacagaggagcagagaaacagacgcagggaggttctctgtgcagcagggtatgcaacaaacatttacctgatgaagag

SEQ ID NO: 113178 - DNA, 601 bp, Human
ttttagagcaagtcacagacatgtcatgtcactaaaaatgtttcaatacacatctctaataaggactctgggtttcatatgattaccatgcaataattataccaaaagaagagttataaattccttaacgtcatctagaacctagtttgtttttagatttcctcaattaccttaaaaaaaaatttttttttttgagatggagtctcgctctgtcacccaggctggagtgcagtggcgcaatctcggctcactgcaagctccacctcccgggttcatgctattctcctgcctcagcctcccragtagctgggactacaggcgtccgccaccacgcccagctaattttttgtatttttttattagaaacagggtttcaccatgttagtcaggatggtcttgatctcctgacctcgtgatccacccgcctcggcctcccaaagtactgggataaagttaatgtttcaaaccaggatccaacaatacctacaaactgcattttttgttaggtatctcaagtgtccctgattcgctcttttaaatgcaatcaatatgatggaaaagcctagccactgttctatgaaatgttccacattctggattt

SEQ ID NO: 113179 - DNA, 601 bp, Human
ccatattgtccaaagcaatctgcagattcaaccccattcctgtcaaattaccaacagcatttttctttcacagaagaaaaaaaactattataaaatatggaaccaaaaaaagaacccaaatagacacagcaatcctaagcaaaaaggacaaagctgaaggcatcatattacaaccaaccgcaaactatgctaataaggctacagtaaccaaaagagcatggtactcctacaaaaaaaagacacacagacaaatgcaacagaatagagaacccagaaataaagccacatacctacaactaaycgatcttcaacaaagtcacaaaaataagcaatgggaaaagggctccctattcgataaagtgtgctaggaaaactggctaaccatatgcagaagaattaaactggacccctatttatcaccatatacaaaaaaaaagctcaagatggcttaaagacttaaatgtaagactgcaaactataaaaatcctggaagaaaacctaggaaatagccttatggacagcagcctaggcatagaatttatgtctaagtcctcaaaaacaaaaattgacaagtgggacataattaagctaaagagcttct

SEQ ID NO: 113180 - DNA, 601 bp, Human
cttttctcaccacttaagacgtgcctgtttccccttccaccatgattgtaagttttctgaggcctccccaggcatgcacaactgtgagtccattaaatttccttccttcataaattacccattctcgagtagtatctttatgtgagaagagacgaatataactagtttgaaaatagtaattaaaacatgacaatattgctgactctcctacagtcttcaaaatgaagcttttcctgttatttctatttaattaaaggatatcctaatatttaagctgtatcttttttttttttttttttttagagacaggatctcattctgtcaaccaggctggagttcagtagcatgatcaggttccacagccttgacctcctgggctcaagtgatcctcccacctcaacctccagagtagctggaactacaggctcacaccaccatccccagctaatttttttctatggtaaagacagggtctcattatgttgctcaggctggtctcaaactcatgggatcaagcaatcctctcacttcagcctccccaagtctgggattacaggcatgagccacaatgcccagcctgtatctttctaatattaccttc

SEQ ID NO: 113181 - DNA, 601 bp, Human; identical to SEQ ID NO: 28682

SEQ ID NO: 113182 - DNA, 601 bp, Human; identical to SEQ ID NO: 28683

SEQ ID NO: 113183 - DNA, 601 bp, Human; identical to SEQ ID NO: 28684

SEQ ID NO: 113184 - DNA, 601 bp, Human
aacaatacttaaaaagataacagccaaaaattgtctaaaacaaattaggaaaaaaactccaactatatatttaagaattcctacatacaccacgcaggataaatacaaagaaaaccacaagtagaaatatcatggtaaaactgctgaaaatcaaaaacaataagaaattaccttcaaagaagcaacaaggtagctaacttctcaacagaaataaattctggaatgaaacactcaaagtgctagaaaaaaaataactgtcaagcaccctgatctttttttttttttttttttttttttttttgagatggagtctcactctgtcgaccaggctggagtgcagtggcgcgatctcagctcactgcaacctccgcctcccgggttcaagccattctcctgcctcagcctcccaagtagccgggattacaggcgcctgccactaggccgagctaatttttttgtatttttagtagagacggggtttcaccatgttgtccaggctggtctcgaactcctgacctcgtgattcgcccgcctcagtgctgggatttcaggcgtgagccactgcgcccagctaaccaccctgatttttatactcagaaaa

SEQ ID NO: 113185 - DNA, 601 bp, Human
ttgacttttggagtgttctcagtcaactgataaggatggctcaccaaacctagattacttgtcccaaaaatacagtttatgctgaataaatttttttcctcctggaatcctggaattttgctacatgctaagcacagagtgcctacatgaccggccatcaataaaaatcttgagcagtgagagtgtaatgagcttccatggacagaaacatcacaaatacattgctgcaggaagagtgagctcaggatgacccctcatgagaaaaagagagcacaagaaagcctacacattaactcccccsagactctacttgtctttgtctcttatgattgagctgtatatccttagtacgttgctgtataaatctgagttatgagtacaaccatatgctgagtcctgagttattctaataaatctccagaagtgagggtggtacagggaacccctaacacaactcagtctccactttctcgccttccattagcttcttaaaattaccagtctgacccagccctactgcaccacagaaaataatcctcagataaatactttccgtccttattgaattttgtcctctccatgaaatcatactgttaaattg

SEQ ID NO: 113186 - DNA, 601 bp, Human
cctaatagctattttacatgacattacaagataacatcctactccagccaaagttgatgggagcacgaataacccctaactcaatctgaagccatcagattctctctcctggtaatttggaattgggattccgagacaagcagttagtctctgcatgtggctaaaattataacaggttaccttagaagcttcgagacagttaatgatctcccaggaaaatcaggaatcaggaagagccaatcttgagagacagagacaatgagaagactgatacaaataaagggacaaaagcagagatgcratattaagaagaaagagcagaaactaggttctaagtaactttccaggtccaggttccaatattgtcctaaaatctggcacattccagtgcctgagttccactaatttactcatgaataagtacccttaatatttaagccagtttaagttattttctgctgtttacagtcagagagtctaaactagtaaaaccctctatcctttgtgtattgaaagatattgccctacattcatcaaaaaaagttggtctttctgactattctaacctctatcattatattggtaacatcaacatccattg

SEQ ID NO: 113187 - DNA, 601 bp, Human
tttgactcaactgtctggttattgcattgattgtcttgaacgaaatctgacacctttaaagtattctattgcaaacatactaacttcaaggagccaagaagatatgtcaatgcttgtattaagtgttgtaaaataagagcaaattttatttaaaaatttaaaaatatttattacccttcccagccacagaattgatgacacttctgctgtacctctcctaactttggttgtgttgttacttgagttacacctttaacagtaacaccttccaagaaaatagcgccctttaaaaaaaaaatawgaaaaataagggaaagaaaaatattttattagagttcaaattcatttacaaagaagagactgagagataaattagtttgttctcacaaatcttagcaagtcaatatatctaacagaaacggtctgctgtataaactcccctaagattgtacactagttttcctaaatccagcacatggttttcttcaatatacgtatgtactctataggcacttctcaaatcataacagtaataataatttatctaccatttattgagatccaagcagaatgtctggcatcttgcaaacattctctctaa

SEQ ID NO: 113188 - DNA, 601 bp, Human; identical to SEQ ID NO: 28685

SEQ ID NO: 113189 - DNA, 601 bp, Human
tttttaatgttattttctgaattttgtcaaatgaatatgtcttacctataaaataccctaaaaaagctaaaaaatgctaaactgaggggaaaaattgtttccaacagaggcagacaattaaaatgaatgaaaatatttttaaatattcccaataaaaatcaaatataataaaatacttaaacattctagaaagcatataatgttaaaatatcattatagtcacctaataatgaaaataggttgtatctgctccacttcttttctccatatatatcttttaaggtaactacatgttaaatgkagatggagatggcatgatacaaagagtataactgccacttaagactttccaaaactcataaaaattaaatagaatctgtcatcttcaaaataacacttaaaagctaatatatatgtactgccagttattccaaaacattttattatgaaatagttaatgacttctatgttaatatctgttaaaataattatttcaacttgctaaatgaatacatacatatagcaaaactgtaatagatgcaaaaaaatatggattacaaaagaaaaaaataaaatgttgctgaggaagaataaaatttct

SEQ ID NO: 113190 - DNA, 601 bp, Human
accaactaaatcaagagatcaaagttaacatcatcactaataggagaattcaacattatgtgcctcctgaaatgacatgaagaatattactactgtgatgttcttgcaagcatgcccaacttgaatcatgaggaaacatcaaacaaactcaatctgagagacaagctacaagataactggccaatgctattcaaaagtgtcaaagttatgaaagaaagcctaaagaattattgcagaggccgggcgcggtggctcacacctgtaatcccagcactttgggaggccgaggcaggcggatcaygacgtcaggagatcgagaccatcctggctaacacgttgaaactccgtctctactaaaaatacaaaaaaattagcctggcgaggtggtgggcgcctgtagtcccagctgctcgggaggctgaggcaggagaatggcgtgaacccagcgggcggagcctgcagtaagcagagatcgcgccactgtactccagcctgggcaacagcgagactccgtctcaaaaaaaaaaagaattattgcagaaaaaagaagagacatggcaacctaatgaaacacgtgatcctggactggatcctggaccag

SEQ ID NO: 113191 - DNA, 601 bp, Human
ttatccacaaataatttattattagttaaatagttatctgcaagttctatgagatagggacagtatccacactgctcactgctgtttccccagaacctagcacagtacctgacacacagaggaatccaagaaacagaaactataatttagtgtattactaaagtcttagtggtggggaatgtaacaagaaataattttcaaagctcaggaaaaagttaaataaaatttaaaaattcaaaaattcaacaagttaaaatataaccaagtgctacggtttgaaaattcatggtgaaacttaatytccagtgcaacagtactgagagatggaacctttaggaggtgattaggccacaagggctctgccctcatgcatgggattagtgatcttacaaaagagctggtggtaactagccaggcccttttgctcttccaccatttgagcacaaagcattcgccccttcagccatgggaagatgcagcaacaaggcatcattttggaaacaaagagcaaccttcaccaaatactgaacctgctagcatcttgattctgaacttcctagcctccagaactatgaaaaataaatttctgttgtttataaat

SEQ ID NO: 113192 - DNA, 601 bp, Human
ttaagggacctttttatcctttagtaaatcctaaagatgtgactactaaccaatgggtatttcaaagatttggttttaaaatgttagattgttttgcctttgcttaattttcttcttgtgcaataactataccacaccctaaaagaattctgagtgaactctgggaaatcaatgttggttctcatgtaataatggttttcaaaacagtcttcagttataacaacaataactaatatgcattgagtgctgtataataagcattttatgtgggtctccaccaactaacagagaaattctcagrtatgttcttaactcaatagctggctaaatactactttgaattgggtcactgatttttaaattttgttccatgaggcactacagatagcggctcccaaatcaggttaaaaatcacaagtaatcggggtgcttttcaaaaatgcattttctcagaaccaatccaggcttaatgaatttgaatctctgaatttttttttaataaaagtttcctatgatggtagcgcaactggaaatgctgccctaaaaagttccatggtaacctcagacgccacaccagaatgcaaccccatatgctttcctc

SEQ ID NO: 113193 - DNA, 601 bp, Human
aattcaatctctttatcctgtattccttgtttctcatttgtttgggtccagtagcccagctctatataggggaaaaaatgtttgaaaatattaacgaaaaattcatttgttttaatctttcaaagcttcacatgtttgctgcccccagaacctggccaactgaaaattctgagttagggttgcacctatgtttgcaatcaaagttttatctgtatctgctcagctctaagagttctctagcagattttggtaataggtaataaatttggttggtttttatttttaaataccatttcaaagwcagtatctctattaactagtagtaactctcatacttaggatttgattaaagaaactgctatttaagggacctttttatcctttagtaaatcctaaagatgtgactactaaccaatgggtatttcaaagatttggttttaaaatgttagattgttttgcctttgcttaattttcttcttgtgcaataactataccacaccctaaaagaattctgagtgaactctgggaaatcaatgttggttctcatgtaataatggttttcaaaacagtcttcagttataacaacaataactaatatgca

SEQ ID NO: 113194 - DNA, 601 bp, Human
tgtctcaaaaaacaatcatcatcatcatcatatagtttagttctaattacctgctaagcctatcatagctagcacaatctctggcatatggtaaatgttcaataaatatttgttaactacatgaatgaacaaagagacaaattcaatctctttatcctgtattccttgtttctcatttgtttgggtccagtagcccagctctatataggggaaaaaatgtttgaaaatattaacgaaaaattcatttgttttaatctttcaaagcttcacatgtttgctgcccccagaacctggccaactraaaattctgagttagggttgcacctatgtttgcaatcaaagttttatctgtatctgctcagctctaagagttctctagcagattttggtaataggtaataaatttggttggtttttatttttaaataccatttcaaagacagtatctctattaactagtagtaactctcatacttaggatttgattaaagaaactgctatttaagggacctttttatcctttagtaaatcctaaagatgtgactactaaccaatgggtatttcaaagatttggttttaaaatgttagattgttttgcctt

SEQ ID NO: 113195 - DNA, 601 bp, Human
aggctgaggtgggaggtcgaggctgcagtgaggcatgagtgtgccactccactccagcctaggcaaaacagtgagaccctgtctcaaaaaacaatcatcatcatcatcatatagtttagttctaattacctgctaagcctatcatagctagcacaatctctggcatatggtaaatgttcaataaatatttgttaactacatgaatgaacaaagagacaaattcaatctctttatcctgtattccttgtttctcatttgtttgggtccagtagcccagctctatataggggaaaaaatgttkgaaaatattaacgaaaaattcatttgttttaatctttcaaagcttcacatgtttgctgcccccagaacctggccaactgaaaattctgagttagggttgcacctatgtttgcaatcaaagttttatctgtatctgctcagctctaagagttctctagcagattttggtaataggtaataaatttggttggtttttatttttaaataccatttcaaagacagtatctctattaactagtagtaactctcatacttaggatttgattaaagaaactgctatttaagggacctttttatcctt

SEQ ID NO: 113196 - DNA, 601 bp, Human
gaaagaaagtaaaagaaactgaaccaaatgggtagtgagggaagagcacctaagcacaactgcttatcataaagcaaaggtcagaaattgacaaacccagcccacattcatggagcttccaagcagcttctctgcctcgtttcaaatgcacagccaaccaaggatcaccacacatttgaagaaactagaaacataaagaagaaagatgattcaaggaagagaaagataactttaaatatgcttttaactagtattctcatagagattcaagaagctatcacaaccataaaccaagaacaakttgtcatgaaaaggtacaggcagagaacaagaatgtatgtactattgacaaaagcataattaccagaataagtaattcaacaaaaagaaaggaagaaaataagagaacctggtacttggcacataacagacacttaaaaaattgtggaatgaatatgtttttcatttagtcaatgaaacaaaaaatatatatagacagagggaaaagtctaaaagcatacacaccaaaatgtaagcagcaaccatctctaactggtgaaattacatatgtttttcgtgtttgtcctgttccttatcttca

SEQ ID NO: 113197 - DNA, 601 bp, Human
aagttatttagaataatattatcatggtattcttataaaagcaaaactttcaaaacaagctaaatttacaaccacacagaaattttcaaagtatgatgcacttatacaatggaatgttccatacaatagaatgattcttcccaagacactactgaaataatagcagagtttttttttttttaagtataaagctatatggtcctgaaaaatatgtcctgaaagtccacaaaattatttgacactcttaacctcaagagatggagcttaattcccctcctttaagtttgggctagacttataygttacaacaaatagaatatggcagaagtggattgtatgtcacctcttgggctagattagattagattataaacagactactacttttatcttgggtgttctcttagatcatttgctataagtaaagctggctgccatatggtgaggacactcaggcagctgtgagaacccactcggaaccccagagctggtatgaagattattttaaccagaagacatttgagagtcaacaaatgcagaaaggtggctgttcagagctttccttatctgactaaaagcagaaacttccgggaattaagct

SEQ ID NO: 113198 - DNA, 601 bp, Human
cacattttatattatgcaacctttgaaattcactattggctagactcattgaatgaatgctaaaagtaagctactttgagtaaaattttcactaagtcccaaaaaaggttcacctaacagtcttttaattatactgaaaatgggaaataaagtgttgggaaggatgactgggagagaattactatagggttttcctgtgcctccggctgggaaagccccttaggcttagctttctgtgccatcacaacctttttcttcctccagtcacataagtaggtgaagtgcttcctcttccactgcyacagcaactattcctcagagtgttcatttccctgccttctgtatcactatggaaaatagtctcttaccacactctttacctgatttccaaaaaaaaaaaaacagctcttttaaggcctcaaaggctatggggctaaccaactgactcagcaaatcaggtggtcctaaacttcaagaagattgagataaaggatctcccattttaatagcctcctaagaacaattcaaggagtgggagttgacatcatagtcaaagtttaaatcagaagcttatggcttagcaatcattaaaactctgaca

SEQ ID NO: 113199 - DNA, 601 bp, Human
ttttcttttaaatcaagtagagtatcaatcaaaagaaaatattttctatgcacacatgtgtataaacagatttaaaagactaaggaagaaaaagctttagaggacgggatttacaaaaggatagcttctgcatctgcagaaacaccagagaaattatttagcacttggtatttagggattcttctgcacacataaattttcaggctttggaacacaagttcctgagctatgatttttagtttgaactccagtcattccaaatcatatgttcttttgttatgcgatactaacaaaaagtaakgagctatttcatgtaaggaatgtggaaatatttccacatcactccaaagtccctgaaagcagccagattctttaaaaagaagcaactacctcacaaactgtcagatactgccttagtatataactatgatgcaatataatttcttattaattaggaaattatctcaactgcaaatttaatattcagaattatcaataggtatttgtattatattcattcattcccattaaaaggcaaaatttaattcagtatacgtttcccagatagaaaatgctaaagtatataaaccaaaggtatatg

SEQ ID NO: 113200 - DNA, 601 bp, Human; identical to SEQ ID NO: 28686

SEQ ID NO: 113201 - DNA, 601 bp, Human; identical to SEQ ID NO: 28687

SEQ ID NO: 113202 - DNA, 601 bp, Human; identical to SEQ ID NO: 28688

SEQ ID NO: 113203 - DNA, 601 bp, Human; identical to SEQ ID NO: 28689

SEQ ID NO: 113204 - DNA, 601 bp, Human; identical to SEQ ID NO: 28690

SEQ ID NO: 113205 - DNA, 601 bp, Human; identical to SEQ ID NO: 28691

SEQ ID NO: 113206 - DNA, 601 bp, Human; identical to SEQ ID NO: 28692

SEQ ID NO: 113207 - DNA, 601 bp, Human; identical to SEQ ID NO: 28693

SEQ ID NO: 113208 - DNA, 601 bp, Human
gagttggagaccagcctaggcaacacagggaaacctcgtctctagaaaaaaatacaaaaaaattagctggacatggtagtatgcgcctgtagtcccagctactcggtaggctgaggtgggaggatcacttgaccccaggaggtcaaggctgtggtgagccgagatggcaccattgcactccaggctgagcaagagtgagaccctgcctcaaaacaaaacaaaacaaaacaaaacaaaaaactcatactcaccttcccattacaatacactgccttgcctacagatcaaaaaaaaaaaaaaagagtgctggcaatgggaaaatgagctctctcatctgctggagacaaaattgctttatttggaaaggaatttggcagtagttactaacattactcataatctttaaaccaaaaattctacttaccctgaagaaatatccacccatataaacaaaaatgttcactgaaacagtgttggtaatagcaaaggactagaagcaatctaaaaacccatcaattacaacataatgtatagtacacctttactatcattaccatgcagcacttaacaaataacatggcaaatctctatacactgacat

SEQ ID NO: 113209 - DNA, 601 bp, Human
atctactaaaatgcctatgaaaaacatcgtataaaaacattaaacttcagagcaggacaaaaagtcagtaactaccagaattttaaggtgatagatctgtaccagaaagttttagaaagtattataattagccaggcacagtggtatacgcctgcagctcagctacttgggacactgaggtgaaagaattgcttgagcccatgagtttgagaccagcctgggcaatacagcaagactctgtctctattaaaaacacacacacacacacacacacacacacacacacacacacacacacacatatatatataagatttacatatatatatatatataagatttacatgtatatataagatttacatatatatatatgatttactactccaaaggaagttatctgggacaataaatctttaggttcaccatatgaaagtatgaattctctttagtatgcattatatgattttcttaaatttccctctgaaatgacatatgaatgagatttatatatatatataattgatgacactttataataaattccaaaaagtagaaaagtgcagataatattctctcatgtcactataataaaaatttt

SEQ ID NO: 113210 - DNA, 601 bp, Human
gagaaagcgggaaagatcttaaatcaacaccctaacatcacaattaaaagaaacagagaagtaagagcaaacaaattcaaaagctagcagaagacaagaagtaactaagaccagagcagaactgaaggagagagagagagacacaaaaaaaaaacccttcaaaaaaagtcagtgaatccaggagctggttttttgaaaatattaacaaaatagatagaccactagccagactaataaagaagaaaagtgagaagaatcaaatagacacaataaaaaaatgaaaaaggagatatcaccaccratcccacagaaatacaaactaccatcagagaatactataaacacctctatgcaaataaactagaaaatctagaagaaatggataaattcctcgacacatacactctcccaagactaaaccaggaagaagtcaaatccctgaatagaccaataataagttctgaaactgaggcagtaattaatagcctaccaaccaaaaacagcccaggaccggacagattcacagctgaattctaccaaaggtacaaagaggagctggtaccattccttctgaaactattccaaacaacagaaaaagagg

SEQ ID NO: 113211 - DNA, 601 bp, Human
gtgctggaactaaatacctccatcatttcaacaatgaccaacagaagcttctatgcaagtggaaagggcagacgctattatttaactgccatatttcactttaaaattctaaaaaacctactaagtcagacaatgccaaagtagtggctcacattgttgagttacacactttaaaaaaaaaagtattcagaggcctggcaagatggccaaataggtacagctccagtctgcagctcccagcgagatcaatgcagaaggcggtgatttctgcatttctaactgaagtacctggctcatctcrttgggattggttagacagtgggtgcagcccatagagggtgagctgaagcagggtggggcatcacctcacctgggaagcacaaggggtttgggcactctctcccctagccaagggaagccatgacggactgtgccatgagggacagtgcactcaggcccagatactacgctcttcccacagtctttgcaacctgcagaccggtagattccctcggatgcctacgccaccagggccctgggtttcaagcacaaaactaggtggccgtttgggcagacaccgagctagctgcaggagttttat

SEQ ID NO: 113212 - DNA, 601 bp, Human
tcttatagaaagttccgttggacaggtctgctttgaaagaaaacacatataaacaagacgccaacaaaaaggaccctgcaataaattgaaaacacgtttgttttctttttttttttttttttctttttggagacgtcttactctgtcattcaggctggaatgcagtggtgcgatctcggctcactgcaacctgggtccaagagattctcctacctctgcctccagagtagctgggattataggcgtccaccaccacgcccagctaatttttgtatttttagtaaagacggggtttcaccaygttggccaggctggtctcaaactcctgacctcaagtgatcctcccacctcggcctcccaaagagctgggattacaggtgtgagccaccacacccagccttctgtctgttttctaaaaaacatgtaagtaaaaatgaaaggaaaagaataaccaaaaattatttacaaaatgccaaaattcttaagtgaaaatgcttaaaggaagtctgtcagttatcatagagcatacactgaagggtacactgagaactaagaatataaattaataattgacacaatatcccatcacatttgccatctg

SEQ ID NO: 113213 - DNA, 601 bp, Human
tatattaaaactgtgctattcaatggccacatgtggctactaaaatttaaattaaatgacattaaaaatctagttccctcagctgcactagccacaattcaagcactactcaataaccatgtttggctaggaggcactgtagtacatagcaaagattacagaacattttcatcttatagaaagttccgttggacaggtctgctttgaaagaaaacacatataaacaagacgccaacaaaaaggaccctgcaataaattgaaaacacgtttgttttctttttttttttttttttctttttgragacgtcttactctgtcattcaggctggaatgcagtggtgcgatctcggctcactgcaacctgggtccaagagattctcctacctctgcctccagagtagctgggattataggcgtccaccaccacgcccagctaatttttgtatttttagtaaagacggggtttcaccacgttggccaggctggtctcaaactcctgacctcaagtgatcctcccacctcggcctcccaaagagctgggattacaggtgtgagccaccacacccagccttctgtctgttttctaaaaaacatgtaagta

SEQ ID NO: 113214 - DNA, 601 bp, Human
tctgaaaaaaatgcattgttgggtgattctgtcattgtgtaaacatcaccgactgctcttacacaaacctagatggtccagccaactatacactaggctatacaatatacagcctattgctcctaggctacaaacctgtacagcatgtaactatactctgtactgaataccgtaggcaactctaacacactggtaagtatttatgtataaaagataaaaaatggtacacctgtatagggcaactttgttataaccttatgggaccaccattatatatgcagtccaaagttgaccaaaacaytgttaagtggcacacaactatatattaaaactgtgctattcaatggccacatgtggctactaaaatttaaattaaatgacattaaaaatctagttccctcagctgcactagccacaattcaagcactactcaataaccatgtttggctaggaggcactgtagtacatagcaaagattacagaacattttcatcttatagaaagttccgttggacaggtctgctttgaaagaaaacacatataaacaagacgccaacaaaaaggaccctgcaataaattgaaaacacgtttgttttctttt

SEQ ID NO: 113215 - DNA, 601 bp, Human
gaaatacaagaaataaaaacactagtgaacagtaactgtaaaagaaaatcatagaaaattagcagcaaggtgggcaggaactagatcatacaggtatacatcaagataagttttattttgctttaaatgtaaaaagaatctatgatataggcacaaaaatcctacataccagcaaattaaatttaaaaatacagttatgcatcatttaacaacaggagtgtcttctgaaaaaaatgcattgttgggtgattctgtcattgtgtaaacatcaccgactgctcttacacaaacctagatggtmcagccaactatacactaggctatacaatatacagcctattgctcctaggctacaaacctgtacagcatgtaactatactctgtactgaataccgtaggcaactctaacacactggtaagtatttatgtataaaagataaaaaatggtacacctgtatagggcaactttgttataaccttatgggaccaccattatatatgcagtccaaagttgaccaaaacactgttaagtggcacacaactatatattaaaactgtgctattcaatggccacatgtggctactaaaatttaaattaaat

SEQ ID NO: 113216 - DNA, 601 bp, Human
gaaaaaaatgtgctaattaaattttagaaagcatatgttttacattctcaaatttctgaaaaatatgctatgctaaaaatcagatgtgtgaaatatagggcattttgaggaactatccaataatacaaaaagaagaacaaagaaaagtataaaagataaaatatatagaagcacatgttaagcaaaatttttaaggaaaattaaatattatgcaaacctatattaatatttctaagcaaaatacgattaagcaaaattcaaagtaaacaaaagcaaaataaaagaaattaatatttctgtrtaaaatatgcctaagcaaactgaaagaaaaaatggtgtcaactgatttcgataataaaattcataatgaagaaatgagtaataaatgtttatgtgctaaaattttaatatattagaaaaaagacaaaatgtaatagcactgaaacattttaatattcctctcttacctatgacaaaactataacataaaaacattcacagaaatgtttataactgatgatatattaggccactaaaaaaaaaaaaccagcaaattcctagaaatcataccaactacattccctagtcaccaaacaaacaa

SEQ ID NO: 113217 - DNA, 601 bp, Human
gaacaggacaaagatattctctgtcagcactcctttcaaaatcatactgaagttctagctaataaagtaagacaagtaaaaggtataaatattgggaaggtagaaataaaattgtcttttttcacaaatgatatgattgcctatgcagaaagtatgaaaagaataaacaaaaactcctggaactaataagcaattatagccaggtttcaggacacaaatatataaaactcaatcactttcccacataccagcaatggtatacagaaaaaatatcaatcactttcctatataccaggtgaawttcaaaatttaaaatacaataacatttacattagcaccctccaaaaatgaaatacttagggataacataacaactacatataaaaatctgtattagaaaaactacagaattccaacgaaagaaaccaaagaagaactaaataaatggagagacagcacatgttcatagataggaagactcaatattgtcaagatgtcagtcttcccaatttgatctacagattcaacacaatcccaaccaaaatcccagaaagttatgttctaaatattgtcaaactgattttaaaggttgtatggagag

SEQ ID NO: 113218 - DNA, 601 bp, Human
aggcatttctatctacctgctacagctgcggatctttatttcacctttcaaaaattatttcacctactaggtaggtgaaacatttcacgaacattctcaaaaccctatctccacacatgcctctctggaactacaattctcagcactgcaatatgactagatatgagattgtacagaatcatatgtggaacagtgttttagacttggaaaaccaagcaaagagtattaagaatttaagccctgaaatgccacaagagtggtgctttctgaggactgaacttatcacaagaaaacctatagrctcctaccaattacccagtgaaaaagtctaattttaacaatatattactgatgatgatgatatgatgatgatgatgatggatgacttatctgaggctagcagttccacactattaaataaagaaagcaaaattttaaaacattggccagttacccagccctccatgtttggctaatatgagaggaagaatcaaaaaacaatcaaatattttctcattaatgtcagaacaggacaaagatattctctgtcagcactcctttcaaaatcatactgaagttctagctaataaagtaagacaag

SEQ ID NO: 113219 - DNA, 601 bp, Human
acctcattaatctctaccaacagacagctgctaaattattatttaaaagtactccacatcaaacgtgatcactctcttacaatatatgtctcccatccagcaatgaaagaggcatttctatctacctgctacagctgcggatctttatttcacctttcaaaaattatttcacctactaggtaggtgaaacatttcacgaacattctcaaaaccctatctccacacatgcctctctggaactacaattctcagcactgcaatatgactagatatgagattgtacagaatcatatgtggaacrgtgttttagacttggaaaaccaagcaaagagtattaagaatttaagccctgaaatgccacaagagtggtgctttctgaggactgaacttatcacaagaaaacctataggctcctaccaattacccagtgaaaaagtctaattttaacaatatattactgatgatgatgatatgatgatgatgatgatggatgacttatctgaggctagcagttccacactattaaataaagaaagcaaaattttaaaacattggccagttacccagccctccatgtttggctaatatgagaggaagaatc

SEQ ID NO: 113220 - DNA, 601 bp, Human
gagtatgataaacccagtttaaaatgttttgtaattgtgctgcaaaagccataatcaacaagagaaaaataaatttgtgatacatactgagaacagttttaataaaattaacttctcttaaaatcagcaataaatgactgcaaaatttaatcattatgttttttctatacagagctatatttagttagccaaaaccatttatgtgaccatacatttatgtcataataaataaaaagacttctgttaaacatatttgtttgctgataggtaaaattatatccacatcacagtttcaataaarataataatactagtcctttaatatcttcaacctactttctttcagttcataattcaataaacagcaaattattagaaaatttaattttgaaatatacagttattataacatctatgagacctagaaaaaattatttaatgtcaagaatagtattcttcataacattaagtattccccaaaattatataaaacttaaatatattttttggtagataaaagataaagtcatttttcctgaaatgatgtcttagcacctaactgaactatagaaaagagaaggtcattaagaggaaggtttca

SEQ ID NO: 113221 - DNA, 601 bp, Human
aaaaattagccaggcatagtggtacatgcctgtaatcccagctactcaggagagaagaatcgcttgaacccgggaggcagaggttgcagtgagccaagatcctgccattgcactccagtctgggcaaccagagtgaaactccgactcatagaaaaaaagaaaaaagtttatttcgtccatcaggaaccaaatcaagtcaggctaaagatgaatgcacagttactgataaaataaggctatgaaattaactaccaattcattacgagtatgataaacccagtttaaaatgttttgtaattgkgctgcaaaagccataatcaacaagagaaaaataaatttgtgatacatactgagaacagttttaataaaattaacttctcttaaaatcagcaataaatgactgcaaaatttaatcattatgttttttctatacagagctatatttagttagccaaaaccatttatgtgaccatacatttatgtcataataaataaaaagacttctgttaaacatatttgtttgctgataggtaaaattatatccacatcacagtttcaataaaaataataatactagtcctttaatatcttcaacctactt

SEQ ID NO: 113222 - DNA, 601 bp, Human
ccttcaccatccaagtctattcacatcattttttttttttttttttttttttttttgagacggagtctcgctgtgtctcccaggttggagtgcagtggcgccatctcggctcactgcaagctccgcctcccgggttcatgccattctcctgcctcagcctcccaagtagctgggactacaggcgcccgccaacacgcccagctaattttttgtacttttagtagaaacggggtttcaccgtgttagccaagatggtctcgatctcctgacctcgtgatccgcccgtctcggcctcccaaartgctaggattacaggcgtgagccaccgcgcccggcctattcacatcattttaaaatcattcttctatacagatgtaagatgagtcaacatctaacagtttattttcttttaaccatctgtaatttccatcaggttgagcattatgtgcaattgttcctaagtattcttaaacacctaaaaatacagccaaatatactatcattttttgaaagtcagcatattagaaacataagctcaagacattgggttaaccaggagcataatttaagtttactttgggctgggcgcggtggctcatgc

SEQ ID NO: 113223 - DNA, 601 bp, Human
acaaaaaaataagtaaaaaaaaaaaaaaaaaaaaaaaaagtggggggaggtgtagatataaatacactaaatatacacacaacacatacgtgtacacacacacactcatattctccaactatcagaaaactaataaaccactctgaactatatcatgtctcctcaaactaatcagcaaccttaaccctattccttcacgtactttgccaacctctgaacctaaatgataactaacctatcccatgccttcaccatccaagtctattcacatcattttttttttttttttttttttttttttgagacggagtctcgctgtgtctcccaggttggagtgcagtggcgccatctcggctcactgcaagctccgcctcccgggttcatgccattctcctgcctcagcctcccaagtagctgggactacaggcgcccgccaacacgcccagctaattttttgtacttttagtagaaacggggtttcaccgtgttagccaagatggtctcgatctcctgacctcgtgatccgcccgtctcggcctcccaaagtgctaggattacaggcgtgagccaccgcgcccggcctattcacatcattttaaaa

SEQ ID NO: 113224 - DNA, 601 bp, Human
tgtacgtattatgaaaggggtaagattttaaaaaaaagctaaagtcatctctcataagttaataacttcctaataaatcatcctttattacctatatatatctccagtgaagacaacagtaataacgtcctaactgggcatatagagttgcttctaggtgaatttcctttcttcaaactatttctactcactatgctactcactgactttctaaaacaaacaatttgttgtgtgtcatggtcatatctaaaaatatttgaatgcccttcactgtctatagtccaagttgccttagtatagyttttaaagccctttttttcctgggaaaactctcctgaatatgtctataatcaaatcacaatgaaatgctcaccttttctaaaatatttatatactttgatatcattaaacctttgttcatgctatactctgtatccagattgcagctgacaagaaatataagtgagtatttgttttgtggatagaaaagcatgacctatcagtttagaagaatagtaagtacttttgaaatgaatatacgaatacaatggatatttggccataaatacataatgcagtaaaaatacaactaaactgcata

SEQ ID NO: 113225 - DNA, 601 bp, Human
tgagaatactcaatatagtaacttctatctcttgactcttttatgtgctttcataactccccacaaatccaaggtttagttttaaaacccccccaaaaatggaaatttgcactcccctggatactaatctttattggttttcaatcccaaattctaacttctagttcaggttaggattattcaatgcttctgtactctgaatgtccttctaatcagtaaataataatcctacaagtcatccttcttgctcatcacaaagccaacatcattatcttcttttaaaaaagaatgacttgattgycactatttaccaatagtgcctaaacaactatgtcattcaagttagctaatcaaaatataaatcgcttttgcaatactattgttggctctttcattaaccaatattattgcaattaaaaagaggcataataattctggtgaatcctatttgacaagttagaaaatctcaaacaaaatttctctagaaaatataccctcttaattttggttgccgttagtcttatttttaccaaaatcccttcatagatccacaaagaagtagtcaaccacatcctcatggaacaataaaagttcttttcat

SEQ ID NO: 113226 - DNA, 601 bp, Human
aatgaccaggcacaatggctcatacctgtaatcccagcactttgggaggctgaggtgggaggatcacttaaggccaagagattgagaccagcctgggcaacatagtgagaccctgtctctacaaaaaatttaaaaagtagccaggcatggtggcatgcacctaagtcgcagctactcaggaggctgaggcagaaggatcatttgagccccagaggttgcagctgcaatgagtcctgattgcaccactgcactccaacctgggcaacagaattagatatcgcctaacaaaagcaaaaaaaawttttttacccatttttataataaaaaaaattaagaaaaaggttacaaatcaacgacctcaacttccactttaagaaagtaaggagaactgtaaagaatttcataatctcagatataaaaaatagccagttgggctgagatagtgtacacaataaaaacaacttctcccctcctaaggctaagaccggacttcactgaagacggaacagccatagctcactggatggtgaagctgatgaaatgtcccagctgcctttaaagatggaagttgtatcaaagcagtatgtccaaatttagcata

SEQ ID NO: 113227 - DNA, 601 bp, Human
aaagggggtcaattcatcaggagtctgtaacaatcttaaatgtatacacaccttaaaaaaagcttcaaaataaaactgacaaaatagataagaaaaatagtggggaaatcctcaattatacatagagaatttaacactcttctctgagcaaacgactggacaaatagaaaaaaaaatcactagtagtaaagacatcttgaaaagacttacagaacacaagcagacagaaagccagtgaggatatggaagcgtagatcactataaaacaacctgacttaattgacatttataaaaatactcyacccaaaccaggaaaaaatgcttttttttcctaaatgcgtacaacacatttcaaagtatattctctgatcataatgaattaaattagatgtcaatatttggaaagtcatccaatatttgaaaattaaataacacacttctaaataacccaagaataaaagaagaaattaaaagggaaattttaaagtattttaaacagaatgaaaacaaaaacagagtagattaatgtttgagagatgcagctaaagcatatttacagaaaattttgctgcatgaaatacctaattaaaaagaagatcaa

SEQ ID NO: 113228 - DNA, 601 bp, Human
acttatgtaacaaacctgcacatcctgcacatgtaccctgaacttaaaagttgataaaacaaataaataaataaaaataacattgtaaatgatctagacaaaaaagtggaaaacatgcataaacggatatggagtttcagcagagatggaaacaataaaaatgaaacaattgaaaatgcagaaataaaaacacacaacatcagagaaaaagaatgttaatcagtgggaatgataatcaatgagattatccacagactggacacagaagagaaaagtcactaaacttaaagaagaaacgtaygtggcactttttccaactgaaatacaaaaagaaaaaaagagggaaaaaagaaacagtgctgagaatcaaagagctgggagactacagccaaagacagaacatttgtacagctggaatgcgaaaacaaaaagaaagatacaaggaagcaaagaaaccaactgagagaaataatgcctccaattgctacaaaattaattaaacacataaacacaaacacacaccccaatggactccaagaggacaggaagaaagatttaagaaaaacaaaaaaaaaaatgtaggtttatcatagtcaaaacc

SEQ ID NO: 113229 - DNA, 601 bp, Human
tacaggggagcagagcctactgaaagctaaacgtgaaacagaaacaccaggagaaaacccttttatactctaggcattacaataaatacaagtaacagcagccaactgctgagaaaatataaattctttggagcactgaagatgtaattatatagcaacacatagaacaggctgattcaaccactacccctccccacccacaaatgaagcctattaacaaactaaaagaagtatgcctgttaccaagcataaagatacttacctcagtctcttttgttcatataggaaagaaaaatccacgaaagacgtctaatttaaaaattctgtctcacacacacacatacacaaaggaaaaataaatggcctatattcaaagataaggcagtcaacagaagcagacaaagagagggtctatattttggaattatcaaagactttaaaaataacatttacaaaaaacaacagatgctggcaacgttgtcgagaaaaaggaacacgctttttttttttttttttgagatggagtctcactctgtcgcccaggctggagtgcagtggcacagtctcggctcactgcaacctctgcttcccgggttcaaga

SEQ ID NO: 113230 - DNA, 601 bp, Human
aagctggagacagacttggaccaatgatattatattgataaaaagcagaaagacttggtcctgacaaaatatccctatgcaaggcaaaacttcactggcaagagggagagggaagacccactgaggaaaaccccatgcctgcgattcaggtgctcaggttctgcttaatactaaggctggagaagaaaaactaagaaaactccacagtcttcacaagtctggcactgagcggcaagaaacagttgtttacatatggggaaaagtactagaagtatgaaaatagaacactctgtggtacagrggagcagagcctactgaaagctaaacgtgaaacagaaacaccaggagaaaacccttttatactctaggcattacaataaatacaagtaacagcagccaactgctgagaaaatataaattctttggagcactgaagatgtaattatatagcaacacatagaacaggctgattcaaccactacccctccccacccacaaatgaagcctattaacaaactaaaagaagtatgcctgttaccaagcataaagatacttacctcagtctcttttgttcatataggaaagaaaaatccacgaaaga

SEQ ID NO: 113231 - DNA, 601 bp, Human
atgtcttctttggtagagaaaaggaagaggaagtggcagccataagtgagtacaaagaaaacaacaactgaccaattcttaaaaactaagtctgggcgagtggaacagtttagaatccctggaagcccaaaacacaagagatacaaactttttctcaggcttctatcaggcttcacaagaaagaccacaggcagggcaggaaacatgagaatgcccccaccttggttgggcacagacgttaaaaccctcctgctttccaaacccttcttgatatgatgcaaaagttacctgggaataaatycatatgcagctatacaagaagctggagacagacttggaccaatgatattatattgataaaaagcagaaagacttggtcctgacaaaatatccctatgcaaggcaaaacttcactggcaagagggagagggaagacccactgaggaaaaccccatgcctgcgattcaggtgctcaggttctgcttaatactaaggctggagaagaaaaactaagaaaactccacagtcttcacaagtctggcactgagcggcaagaaacagttgtttacatatggggaaaagtactagaagtatgaaaata

SEQ ID NO: 113232 - DNA, 601 bp, Human
gcttttgtttatttacaattcttaaaaaaaaaaagtatccaaacttgttacggccatcttccatatatcagtatcttcatcattagagccaacttttaagtcatttagccagtttccattatttttcctgctgctgtctctgatttacagcattcttcaaatcatacatgagattataactgcagatgttatcccaagctacaagtactggttgactaatgttaagaaaatgctttttcccctcattcattccatagatctatgttcataatcttagaagtgctttgctctttgaagatayctttaaaaggttggtttaagaaaaagttcctcattcatttacgatgtgaaaaatagtaagagaatgctgcttctacactgatgataataaaaaagcagataatctatcaaataataacttttgttatggccatcagaaagctgacatctgcaggcaaccaaataaactgaatcccagcccctccaaaggagggtgaagtatatgaactcatgtcttctttggtagagaaaaggaagaggaagtggcagccataagtgagtacaaagaaaacaacaactgaccaattcttaaaaactaagt

SEQ ID NO: 113233 - DNA, 601 bp, Human
attatagaatatactatatgaataaagtgaatatgaagggagataaaattcttgaaggaaaaaaggttttctaagaatagagatgtaatctaaaaatgttattaatattgtatactttatattaactgatttatatattcatatgagatcatatatgtaatgtgtttattaaattagaaatattagcttttgtttatttacaattcttaaaaaaaaaaagtatccaaacttgttacggccatcttccatatatcagtatcttcatcattagagccaacttttaagtcatttagccagtttmcattatttttcctgctgctgtctctgatttacagcattcttcaaatcatacatgagattataactgcagatgttatcccaagctacaagtactggttgactaatgttaagaaaatgctttttcccctcattcattccatagatctatgttcataatcttagaagtgctttgctctttgaagatacctttaaaaggttggtttaagaaaaagttcctcattcatttacgatgtgaaaaatagtaagagaatgctgcttctacactgatgataataaaaaagcagataatctatcaaataat

SEQ ID NO: 113234 - DNA, 601 bp, Human
gtcttctaaatttttggatatgctgtgtgttatacatcccttttatcacaatcacacactcttgaaagcactatgcttaaagagtttacaagatttgctttccaaaagcaacaaccaaaacttcaagtacgtatttcacttgcaacaaaaatctgtgattctcttcccaaactgtgacttcatcttctctgccatttcatccttcaaaatctataatttctctaaactgagggcagttcaaatttgagtttaaaaatctatatttccttaaaattttaatgttcctttctgacactgagayagaaattagatcagtaattgccagaggcttggggggtagtctttaatgagtttcagttttgaaagatgaaaaagttggctgggcatggtggctcacacctgtaatcccagcaatttgggaggctgaggcgggcagatcatgaggtcaggagttcaagaccagcctgtccaatatggtgaaacaccatctctactaaaaaatacaaaaattaaccggtgtggtggcgcgcgcctgtagtcccagctactactcacaaggccgaggcaggagaatcacctgaacccaggaggtggaggttgc

SEQ ID NO: 113235 - DNA, 601 bp, Human
cagctcaaacatggagattataatccataaatacactgtgttttccaagaacccttagagaatgtttttaatcttactttggggtttttttgtgtcttttttatatttttccaagcagagaatttcattgcaaagaatacaccgtgaaaaatacaactaacagttttttcaatgccatatcaacagagttatagaccctataccctctaattaattctgactgattacgtagttttaatgtatctctttcacagatttttattattttgaagaactcaacatgtatatcactgatggaggyctgaaacatgaatttctgcattttggggaagagaacaaaacatactttcacagagctaggtgcattagttcattttcacacttgctaataaagacatacccgagactgggtaatttataaagaaaaagcagtttaatggacttgctgttccacatggctggggtggcctcacagtcatggcagaaggtgaaggaggagcaaaggcatggtcttacatggcagcaggcaagagaatgagtgtcaagcaaagggggaagccccttataaaagcatcagatcacataagaactcactatcatg

SEQ ID NO: 113236 - DNA, 601 bp, Human
tttggcaaaatttccttcaagtagctataaaataaatacacatgtattctttaaaaatataataatcactttaaaagtatttaaacttcttgctaagctttataaaaacttcttaatatataagttataagaactgaaatacaaaataagagaaagggataggtctaaaggaatctaagttaatacatcgtaagatttgaatacacacacacagacacacacacacacacacacacacacacacacacacaaatttccattccttggcaggctagatattctaaacaatagtcctaactayaacaaccaaaataatgaataaagcactgaaaacatatttttaaatgtattcctaagccagcacaaaaggaagaaagacatagaagcaaaaacaaagtgaaagtagaaactctggaaagtaatagataaaaggaataaaaaataaacacacacaaaaacaggagaagcaaagaaatacttggggacaagaatttgtaactacaaactagctcaaacatgaagattatagtccaaagctacaaacaaacttgcttgggggcaagaatttgtaaccacaaaccagctcaaacatggagattat

SEQ ID NO: 113237 - DNA, 601 bp, Human
tactccagtaggctgaaaaataagtccatccatttcatggctcacttctttggcaaaatttccttcaagtagctataaaataaatacacatgtattctttaaaaatataataatcactttaaaagtatttaaacttcttgctaagctttataaaaacttcttaatatataagttataagaactgaaatacaaaataagagaaagggataggtctaaaggaatctaagttaatacatcgtaagatttgaatacacacacacagacacacacacacacacacacacacacacacacacacaaatttccattccttggcaggctagatattctaaacaatagtcctaactacaacaaccaaaataatgaataaagcactgaaaacatatttttaaatgtattcctaagccagcacaaaaggaagaaagacatagaagcaaaaacaaagtgaaagtagaaactctggaaagtaatagataaaaggaataaaaaataaacacacacaaaaacaggagaagcaaagaaatacttggggacaagaatttgtaactacaaactagctcaaacatgaagattatagtccaaagctacaaacaaacttgct

SEQ ID NO: 113238 - DNA, 601 bp, Human
acttactccagtaggctgaaaaataagtccatccatttcatggctcacttctttggcaaaatttccttcaagtagctataaaataaatacacatgtattctttaaaaatataataatcactttaaaagtatttaaacttcttgctaagctttataaaaacttcttaatatataagttataagaactgaaatacaaaataagagaaagggataggtctaaaggaatctaagttaatacatcgtaagatttgaatacacacacacagacacacacacacacacacacacacacacacacacacaaatttccattccttggcaggctagatattctaaacaatagtcctaactacaacaaccaaaataatgaataaagcactgaaaacatatttttaaatgtattcctaagccagcacaaaaggaagaaagacatagaagcaaaaacaaagtgaaagtagaaactctggaaagtaatagataaaaggaataaaaaataaacacacacaaaaacaggagaagcaaagaaatacttggggacaagaatttgtaactacaaactagctcaaacatgaagattatagtccaaagctacaaacaaactt

SEQ ID NO: 113239 - DNA, 601 bp, Human
ttaagttggtaaaagttcttcagtgcatttcaaaaatttaacatggaaaaaatattcaaaagttttattctttctcaagtagtgacaaagtatgaattttactctacagtaaactacagcaaaatgaagttttagagagattaatacataaaagtataccaagttacaaaaggaaataaacatttatgtaatgctattggtagaaaattattttttaataactaattatattaaaagactggtttctttgaaatgtaacgaccaaaaatgcttatttcttaagctgagtgaaaaacagatrggtgctcattttagtattacatgtatttagatataaataaaatctttcataatgagcaatttgttttaaggaaaagtggcaatcacagcagtaatcaatcccaagtaaataagtttgaggcatacatgtgtatgtgtatgtatatgtatatctgtgtacacacacacacaaacacacaaacgaacacacacacacagacaaatgaacttactccagtaggctgaaaaataagtccatccatttcatggctcacttctttggcaaaatttccttcaagtagctataaaataaatacacatg

SEQ ID NO: 113240 - DNA, 601 bp, Human
cattataaattttatagcatatcagtctttgaattagagatactcaacctgtacagtatttaatacactgtgttcaaattattagttccctttctttgaccccaggcacccagtctgatgtctccatatataaattctcaactagcttatactctaattactaaaagaagagttggtgaagaaaaaaagcagcatatgatgaggtggttgcacatgaaataaactctttcctatagagtaagtagctctcatacttgaacatgcattagaatcacttggagaacttgtcaaaacacaaacygctaaactccatccccagagtttctactcaataggtgtggggctgagctgcatctgtgaaacttcctgggtggtgctaatcctcctctacaggccacattttgaaaaacaccgtcctacagaacatgggttatcaagtagggccaattatgttctctgaggaaactgggcaatgtcagactatatttttggttgtcacaaatgggaatagggagcatgctcctggcatctatactcctggcatctagtgagtagagaccacagatgctgctaaacatcctaccatgcacaagacagctcc

SEQ ID NO: 113241 - DNA, 601 bp, Human
gtgctcaaaacattataaattttatagcatatcagtctttgaattagagatactcaacctgtacagtatttaatacactgtgttcaaattattagttccctttctttgaccccaggcacccagtctgatgtctccatatataaattctcaactagcttatactctaattactaaaagaagagttggtgaagaaaaaaagcagcatatgatgaggtggttgcacatgaaataaactctttcctatagagtaagtagctctcatacttgaacatgcattagaatcacttggagaacttgtcawaacacaaaccgctaaactccatccccagagtttctactcaataggtgtggggctgagctgcatctgtgaaacttcctgggtggtgctaatcctcctctacaggccacattttgaaaaacaccgtcctacagaacatgggttatcaagtagggccaattatgttctctgaggaaactgggcaatgtcagactatatttttggttgtcacaaatgggaatagggagcatgctcctggcatctatactcctggcatctagtgagtagagaccacagatgctgctaaacatcctaccatgcaca

SEQ ID NO: 113242 - DNA, 601 bp, Human
atgccttctctgaaatgcttaggaccagaagtggtttggattctgatttttttcagattggggaatatctgcattatatatacttaacagttgagcatccctaatacaaaaatccaaaatgctccaacgagcatttcctttgagcatcatgctggtgctcaaaacattataaattttatagcatatcagtctttgaattagagatactcaacctgtacagtatttaatacactgtgttcaaattattagttccctttctttgaccccaggcacccagtctgatgtctccatatataaattmtcaactagcttatactctaattactaaaagaagagttggtgaagaaaaaaagcagcatatgatgaggtggttgcacatgaaataaactctttcctatagagtaagtagctctcatacttgaacatgcattagaatcacttggagaacttgtcaaaacacaaaccgctaaactccatccccagagtttctactcaataggtgtggggctgagctgcatctgtgaaacttcctgggtggtgctaatcctcctctacaggccacattttgaaaaacaccgtcctacagaacatgggttatcaa

SEQ ID NO: 113243 - DNA, 601 bp, Human
aaaaaaaaaaaagtatggttactagaaagggaacggaatgacaaatcaactgcctatactagacatccaagaaagagactcacttatttgtcaggccatttttcctacatatgccatatatgtacagatctgaaccatgagtttcacacactgaaattttctgaatttattgttatatttagactttgcttctttcagtctagggagactggaatatattagaactaaaagattcaactttaattttcctaaaatagtattttcttccatttccgtccctaacctctagtgctcctccatstcctcctccctctcctcctcccttaaccacagaagatatttctgttctttgtttggcaaggggggctagaagacagacagatgccaatcacatatcacattgtctctaaatttgcattttagcagagatttattacacacgtaaagatataatgctttacatgcataggttgaatatgccttctctgaaatgcttaggaccagaagtggtttggattctgatttttttcagattggggaatatctgcattatatatacttaacagttgagcatccctaatacaaaaatccaaaatgctcc

SEQ ID NO: 113244 - DNA, 601 bp, Human
gcgcggtggctcacacctgtaatcccagcactttgggaggccaaggtaggcggatcacctgagatcaggagttcaataccagcctggctaacatggtgaaactccgtttctactaaaaatacaaaaaattagccgggcatggtggtgcgcacctgcaatcccagctactcaggaggctgaggcaggagaatcccttgagcccagaaggcagaggttgcagtgagccaacattgcgccattgcacttcagcttgggcaacaagagcaaaactccatctcaaaaaaaaaaaaaaaaaaaaaaagtatggttactagaaagggaacggaatgacaaatcaactgcctatactagacatccaagaaagagactcacttatttgtcaggccatttttcctacatatgccatatatgtacagatctgaaccatgagtttcacacactgaaattttctgaatttattgttatatttagactttgcttctttcagtctagggagactggaatatattagaactaaaagattcaactttaattttcctaaaatagtattttcttccatttccgtccctaacctctagtgctcctccatgtcctcctccct

SEQ ID NO: 113245 - DNA, 601 bp, Human
aatacaaaaccaaaaaagaacagcatagactgtgtagaactgtagaagcaaaagccaaaaaaaaaaaaaaaaaaaagaggaaaataattgcctcctaggagtagtactcagagtgcagaaaaaggtaagagactgtttggtaagagactgttctatttttcagcacaaatcactcatttaattggtttttttaaatcatggataggcattaccatggattatgtgcaacttacataattttttcaacaataaaaaatattaccttcattattctgaatataaaaaatgagaaaaattggcygggtacagtggctcatacctgtaatcccagcactttgcgaggctgaggcaggcggattgcttgagctcaggagctttagaccagcctcggcaacaaggcaaaaccccgtatctacgaaaaatacaaaaattagcaaggcgtggtggtgcgcgcctatagtcccagctacttggggacctgaagtgcgaggattgcttgaacccaggaggtcgaggctgcagtaagccatgtttgtgccactgcacaccagcctgggcaacaaagtgagaccctgtctcaaaaaaaaaaaaagagagaaaa

SEQ ID NO: 113246 - DNA, 601 bp, Human
ggctatgcagcaggactaaagaatggaaggcttcagaaagaatgccttcaaatgaaaaatggaccttatatatttgactgcattgataaaaagtaaacagttcttttggagagtttaaagaaagaaatattaataattataataaccaaaaatattcctaatgctagatgacaagacttttctaaaaaaagaaaatacaattgtatactatttgacccagataggaacaatatttatgtcaccataaaaatataaaaattgaatattaatttgaccaaatatgtgatgtaattacaatagratgacagaaggagaaaggggtgtggagggggttagtggaattagagggctcaatcctattcttccacagtacaaagtaagcagattatgtataaaatacaaaaccaaaaaagaacagcatagactgtgtagaactgtagaagcaaaagccaaaaaaaaaaaaaaaaaaaagaggaaaataattgcctcctaggagtagtactcagagtgcagaaaaaggtaagagactgtttggtaagagactgttctatttttcagcacaaatcactcatttaattggtttttttaaatcatggatagg

SEQ ID NO: 113247 - DNA, 601 bp, Human
agtcagagccataaaattgtagaacagattagagaccactgaaaataacatgttcagtttacagctgaaacaaaagctccataagtataaggaccagtttgtacagcattaggttttcaagatcactcaaatcaaaaaagcagaaaagataaagtcaaaaaagtagggaaatctatcagagaagaaaggtaaaagggatttcctggatgaaatagtgaaaagaaactctaagaagaaaaggctatgcagcaggactaaagaatggaaggcttcagaaagaatgccttcaaatgaaaaatgraccttatatatttgactgcattgataaaaagtaaacagttcttttggagagtttaaagaaagaaatattaataattataataaccaaaaatattcctaatgctagatgacaagacttttctaaaaaaagaaaatacaattgtatactatttgacccagataggaacaatatttatgtcaccataaaaatataaaaattgaatattaatttgaccaaatatgtgatgtaattacaatagaatgacagaaggagaaaggggtgtggagggggttagtggaattagagggctcaatcctattc

SEQ ID NO: 113248 - DNA, 601 bp, Human
gaacatcacacactggggcatgttgtggggggttgggggctagggaagggatagcattaggagaaatactgaatgtagatgacgggttgatgagtgcaggaaaccaccatggcacgtgtatacctatgtaacaaacctgcatgttccgcacatgaatcccagaacttaaaagtataattttttaaaaaccaccaccaaaaaaagcaaacaaacaaacaaaaaacaagaaataaacaactcaaagcacaattttaaaagggaagaacataaaaataaaaaaagggaccctcgcaatactgcmatgcactatgatttggaaggggaaggagtgtaggagcctgcctattgcatttgaataaagaaatgtaatcttattttgttctgcaagctggagaagaaaaatctatcattacacagagaattacaattcaactgaagatcacaaatgaatcatgtacaaatgccatgagcacatacaagaaatgggaaacaataaatcaatatatctatacctgcactatctacttacacacatggccactgagcacttgaacagtggcaagtccaagacatgctgtaagtgtaaaattcccactggatt

SEQ ID NO: 113249 - DNA, 601 bp, Human
tgaggcaaaaatataaccaaaagagagcttgtgaggggtagctagaaacagaaaggcatctttaaagagaaccatttttgctttgagaataatcatttaagcaatcagttttagttctgaagcaatttggcaattagtaacaatttttcaagagaaaagatagaaaaagatattgctttcagcttcatgaaagcaaatcaatctcccacaaatcctatggaatggagagcaatgaagacacagagtgtgcacaggaatctaagatctcatctctcttagactggtggcctcagaatgagawcagctgctaccagagaactgaaaaatctccatatcagagaagtagaaggtacaggttgatgatcaggacctaggctgtcatggaaggaaagatctaattctagacaaaggtgtatcacttctgaccaagctgctataaaagtgatgatagaggaatagttatttaatgcaaatatgtatgtgtcaattttgtttaaagaggtttaagattaaatattcatgactaaggtgatacgaaagaaacctagcaactatcttttcaactctttataccctaaaatactaccatcagactaacagg

SEQ ID NO: 113250 - DNA, 601 bp, Human
ctttgggaggccgaggtgggcaaatcacttgaggccaggagttcaagactagcctggccaacaaggtaaaatgccatttctactaaagaatcacttgaacctgggaaccatgggttgcagtgagccaagtctgcgccactgcattccagcctgggcgacagagaaagactctgtctcccccaccaaaaaaagaaatcatggcaggagaaaaaaatcaatagaatacagtcatgtaatagtcatactatcaaacttcataagaagtctagtttattttaattgtctaacttgccatttaaarcataaattatttttaggaaactaaaataaaagagtttcttcttttattaaaaattcattacttagtaaattttcaccaggttattggcagaaagaattttcaagtactgatttatatcatttgcactgatcatcatatgaccataagagaatttcaaagctaagctcttacagcctctacattttacagatgaaaaactggagaatcaaaaagatattcagtggtgtctgtttgtttgtttgtttaaccagagaccactcctaacccactgggaagtttctgaagagaatatgcagagga

SEQ ID NO: 113251 - DNA, 601 bp, Human
aatagaaacatatttccatttttttaaagaggtagaaaagtcataaatctctgcataagagctaagtacaggtttaatctggggctttggcaaatcaaaagtctgaaagtggaatacataagaccactctggtgatggtggcctaaactgaggataaactaaaaataggaaaaaatcagcctttgcaggagaatcggaggttgaaattgcaaaaccaaaataaggaaaaaataacaaaggctacacaattcaatataatgaaattttgcatttgagagagaaaattgcctcctgctacccraatggatttatgcaaaactggagcctattctggatggcaccgttaatatatatttatacttagaataccctttagaatatttaccaaaaaaaatagtaggaatgtaaaataaccactgaattaactaggatgggtagacatgtgattatgtaccacatccttcttacagccagatgctgttttagaaattaaccatccaattaaagagcacatcaaaaatatgatgaaaggtacatattagtgataaaaactaagagaattaaagttggtaacatgtgcttttaagaaataaaaaactag

SEQ ID NO: 113252 - DNA, 601 bp, Human
gtaaaaaggaaattgatgacaatgtataagcacaaaagaagtgagaaaaatcttaagtattctttcttttaaagtcataaagagaatttatgagtaagaattattagaaaaatgtgtcttaaactctgctttctttagcagaatatcatatagtgtctgataatgtcattcaactttattttaatagaaacatatttccatttttttaaagaggtagaaaagtcataaatctctgcataagagctaagtacaggtttaatctggggctttggcaaatcaaaagtctgaaagtggaatacayaagaccactctggtgatggtggcctaaactgaggataaactaaaaataggaaaaaatcagcctttgcaggagaatcggaggttgaaattgcaaaaccaaaataaggaaaaaataacaaaggctacacaattcaatataatgaaattttgcatttgagagagaaaattgcctcctgctacccgaatggatttatgcaaaactggagcctattctggatggcaccgttaatatatatttatacttagaataccctttagaatatttaccaaaaaaaatagtaggaatgtaaaataaccactg

SEQ ID NO: 113253 - DNA, 601 bp, Human
tgttgaaaagatcagcaagttttagatattaaaaactagaaatagactttctccttataatctgaaagactgaataaaaacaagaatgggactacatttctcattgtatgatgcagtgtcatctgatgccctgtccctggaccacctaaaatcatgtctcctctcaccactggaagccacatctgtctataatcaactctcttcttacttcctccttacaaataagacctagtgcaggtgaaaaggaaaattaaggtggttcctttgaatatacaaacagcaatcagaaaaaggctatttsaactggtaaaaaggaaattgatgacaatgtataagcacaaaagaagtgagaaaaatcttaagtattctttcttttaaagtcataaagagaatttatgagtaagaattattagaaaaatgtgtcttaaactctgctttctttagcagaatatcatatagtgtctgataatgtcattcaactttattttaatagaaacatatttccatttttttaaagaggtagaaaagtcataaatctctgcataagagctaagtacaggtttaatctggggctttggcaaatcaaaagtctgaaagtgga

SEQ ID NO: 113254 - DNA, 601 bp, Human
gtctggctctgacgcccaggctggagtgcagtggcacaatctcggctcactgcaagctccgcctcctgggttaacgccattctcctgcctcagcctcctgagtagctgggaccacaggcgcccaccaccacacccggctaattttttgtatttttagtagagacagggtttcaccacgttagccaggatggtctcgatctcctgacctcgtgatccgcccgccttggcctcccaaagtgctgcgattacaggcgggagccaccatgctcggcccaggatttctgtcacatcaaaataccataactattattatatttttctttaaaatagttcactctaaaaatctaaaaaatatatattttaaatggaaactttataacaaatggtacaccattgatactattcgagaaaacggtattgcttaccttaaataaccagtagtcctaaaattagaaaagacagaaattaatcaatgatactaaattctagtagatatgttgcctattgaatagtctaaaagtgggcccacacacttgttgaaaagatcagcaagttttagatattaaaaactagaaatagactttctccttataatctgaaa

SEQ ID NO: 113255 - DNA, 601 bp, Human
agagtgggcaaaaagataaccaaatttggggcttacatagaaatctgaagtctgagtaacatgctgataaaaatgaactaaattcataggtatggatgagactactagaaagagtagggcatgagaaagaatgaaatctggtgcactgagccccgagaaacaccaaacttcaatggctggtagaagacggaagagctcgaaagggaccgcaaagaatggcaaaagactaggaggaatcaggagcatgtggtgtcacagatgccataaaagaaagtatttcaagaaagagtgaacagaatayagactaatgctaaatgatccagtaaaaaagggtgaaaattatcttgattttttaattaaaggagatgactggcgacctttcaaaaaagcagttgattcgaacatcatttacttagcagctaaagccctttttaaaacataatctcatctacaagcacaatatataaaagtaatattagtaaatcagcagcactgcaatggaaacagaatgctgacctagtaacctatccctccatgcagtcacctaaggcacttcacagaaacctagaacattggagtttatatttttgaaaccagtgag

SEQ ID NO: 113256 - DNA, 601 bp, Human
taactgcatttagtaactgaggtggaaatgctggaaaagaaccagtttgtatgtctgcttatttgatcatttcagaaatagagatagagtttgtctttgatatgcagatgcttctcaacttacaacggcattactatccacagaaaaatcataagtcaaaccatcataagctgggaactgtctgtattgtgtttctgatgtttttgagaaattcaaaaggcagtatcagagtgggcaaaaagataaccaaatttggggcttacatagaaatctgaagtctgagtaacatgctgataaaaawgaactaaattcataggtatggatgagactactagaaagagtagggcatgagaaagaatgaaatctggtgcactgagccccgagaaacaccaaacttcaatggctggtagaagacggaagagctcgaaagggaccgcaaagaatggcaaaagactaggaggaatcaggagcatgtggtgtcacagatgccataaaagaaagtatttcaagaaagagtgaacagaatatagactaatgctaaatgatccagtaaaaaagggtgaaaattatcttgattttttaattaaaggagatgactggc

SEQ ID NO: 113257 - DNA, 601 bp, Human
gttgtttataagccactcggtttatggtattttgttacagcaccccaaactgactaattgactgtttatattattgtttatatcactgtttgtgaataatataattaagccacctttaaataaaaaacattaaagttatttttgaatcaacagcaaaacacacagggaaaccaaaaggcaaaatatgataaagaaaaaagtaaactggctccaaatctaatgttggtttcctgagaaatgttggttaacctgagaacaaggagaaagcactagagattaaggaagatcactcgatatggaragaagaaaagattgggccaggcgtggtggctcatgcctgtaatcccagcactttgggaggccgaggtgggcggatcacaaggtcaagagatccagaccatcctggccaacatggtgaaaccccgtctctactaaaaatacaaaaattagctgggtgtggtggtgcgggcctgcattcccagctactcaggaggctgaggctggagaattgcttgaacccaggaggctgaggttgcagtgagcccagatcgcgtcactgcactccagcctgggcaacaagagtgaaacttcatttcaaaaa

SEQ ID NO: 113258 - DNA, 601 bp, Human
taaatttctgttgtttataagccactcggtttatggtattttgttacagcaccccaaactgactaattgactgtttatattattgtttatatcactgtttgtgaataatataattaagccacctttaaataaaaaacattaaagttatttttgaatcaacagcaaaacacacagggaaaccaaaaggcaaaatatgataaagaaaaaagtaaactggctccaaatctaatgttggtttcctgagaaatgttggttaacctgagaacaaggagaaagcactagagattaaggaagatcactygatatggagagaagaaaagattgggccaggcgtggtggctcatgcctgtaatcccagcactttgggaggccgaggtgggcggatcacaaggtcaagagatccagaccatcctggccaacatggtgaaaccccgtctctactaaaaatacaaaaattagctgggtgtggtggtgcgggcctgcattcccagctactcaggaggctgaggctggagaattgcttgaacccaggaggctgaggttgcagtgagcccagatcgcgtcactgcactccagcctgggcaacaagagtgaaacttca

SEQ ID NO: 113259 - DNA, 601 bp, Human
cacaacataagccaagaagcaggccttcaccacacaccgaatctgccaacaccttgatcttggacttcccagcttctagaactgtgagaaataaatttctgttgtttataagccactcggtttatggtattttgttacagcaccccaaactgactaattgactgtttatattattgtttatatcactgtttgtgaataatataattaagccacctttaaataaaaaacattaaagttatttttgaatcaacagcaaaacacacagggaaaccaaaaggcaaaatatgataaagaaaaaagyaaactggctccaaatctaatgttggtttcctgagaaatgttggttaacctgagaacaaggagaaagcactagagattaaggaagatcactcgatatggagagaagaaaagattgggccaggcgtggtggctcatgcctgtaatcccagcactttgggaggccgaggtgggcggatcacaaggtcaagagatccagaccatcctggccaacatggtgaaaccccgtctctactaaaaatacaaaaattagctgggtgtggtggtgcgggcctgcattcccagctactcaggaggctgaggc

SEQ ID NO: 113260 - DNA, 601 bp, Human
ataaaaatattaatatttcaaaagaatgcaatattaaaatcaaagctgactctaaatttctatgcaaactgatgaataccagatacataaaatcaagctgaaccaccttataggaaaatcaaaatagtgatgaaaacattaaaaaacaattatatctctactacttgaaagtaaataactctagactcaatagaaacaattatgttttactaaccatagtagagttagtgggtacaacaagaaaagccatttttctaaatataaaacaaaaatattttcaagatttttattcttacttcarttatacaatccactattctgtttttatttcatagtgatagattaatggcatacaattcttgtctagaaacatagtttctccagatgataaaagtaaaatcaaagctgatttttcaaaaggttaaaaattaatgttatttccacatgtaaaactgtaatatgctacataaatctacactaaaatcaacttataaaagctagtaaacaaataagatttcattttactaccaactttgtaaattaaacaatctaatagctatcatgtaaaagattgaatacctgcatattaaaataccaaatc

SEQ ID NO: 113261 - DNA, 601 bp, Human
ttcatttttgtgaagtccttatttatatttatttcccctttctctgctaccaatatatcatcattagcaattccttttagttgtacagatatatctatatctagctgagactgattacaaattatgcatctgtagctgtttattttgccaacaaaattcaaaaaaaagtaaatatttattttaaaaacttgaaaatgatgttttgctttttcttccttacacaaagcaagctaagaatattttgctgtgctctaaaagatgaacaaggaaaaaaaaataaaataaggtatattttctttcytggcactttgctattacaattccttggaaaattatatttttcaataaaagtaacacattttgagaaaagatagaatgacacttttgcagcctgccagaaaacagagcccttcttcaaatgaagacctatcaaaatatgcaagcaaatgtcatggaaacagaagctctcaccatggtaacatccttgctacagaggaaaaccattctaatttgtcatgtacttcaagacaaggcattaggctaattccaattttcattttacaatctatccataacattcaatatacctggcagtagtaaa

SEQ ID NO: 113262 - DNA, 601 bp, Human
tgtatatttaccctctaggaattcaccgcttctttcatttttgtgaagtccttatttatatttatttcccctttctctgctaccaatatatcatcattagcaattccttttagttgtacagatatatctatatctagctgagactgattacaaattatgcatctgtagctgtttattttgccaacaaaattcaaaaaaaagtaaatatttattttaaaaacttgaaaatgatgttttgctttttcttccttacacaaagcaagctaagaatattttgctgtgctctaaaagatgaacaagraaaaaaaaataaaataaggtatattttctttcttggcactttgctattacaattccttggaaaattatatttttcaataaaagtaacacattttgagaaaagatagaatgacacttttgcagcctgccagaaaacagagcccttcttcaaatgaagacctatcaaaatatgcaagcaaatgtcatggaaacagaagctctcaccatggtaacatccttgctacagaggaaaaccattctaatttgtcatgtacttcaagacaaggcattaggctaattccaattttcattttacaatcta

SEQ ID NO: 113263 - DNA, 601 bp, Human
ttggtattctgtatatttaccctctaggaattcaccgcttctttcatttttgtgaagtccttatttatatttatttcccctttctctgctaccaatatatcatcattagcaattccttttagttgtacagatatatctatatctagctgagactgattacaaattatgcatctgtagctgtttattttgccaacaaaattcaaaaaaaagtaaatatttattttaaaaacttgaaaatgatgttttgctttttcttccttacacaaagcaagctaagaatattttgctgtgctctaaaagwtgaacaaggaaaaaaaaataaaataaggtatattttctttcttggcactttgctattacaattccttggaaaattatatttttcaataaaagtaacacattttgagaaaagatagaatgacacttttgcagcctgccagaaaacagagcccttcttcaaatgaagacctatcaaaatatgcaagcaaatgtcatggaaacagaagctctcaccatggtaacatccttgctacagaggaaaaccattctaatttgtcatgtacttcaagacaaggcattaggctaattccaattttcattt

SEQ ID NO: 113264 - DNA, 601 bp, Human
gagaaaatgaaatgtaacacagtcaaaaagataaaaacaaatttcccaggggaagtaaaatttaagctgagaattatacaggcaataaggatgagttaagtagctacaagagaaagtacagtgaatctgagcagcagacattcagattgcccacacgtacagcacagtacttaatattcaccctactgctacaagcactaaaaatatcactgtgaatgagacagagatggtctctgtcttcatggtacttacaatctagtaagagaaatggtaatgtttaaataactaaaaattaatacaygttaagtgctttgaggccaatgggaatactgtggaggcacaggggagagtcatgctcacctatacaaccaggcttcctcaaggaagcacatctaacttgatagttgaaggataaatgggagtaatatagaaaagaaaatagtttcaggcagaagaaatagcatgtataaatacatattctttagagactatttcagtttgtagctcttacagaatgaattggtctgtcagtagaaagagctactaaagttatcactgaacttggacaacaaaaggaaaatcaattttctgaccctacata

SEQ ID NO: 113265 - DNA, 601 bp, Human
catttataaatctataaatctaagacaatatggagaaagcaaagaaatccacagtctaaagcagggttctttaacagcaatactactgacattggggcagttgactctttgttgtgggggctgttccgtgcaatgtaggaggtttaacagcatccctggcctctatgggccaatcaaaataataaaaaatgtccccacatactgtcaaatgttatttgggaagtaaaatcatgccagttgagaatcactgatctaaagtatgcattcattctttttttttaaaccagtacctattgatcarctgctaagcctgtgtcaacctctgtgctagaggacagtaagataaagataatgggggtttcagacaaataataagcagttacaaaaaactgtgaagaatttaatgaaagatgaagttcagagtgctataatagctgagaaaatgaaatgtaacacagtcaaaaagataaaaacaaatttcccaggggaagtaaaatttaagctgagaattatacaggcaataaggatgagttaagtagctacaagagaaagtacagtgaatctgagcagcagacattcagattgcccacacgtacagcac

SEQ ID NO: 113266 - DNA, 601 bp, Human
tcctagaagtaaacaaagaaaaacttcttgacactggtcttggcaactattttctggatataacaccaaaagcacaggcaacagaagcaaaaatagacaagtgggactatatcaaactaaaaaccttctgcacagcaaaagaaacaatgaacaaagtgaaaggtcacctatgaaatgagaaaaaataatcttcaaactatacatccacaggggttaatatccaatatataaaatcatacaactcaatattaaaaatacaaataacctgttaaaaatgggtaagggccctgaatagacactyctcaaaataagaaacgtagatggccaacagacctattgaaaagctgctcagcatttctaatcagcagggaaatgcaaatcaaaacctcaataagacagcacttcacatttacgaggatgcctattatcaaaaaggcaagaaataacaagtgttgtcaaggatatggagaaaagtgaacccttgtatacttcggtgagaatgtaaattggtacagcccattagtgaaaacagtattgaggttcctcaaaaaattaaagacagaaccaccctatgattcagcaatcccacctctgagtatgt

SEQ ID NO: 113267 - DNA, 601 bp, Human
aactaccacattgtacggggtgaatggaaagacaaaaaggtgcacaccatacacaaaaatcaactcaaatggattaaacatttaaacacaaaagtggaaactgtaaaactcctagaagtaaacaaagaaaaacttcttgacactggtcttggcaactattttctggatataacaccaaaagcacaggcaacagaagcaaaaatagacaagtgggactatatcaaactaaaaaccttctgcacagcaaaagaaacaatgaacaaagtgaaaggtcacctatgaaatgagaaaaaataatctkcaaactatacatccacaggggttaatatccaatatataaaatcatacaactcaatattaaaaatacaaataacctgttaaaaatgggtaagggccctgaatagacacttctcaaaataagaaacgtagatggccaacagacctattgaaaagctgctcagcatttctaatcagcagggaaatgcaaatcaaaacctcaataagacagcacttcacatttacgaggatgcctattatcaaaaaggcaagaaataacaagtgttgtcaaggatatggagaaaagtgaacccttgtatacttc

SEQ ID NO: 113268 - DNA, 601 bp, Human
acaaccaaagaccacctccccgtgcccacttacctagccttattcatcctctctagttttatcccctactatgccctttacacagaataattaaggcagcaataacttctaagggctaacatcgactgagtttttcacttttcaccagttactggtttgagtgttcttaaatcactttattctcaaaatagctccatgaggtagttcaatctaacatagtacccttttctcatggatcacaaaacagagtcataaagaaattggtagaaaagatatttgaacccaagtattttattccagwttccaaaatatatactaactaccacattgtacggggtgaatggaaagacaaaaaggtgcacaccatacacaaaaatcaactcaaatggattaaacatttaaacacaaaagtggaaactgtaaaactcctagaagtaaacaaagaaaaacttcttgacactggtcttggcaactattttctggatataacaccaaaagcacaggcaacagaagcaaaaatagacaagtgggactatatcaaactaaaaaccttctgcacagcaaaagaaacaatgaacaaagtgaaaggtcacctatgaaa

SEQ ID NO: 113269 - DNA, 601 bp, Human
ttattttaagcaagttcaaagtgggctttatctatctcatttgtaaaaatgcaataatagcattttgcttgcctaaaacaggatatctagaccagagatatctaaaaacaccttgcaggcttatgttattctattatttccactagtaaaatgtgagtagttatcaccaggttctacagtaaaacctgagacataatgccttcttcacaaagatcacatctgaagctaagaaagatccctgtccttactataatattagttttattacagcatttatttttaaagaaaactttagaaatcmtagacagtaatgctactagagacagtaaaacaatggaatcaattatgaacgcacattcttcaagaatctattatttgtcttttcactgttacacattatacagcatccactcctctaagactccaaatacacttacaatgaaaattactcccaaatcttcatcttttgtcctaactttctcccaaataaaagtatgccaggcactggcttattcattagtaccctaaaggcagcctaaagttttaaatctaaaactgaatcatttatattcttaaacaaaaaactagttcatctccattc

SEQ ID NO: 113270 - DNA, 601 bp, Human
attattttaagcaagttcaaagtgggctttatctatctcatttgtaaaaatgcaataatagcattttgcttgcctaaaacaggatatctagaccagagatatctaaaaacaccttgcaggcttatgttattctattatttccactagtaaaatgtgagtagttatcaccaggttctacagtaaaacctgagacataatgccttcttcacaaagatcacatctgaagctaagaaagatccctgtccttactataatattagttttattacagcatttatttttaaagaaaactttagaaatyctagacagtaatgctactagagacagtaaaacaatggaatcaattatgaacgcacattcttcaagaatctattatttgtcttttcactgttacacattatacagcatccactcctctaagactccaaatacacttacaatgaaaattactcccaaatcttcatcttttgtcctaactttctcccaaataaaagtatgccaggcactggcttattcattagtaccctaaaggcagcctaaagttttaaatctaaaactgaatcatttatattcttaaacaaaaaactagttcatctccatt

SEQ ID NO: 113271 - DNA, 601 bp, Human
tctagcccaaaatgtcaatggtgccaaggctgagaaaacctgatgtaaatgaagctagcattagtaacggcaaaggagcaacgtatttagtccctctttgcctctactaacgtaattattttaagcaagttcaaagtgggctttatctatctcatttgtaaaaatgcaataatagcattttgcttgcctaaaacaggatatctagaccagagatatctaaaaacaccttgcaggcttatgttattctattatttccactagtaaaatgtgagtagttatcaccaggttctacagtaaaacytgagacataatgccttcttcacaaagatcacatctgaagctaagaaagatccctgtccttactataatattagttttattacagcatttatttttaaagaaaactttagaaatcctagacagtaatgctactagagacagtaaaacaatggaatcaattatgaacgcacattcttcaagaatctattatttgtcttttcactgttacacattatacagcatccactcctctaagactccaaatacacttacaatgaaaattactcccaaatcttcatcttttgtcctaactttctcccaa

SEQ ID NO: 113272 - DNA, 601 bp, Human
gatggccatatgccaaagagaagtctgtaaaactaaggtggacaggaagctaactggaggtatacatgatatatatttgtggtgtaaagcactggttctcaactaggggagattttgcctccaagggatatttggcaatgcgtggagacatttttggttgaacaagaggtggggagggggtgctactgccatctagtggttaaaggctagatatgctactaaacatcctacaaagcacagggcagctgcccacaacaaagaattctagcccaaaatgtcaatggtgccaaggctgagaaamcctgatgtaaatgaagctagcattagtaacggcaaaggagcaacgtatttagtccctctttgcctctactaacgtaattattttaagcaagttcaaagtgggctttatctatctcatttgtaaaaatgcaataatagcattttgcttgcctaaaacaggatatctagaccagagatatctaaaaacaccttgcaggcttatgttattctattatttccactagtaaaatgtgagtagttatcaccaggttctacagtaaaacctgagacataatgccttcttcacaaagatcacatctga

SEQ ID NO: 113273 - DNA, 601 bp, Human
cctttttcatgatccccaaaataataagagcaaatatattacaaatacagaaactgaataagccttttagaaataaatatttatgatttatcaaacttgaaatacagaatcttgctgaactataaacaaggatataaaaacaccattctacatgttctcgtgtatagtcagagtaatataattcaatttaccagcatgtatctaggttaaaataattatcagagctatagttaactgataaatacaatacttagtttatagaaataaatctgattgtatgaggtgagctgtcaaaaaaaaactggggatatgttaggtgtaaacgtaattaccaatataacccaagatatccattgccattgtaaagtcaaaaacataataaatgtaaacgtcaggcagcaaaataagatgcttaagaaagtgttgaccagatgagaacagaacctggcttagaggtagaagatggccatatgccaaagagaagtctgtaaaactaaggtggacaggaagctaactggaggtatacatgatatatatttgtggtgtaaagcactggttctcaactaggggagattttgcctccaagggatatttggcaatg

SEQ ID NO: 113274 - DNA, 601 bp, Human
caaggcaggaaaattgcttgaacctgaaaggcagaggttgcagtgagtcaagatcacaccactgcacgccagcctgggcaatagggtgagactctgtctcaaataaataaattaattaattaatctagaaaatggtattttaagaatactgtagctcccagttattgaatgtagattcaacaatgacacagattctatgagtaaaatatattgaaatacccattagaatgtaattctacttcagaaaaaatcacatcaattttgtgcctacaaaacacctagtaaaatgctcaaatacttkaataaaataattaaaaatacagaatttcaaaacttactacaaaaatatctgtctcaggtacacttaatttaaaaatgaaatatctgagattatgaaataagctaacaatatttatgaaagattatataaatcactaccaaataatccctttttcatgatccccaaaataataagagcaaatatattacaaatacagaaactgaataagccttttagaaataaatatttatgatttatcaaacttgaaatacagaatcttgctgaactataaacaaggatataaaaacaccattctacatg

SEQ ID NO: 113275 - DNA, 601 bp, Human
agaaaatggggccaggtgcagtggctcacgtctgtaatcccagcactttgagaagccaaggcgggcagatcacctgaggtcaggagttcaagaccagcctggccaacatgatgaaacaccatctctactaaaaatgcaaaaattagctaggcatggtggtgcatgtttgtagtcccagccacctgggggggccaaggcaggaaaattgcttgaacctgaaaggcagaggttgcagtgagtcaagatcacaccactgcacgccagcctgggcaatagggtgagactctgtctcaaataaatwaattaattaattaatctagaaaatggtattttaagaatactgtagctcccagttattgaatgtagattcaacaatgacacagattctatgagtaaaatatattgaaatacccattagaatgtaattctacttcagaaaaaatcacatcaattttgtgcctacaaaacacctagtaaaatgctcaaatactttaataaaataattaaaaatacagaatttcaaaacttactacaaaaatatctgtctcaggtacacttaatttaaaaatgaaatatctgagattatgaaataagctaacaa

SEQ ID NO: 113276 - DNA, 601 bp, Human
acttgatattattaggaatttcaaagcacctttatgaaaattaatgattataaaattttagaaaatggggccaggtgcagtggctcacgtctgtaatcccagcactttgagaagccaaggcgggcagatcacctgaggtcaggagttcaagaccagcctggccaacatgatgaaacaccatctctactaaaaatgcaaaaattagctaggcatggtggtgcatgtttgtagtcccagccacctgggggggccaaggcaggaaaattgcttgaacctgaaaggcagaggttgcagtgagtcragatcacaccactgcacgccagcctgggcaatagggtgagactctgtctcaaataaataaattaattaattaatctagaaaatggtattttaagaatactgtagctcccagttattgaatgtagattcaacaatgacacagattctatgagtaaaatatattgaaatacccattagaatgtaattctacttcagaaaaaatcacatcaattttgtgcctacaaaacacctagtaaaatgctcaaatactttaataaaataattaaaaatacagaatttcaaaacttactacaaaaatatc

SEQ ID NO: 113277 - DNA, 601 bp, Human
tgcacatcccaccgcatttgcaacctctgccaaggaaatttcatacttacaggcaaatcatcctttagttccgtttcctacttgtttatagtaagtgactacaagaacacttagaaaccaatatcaatctaagttattaaatctagaaaagttgaatgatggtatagttttaaaatatctcctaataggtacctaatgataaattctaaaaagctttaatatgtaattttatttatataacagatattaaatatcattcacattctcttgcctggaaatcaagactcaattttgtctaatragaaaacaacatgtatcaactcttctgtttttacacagcaataattcagaaacttaagtaactcctcatctcattgcacatcaaatcattcatattaatttggaatactagacttgatattattaggaatttcaaagcacctttatgaaaattaatgattataaaattttagaaaatggggccaggtgcagtggctcacgtctgtaatcccagcactttgagaagccaaggcgggcagatcacctgaggtcaggagttcaagaccagcctggccaacatgatgaaacaccatctctacta

SEQ ID NO: 113278 - DNA, 601 bp, Human
gtcagcaagagagaataggcccaagaaaaagagtaagtttgtgtagcttgaaacacactatgcacatcccaccgcatttgcaacctctgccaaggaaatttcatacttacaggcaaatcatcctttagttccgtttcctacttgtttatagtaagtgactacaagaacacttagaaaccaatatcaatctaagttattaaatctagaaaagttgaatgatggtatagttttaaaatatctcctaataggtacctaatgataaattctaaaaagctttaatatgtaattttatttatataayagatattaaatatcattcacattctcttgcctggaaatcaagactcaattttgtctaataagaaaacaacatgtatcaactcttctgtttttacacagcaataattcagaaacttaagtaactcctcatctcattgcacatcaaatcattcatattaatttggaatactagacttgatattattaggaatttcaaagcacctttatgaaaattaatgattataaaattttagaaaatggggccaggtgcagtggctcacgtctgtaatcccagcactttgagaagccaaggcgggcagat

SEQ ID NO: 113279 - DNA, 601 bp, Human
aaaaaatcattggaattgataggaaacaccttttaactgtgccacgtgtaagaaaataatgcacattattttccctcaagttttgtattgaagcatgagtaagtataaaatcaaatatataatttttcagtggaaattttcttccatatatttgccctgagagatttatttaggtaacatacatgcttcaggataatcacaaataaatctctttagaaagtttttttggaatgttgaaactgcaacattttcccattgtcaacccattagtgaagagaatctgataaaatatagtcattttcctagtaaagcttatttgacagaaaagtcacaggcctttaagtaacagtggctcattacagtagtaaagggtcaaaaaaagtaaggggagaaaggagtgtcagcaagagagaataggcccaagaaaaagagtaagtttgtgtagcttgaaacacactatgcacatcccaccgcatttgcaacctctgccaaggaaatttcatacttacaggcaaatcatcctttagttccgtttcctacttgtttatagtaagtgactacaagaacacttagaaaccaatatcaatctaagttattaaat

SEQ ID NO: 113280 - DNA, 601 bp, Human
cactcatgcagatttgcagcatgaagtaaatatgggcaaaaaaacaggagtagagaaatataggatgtgctaaaggagaggcaagtctcccaattcagtgtgtgcattatggagggtggggccatattataagaaaaatacttaggaaggaaaaattgctaagtgtccaatactagtatttttaaattatccaagtcaaattgcattctaacaaatttttaatttaatttttaaaattagatatggagtcttgctatcttgcccaagctagaatgcagtggctattcacaggtgcagtcayagcactgcagccttgaactcctgagtttaagcaattctcccaccacagcctcctgagtagctgagacgaagggtgcaatccattgcacccagctcaaacagatttttataaattatttaaaactgcaaaaatcataatcacaggattgcttacttcaaacggaagtccatacaatgacgattcaatataatttaagttttgctaagaaagaaaaaatcattggaattgataggaaacaccttttaactgtgccacgtgtaagaaaataatgcacattattttccctcaagttttgtattg

SEQ ID NO: 113281 - DNA, 601 bp, Human
ttggctttttcagggtttttagtcccctacaaattttagaattgtttttctctagttctgtaaaaaatgtcattggtatttggatagggattgcaccaaatctgtgtatcactttgggtagtatggacatcttaacaatgtaaatcttccaattcattaacatggaatatctttctatttatgtgtatcatcttcaatttcttccatcttggttaaatttattcctaggtattttattctttttgatgctattgtaaatgagattgttttcttcattctcttttcagataggctgttatcsattggtgtaaagaaatgtaactgatttctgtatgttaactttgcatcccacaactttattgaattaacaggtttttttgatgtaacagtctttttctacatataggatcatgtcatctgcaaacagagataattctactacttgttttccattttagatgcctgttgtttctttttcttgtctgattgctcttactagtagctccagtattatgttgaatagaagcaccaagatggggaatccttgccttgtaccggattttacaggaaaagcttttagttcttccccattaattgtgat

SEQ ID NO: 113282 - DNA, 601 bp, Human
actattttgtatgttatcttgtattttcgataatagccatcttaatatgcatgaggtaatatctcaatgacgttttaattttcatttctctgtgactggtgatgttgagcaccttttcatacaccttttgacctttttttttttttttgagacggagtttccctctcgttgcccaggctggagtgcagtggcgcaatctcagctcaccgcaacctccgcctcccaggttcaagtgattctcctgcctcagcctcccaagtagctgagattacaggcatgtgccagcaggcccagctaattwtgcatttttttttcttcttttttttagtagagatggggtttctccatgttgttcaggctggtctcaaactcctgacctcaggtgatctacccaccttggcctcccaaagtgttgagattacaggcatgagccaccatgcccagccacctgttgaccactttcatggcttctttggaaaaaaaaaaaaaaaagtctattcaagtccttggattatttgtttttgttttgttttttgctactgagttgtgaattcctttaatattatagatatccccttatcagatatgtgctttgcaaata

SEQ ID NO: 113283 - DNA, 601 bp, Human
caattataataaggaggtacagaattagtttatcacctataatcaaaagttgttattaatgagttaccaactgggtttgtttctcccccatttaaaagagcttattaaccaagtagcttcataataggtgttttttgcattctgtttctgtgtactcaactttttgagattccacatgtaagtgaaatcacacaccatttctctttctgtgtctggctgatcttgcttagtacaatgccctccagctccatccatgttgttataaatgacaggatctttttttctaagcctgaataatatyctgttgcataaatataccataatttcttaattcattgacccactgaaggacatttaggtggtttccatatgtaggctgttggaaataatgctgtaatgaacatgggggcatacatttctctatgaggtactaatttcatttcttttggtatatactcagaggaactgctgagtcatatattagttttgtttttaatcgtttgaggagcctccatactgttttccataatggttgtaccaatttacattcctaccaacagtgggacacccttactctccacaccttcaccaactattttgt

SEQ ID NO: 113284 - DNA, 601 bp, Human
tccatcaacaggtgagtagataaacaaaaggttgtatatacatatattatccaaatataaaaaggaatgaagttttgatacgtgctgccaaacggatgaacctcaaaagcattatgctaagcgaaataagccagacacaaaaggaaaatattgtatgattccacttacatgaaatatttaaaatagaaaaaaatcatggtgaccgaaagtagattagaggtcacccagggctacagtatggaagaaaatggaagttactgcttagtggttaaatgatttctgtttgggatgatgaaaaggytttggaaatagacagtggaggtggttgtacaacactgtccatgtaattagagattataaaaattattttaataaacaaaagctttgtaaataattgtgttcttaagcattataacttcctaatgtatataatatgtaaatataaataaatcacactaatcaatatatttgtatattcactttataggtatcctaattggaatgcatttactcaacagaatgaaaaattaattgaaattttttgatatgtaaagtatataacattataacacaatgtttgatatacacagtgaaatgatta

SEQ ID NO: 113285 - DNA, 601 bp, Human
gatagaaatgtgaaatggtgcagccactatagataaaaggttaacagtacctcaaaaagccaaacacagaattaccacatgacccggaaggtccatttctaggtacacactccaaaaacctgaaaacagctactcaaacagacacttgtatgtcaatgttcattgaagcattcttcacaaaaattaaaaggtaaagacaatacaagtctccatcaacaggtgagtagataaacaaaaggttgtatatacatatattatccaaatataaaaaggaatgaagttttgatacgtgctgccaaayggatgaacctcaaaagcattatgctaagcgaaataagccagacacaaaaggaaaatattgtatgattccacttacatgaaatatttaaaatagaaaaaaatcatggtgaccgaaagtagattagaggtcacccagggctacagtatggaagaaaatggaagttactgcttagtggttaaatgatttctgtttgggatgatgaaaaggttttggaaatagacagtggaggtggttgtacaacactgtccatgtaattagagattataaaaattattttaataaacaaaagctttgtaaata

SEQ ID NO: 113286 - DNA, 601 bp, Human
accacttcatactaactagggtgactataatttagaaaaaaaaacacagaaactaacaagtgttggtgagaatgtggataaatcagaacatgcacattgctgatagaaatgtgaaatggtgcagccactatagataaaaggttaacagtacctcaaaaagccaaacacagaattaccacatgacccggaaggtccatttctaggtacacactccaaaaacctgaaaacagctactcaaacagacacttgtatgtcaatgttcattgaagcattcttcacaaaaattaaaaggtaaagacartacaagtctccatcaacaggtgagtagataaacaaaaggttgtatatacatatattatccaaatataaaaaggaatgaagttttgatacgtgctgccaaacggatgaacctcaaaagcattatgctaagcgaaataagccagacacaaaaggaaaatattgtatgattccacttacatgaaatatttaaaatagaaaaaaatcatggtgaccgaaagtagattagaggtcacccagggctacagtatggaagaaaatggaagttactgcttagtggttaaatgatttctgtttgggatga

SEQ ID NO: 113287 - DNA, 601 bp, Human
aacatttctccaaggaagatatacaaatggccaataagcacatgaaaagatgttcactatcattaatcattaaacaaatgcaatcaaaatcaaatggagataccacttcatactaactagggtgactataatttagaaaaaaaaacacagaaactaacaagtgttggtgagaatgtggataaatcagaacatgcacattgctgatagaaatgtgaaatggtgcagccactatagataaaaggttaacagtacctcaaaaagccaaacacagaattaccacatgacccggaaggtccatttstaggtacacactccaaaaacctgaaaacagctactcaaacagacacttgtatgtcaatgttcattgaagcattcttcacaaaaattaaaaggtaaagacaatacaagtctccatcaacaggtgagtagataaacaaaaggttgtatatacatatattatccaaatataaaaaggaatgaagttttgatacgtgctgccaaacggatgaacctcaaaagcattatgctaagcgaaataagccagacacaaaaggaaaatattgtatgattccacttacatgaaatatttaaaatagaaaaa

SEQ ID NO: 113288 - DNA, 601 bp, Human
aaaagacttgaataaacatttctccaaggaagatatacaaatggccaataagcacatgaaaagatgttcactatcattaatcattaaacaaatgcaatcaaaatcaaatggagataccacttcatactaactagggtgactataatttagaaaaaaaaacacagaaactaacaagtgttggtgagaatgtggataaatcagaacatgcacattgctgatagaaatgtgaaatggtgcagccactatagataaaaggttaacagtacctcaaaaagccaaacacagaattaccacatgaccyggaaggtccatttctaggtacacactccaaaaacctgaaaacagctactcaaacagacacttgtatgtcaatgttcattgaagcattcttcacaaaaattaaaaggtaaagacaatacaagtctccatcaacaggtgagtagataaacaaaaggttgtatatacatatattatccaaatataaaaaggaatgaagttttgatacgtgctgccaaacggatgaacctcaaaagcattatgctaagcgaaataagccagacacaaaaggaaaatattgtatgattccacttacatgaaatat

SEQ ID NO: 113289 - DNA, 601 bp, Human
agattttaatgaggattacactgaatcaatcaataggttagggaagaaatgacatcttaaccaaattgaattttctgattcataaacactgtaaatctctccatttactcatccttaaatgaatcttaacaatgttctgtagtattcagtatagagatcttgcatggcttttgttaaatgtattcctaataatttactatttttggtgaaattatcaacgcaaaaattcagttttgcttctatacaccagcaataaaaatcaaaagaaaaaaaaggaaaggacatttttaaaaacttacartagggttaggcacggtggctcacgcctgtaattccagcactttgggaggtagaggtgtgaggacagcttgagcccaggagttcgagatcagcctgggcaagaaagcaagaccttatctctacaaaaaaatttaataattagccaaatatagtggcacatgcctgtagtcccggctccttaggagactgaggtgggaggattgcttgagcctgggaggtcaaggctatagtgagccatgatcataccactgcactccagcctgagcaacagagtgaaactctgtctcaaaaaaaaaaaatg

SEQ ID NO: 113290 - DNA, 601 bp, Human
ttctaaagtgtgtgtctcatcattttaattggcatttctctaatgacacaaagatggtgaagatcttttcttttgtttattgctatctgtataccttctttggtgaagtgtctgttcaaatcttttactcttgtttgcactgagctgtttgactcattactgccttgtaagaagttacttacatattgtaaataaatagtcttggttggatatatgtattacaaatattttctacaagtctttggctttttcattttctaaataatttcttttgaagaccaaagttctttattttagtaaygtcaaaattatccatttaaaaattatataatttgtgctttttgtgacctatttaaggaatattttcctaaagtcattacaattttctactatgttttcttagacaagttttatggtttcagctgttatttttaggtatacaaactacttcagcttattaatttctatggtatgaagcacaggactgtatgtatgtatgtgtgtatatatatatacacacacacacacacacacacacacacacacacaatttcttttctcactaatctgttgcattaacatatatgtctttcttcctgct

SEQ ID NO: 113291 - DNA, 601 bp, Human
tagacccttgtttgtgaaagtccagaaaaagaataaaaccagtgattctatccaaccttcctatgacttaaaagaagcttcatttttaaaaatgcttttttttcttgttcagctttatggagggataatttataatgaataaaattaaccaacaaatcttgacaaatatatacagttacgtaaccatgaccaaaatcatgatattgaacatttcaaggatgtgaaaaaatttcttgctaccatttgcagtcaattccctccgtcagcattctggcaacagtgatctgctttctacgactayagttgtaccttttctagctacataagaaatactttaaaaataaaaaataaagaaacactttatgtaagatttttgagatgaatctatcctggtgcatatactagtagtatgttccttttcattgctgactaggattccattgtatgtatataccacaaattgtttacacatttacaaggtgatggatatctgggttgtttccagtttttggctatcatgaatgatgctgctctgaacatttgtattgacatgttttcctaactcttgggtaaataactaggagagtggaatgactgtatc

SEQ ID NO: 113292 - DNA, 601 bp, Human
agagggggtttcgtcatgttgcccaggctactctcaaactcctgtgctcaagcaatctgcctatcttggcctcccaaagtgctaggattacaggcatgagccaccacgcccagccaaaattcgttttttaatattattattaccttttatattgttgttattaatataattatattaatgaaaatgattttaaaacaaagatcagtaaactttaaaggaaactgctatatgttagctgacacaggtcaaaggagtaatctctgaaaacgaaattgttgtataagtatatatgtaaaatatyttgtaaaataaagtattttagtttctttctttaaagtattgtaaagtatatatgaaataccctgtaaaaggtgaagccttacacaaacagtattatttcatgcaaaaagtacaaaagtgcatacttacccttctcctcccattcttgttatttttagacgaaaatccacagaattcagactgggaggcttccatttcaaaatatcatcacatcgaccaggtttgtatttctaaagccaattaaaatgatgacaatcgttactaagaagttaaaaattaaacattcaatgtattaaaccta

SEQ ID NO: 113293 - DNA, 601 bp, Human
gacttatttcgatatgcttaattataataccaatgatcatatcttatatctagatctataattcatataagagaattatttttcagtaaaatctcaaaatttagtaaaattttcactttacaatttaacaaagttcttttctttggggggaggtgtgcggcgggggaagtggtctcactctgtcacccaggctggagtgcagcagggtgcagtctcagctcactgctacctctgcctcccaggctcaaacaatcctcccacctcagcctcccgagtagctgggaccacaggtatgtgccamcaagcccaactaatttttctatttttggtagagagggggtttcgtcatgttgcccaggctactctcaaactcctgtgctcaagcaatctgcctatcttggcctcccaaagtgctaggattacaggcatgagccaccacgcccagccaaaattcgttttttaatattattattaccttttatattgttgttattaatataattatattaatgaaaatgattttaaaacaaagatcagtaaactttaaaggaaactgctatatgttagctgacacaggtcaaaggagtaatctctgaaaacg

SEQ ID NO: 113294 - DNA, 601 bp, Human
atttccttcaaagtaaaaaagacttatttcgatatgcttaattataataccaatgatcatatcttatatctagatctataattcatataagagaattatttttcagtaaaatctcaaaatttagtaaaattttcactttacaatttaacaaagttcttttctttggggggaggtgtgcggcgggggaagtggtctcactctgtcacccaggctggagtgcagcagggtgcagtctcagctcactgctacctctgcctcccaggctcaaacaatcctcccacctcagcctcccgagtagctrggaccacaggtatgtgccaacaagcccaactaatttttctatttttggtagagagggggtttcgtcatgttgcccaggctactctcaaactcctgtgctcaagcaatctgcctatcttggcctcccaaagtgctaggattacaggcatgagccaccacgcccagccaaaattcgttttttaatattattattaccttttatattgttgttattaatataattatattaatgaaaatgattttaaaacaaagatcagtaaactttaaaggaaactgctatatgttagctgacacaggtcaa

SEQ ID NO: 113295 - DNA, 601 bp, Human
tgtacactgggcactttgtcaggaagactaatcttgaatgttcaacatatcaatatttatccaatgtttagataagagaaagacatttttgaaactatcctgaaagtcattcctgtgtgtgtattccagctattcctatagcctcaaatttatctatccttggattataatcagactcatatagagctcaatatattcttgggggttccagataattgttctaacaactttttgccattaagtcccaattgtaaattaagccacaaacatttagggatagtgtgtgtgtgtgtgtgtgtggttctttttctttcttttttttttgagacagagacttgctctgggctcaagcaatcctgccacctcagcctcccaagtagctggaaccacaggcatgcaccaccatacccggctaatttttgtttgttttagaaacagggcctccttattttgcccagactggtctcaaattcctggcctcaagtgatcctcccaccttggcctcccaaagtgctggaattacaggcatgagccactgcacccagcctcaaataaaatgttaaataccctgttgtttgaaaacgaatacccacatgcttta

SEQ ID NO: 113296 - DNA, 601 bp, Human
atttttctaatagtgagatggtcttctgtaaggcacttccagaagaacatatcaaacctacacccaacttgcatgattagtgataaacaatcccacatttgactggcaactgagaaaatctgtacactgggcactttgtcaggaagactaatcttgaatgttcaacatatcaatatttatccaatgtttagataagagaaagacatttttgaaactatcctgaaagtcattcctgtgtgtgtattccagctattcctatagcctcaaatttatctatccttggattataatcagactcatrtagagctcaatatattcttgggggttccagataattgttctaacaactttttgccattaagtcccaattgtaaattaagccacaaacatttagggatagtgtgtgtgtgtgtgtgtgtgtttctttttctttcttttttttttgagacagagacttgctctgggctcaagcaatcctgccacctcagcctcccaagtagctggaaccacaggcatgcaccaccatacccggctaatttttgtttgttttagaaacagggcctccttattttgcccagactggtctcaaattcctggcctc

SEQ ID NO: 113297 - DNA, 601 bp, Human
tattgagtatacataaatcttcagcacaaccaatctacaaaataaacattattcctgtggacattttacagatgaggaaggttaggtaggttaagttaacaagaccacacagcaaataagtagtggaacttggatttggttctgggcaaacttggccaataacctatgttcttaaccactatatgctatatataccagtatatatactgtcaaggttattttaagagacttgttacaaaaacctctataatgaaaagttactgactttgctgtgctcttgctctccaggtgtttaacagtkatgacaaattacacaaaaaagctaaagatatatgcattttaaaagagaaaattaacagagattggaatcaaataggaaatgattcacacagaaagttggacttagtgcagcaagtaacaggtagtattgcagaggcagcaagaagggaagatgcacttttaaatttgttttgattaaaacaataaaaataatggcaaatatttaaacgtttaccatgtaccaggttctgttctaaacattttacatacattagcttatttaatccttacagacgtcttatgaggccaacttattttattg

SEQ ID NO: 113298 - DNA, 601 bp, Human
cattcagggcactttttttccacttgataatacagagttatgtttttaatccatgacttaaccatacattctgctgaggttcaattaataattataaccattttttaaagcaaacatttatttattgagttttatgctgaatttacatgcatcatttatttaatccccacaaaacctgataaagtagtattattttttcatcttagcccattagcttgtaaattctataaaggcagacttatatttactttgtttacccatgcaattaaatattgagtatacataaatcttcagcacaacmaatctacaaaataaacattattcctgtggacattttacagatgaggaaggttaggtaggttaagttaacaagaccacacagcaaataagtagtggaacttggatttggttctgggcaaacttggccaataacctatgttcttaaccactatatgctatatataccagtatatatactgtcaaggttattttaagagacttgttacaaaaacctctataatgaaaagttactgactttgctgtgctcttgctctccaggtgtttaacagttatgacaaattacacaaaaaagctaaagata

SEQ ID NO: 113299 - DNA, 601 bp, Human
ttcacagcaaagtgaggcttcttcattcagggcactttttttccacttgataatacagagttatgtttttaatccatgacttaaccatacattctgctgaggttcaattaataattataaccattttttaaagcaaacatttatttattgagttttatgctgaatttacatgcatcatttatttaatccccacaaaacctgataaagtagtattattttttcatcttagcccattagcttgtaaattctataaaggcagacttatatttactttgtttacccatgcaattaaatattgagyatacataaatcttcagcacaaccaatctacaaaataaacattattcctgtggacattttacagatgaggaaggttaggtaggttaagttaacaagaccacacagcaaataagtagtggaacttggatttggttctgggcaaacttggccaataacctatgttcttaaccactatatgctatatataccagtatatatactgtcaaggttattttaagagacttgttacaaaaacctctataatgaaaagttactgactttgctgtgctcttgctctccaggtgtttaacagttatgacaa

SEQ ID NO: 113300 - DNA, 601 bp, Human
gctgtgtttctgtttttaattaaatccaaactggtatgtctattaacatcacacaactatgtgtgaatgtaaaatcaaacaacaaatgtagatgctaggtctgagttcaacctcaaagctctaggaaatcttgtatctcaacagactagaccaatttctaaaagatactattagagatttttagaatactattagcaactttcctggaaacacatacaggaagacacatgtatacaactatattttacaaaagacttttacagtgaaaaagacattgaatatttccagtttctcactattrtaatgatgcttcaataaaattattatacacatacttttacatattcttatttgtttgtatatacattccatcactgaatatttctggagtgcctactataaacaagtcaccatgctatgtactaagaatacaactatgtagaagacaaacaacatctctcctttcacaaaattggagcatattttctcaggacatatactaccttaatgcccattgaaagagttgtaccaacttctgttcctaccaaacagtttaggagagtacctatttgctcacattctaaccaaaagggacaatgtt

SEQ ID NO: 113301 - DNA, 601 bp, Human
gattaacaatcactgtggattttgaagcagtactccaactcattgaccaaggaacctgttaggctaccatttttaagttgaaatcagaacaaaagatggctctgcagcaagttcatgctatagtataagctgctctgccacttgggccttataacccagtatatcaattgtctggagcctctgaatccttcctccaagatcttgtggcaagaatgacagctgggcagcaactggcttcttatgaaccctataaggcctcctccaatcttctaaattttaataatctaccctcatttcttcrttaccccagttcgctgcatggtagacgcttcctgcagtgcttgcttcctctgcaagactttttcatctcttcagttctttcgtaacagacaattcttcaactaaattcattctgttaaaatatttgctgtgtttctgtttttaattaaatccaaactggtatgtctattaacatcacacaactatgtgtgaatgtaaaatcaaacaacaaatgtagatgctaggtctgagttcaacctcaaagctctaggaaatcttgtatctcaacagactagaccaatttctaaaagatactattaga

SEQ ID NO: 113302 - DNA, 601 bp, Human
tgctaagacacatgtaagacagaagacataaaacccacaaaaattaagagcccattgcctaagtaagatttctaggggtccaatggttggaagcctatcaggatagcttctccaaggtgtcagagacaagttactctacttgcactatcagtggatactaaaaaggacgttacaaagattaacaatcactgtggattttgaagcagtactccaactcattgaccaaggaacctgttaggctaccatttttaagttgaaatcagaacaaaagatggctctgcagcaagttcatgctatagtrtaagctgctctgccacttgggccttataacccagtatatcaattgtctggagcctctgaatccttcctccaagatcttgtggcaagaatgacagctgggcagcaactggcttcttatgaaccctataaggcctcctccaatcttctaaattttaataatctaccctcatttcttcattaccccagttcgctgcatggtagacgcttcctgcagtgcttgcttcctctgcaagactttttcatctcttcagttctttcgtaacagacaattcttcaactaaattcattctgttaaaatatt

SEQ ID NO: 113303 - DNA, 601 bp, Human
ccttctggccaggcatgttggctcacacctgtaatcccagcactttgggaggccgaggcacgtggatcacttgaggtcaggagtttgcgaccagcctggccaacactgtgaaaccccacccctattaaaattataaaaaatcagcccagcatggtggcaggcacctgtaatcccagctactctggaggctgaagcaggagaatcgcttgaacccgggaggtggacggtacagtgagctgagattgcaccactgcactccagcctgggcaacagagtaagtctctatctcaaaacaaacaaacaacaacaaaaatacctaagcctcccaatacaagtgggaggccagatccccttaaagaaggtattgcaatactactacaaccatgtacagtactgtaaatccacagttggcaaactatagtctacaggccacatctggcctcacacctgtttttgtaaataaagtttcactgtgacacagtcatgctcactcatacacatattgtctagctttgatttagcaccacaatggtagacttgagtagttgagatacataggcaacaaaccctaaaatattgactatctggcctttcatagaaa

SEQ ID NO: 113304 - DNA, 601 bp, Human
tacctggttaacaaaccagaaccttctggccaggcatgttggctcacacctgtaatcccagcactttgggaggccgaggcacgtggatcacttgaggtcaggagtttgcgaccagcctggccaacactgtgaaaccccacccctattaaaattataaaaaatcagcccagcatggtggcaggcacctgtaatcccagctactctggaggctgaagcaggagaatcgcttgaacccgggaggtggacggtacagtgagctgagattgcaccactgcactccagcctgggcaacagagtaagwctctatctcaaaacaaacaaacaacaacaaaaatacctaagcctcccaatacaagtgggaggccagatccccttaaagaaggtattgcaatactactacaaccatgtacagtactgtaaatccacagttggcaaactatagtctacaggccacatctggcctcacacctgtttttgtaaataaagtttcactgtgacacagtcatgctcactcatacacatattgtctagctttgatttagcaccacaatggtagacttgagtagttgagatacataggcaacaaaccctaaaatattga

SEQ ID NO: 113305 - DNA, 601 bp, Human
agcttccaaacccagctcattctatttttttttttaatgaattgaagcaaaagaaatacacacacacacacacacacacacacacacacacatacactctagtcagcagagtaaaaagacttttccgataggaagtaaaggagaccatgcagtcaattctatatattccattctgcttgctaggaagctagcatttctcagttttaaatgtgcagaccttacctggttaacaaaccagaaccttctggccaggcatgttggctcacacctgtaatcccagcactttgggaggccgaggcasgtggatcacttgaggtcaggagtttgcgaccagcctggccaacactgtgaaaccccacccctattaaaattataaaaaatcagcccagcatggtggcaggcacctgtaatcccagctactctggaggctgaagcaggagaatcgcttgaacccgggaggtggacggtacagtgagctgagattgcaccactgcactccagcctgggcaacagagtaagtctctatctcaaaacaaacaaacaacaacaaaaatacctaagcctcccaatacaagtgggaggccagatccccttaaagaag

SEQ ID NO: 113306 - DNA, 601 bp, Human
aattcaaataagcatgagaaaacgatttttttttttttttcccagagatgagatcttgctgtattgcacaggctggattcaaactcctagggctcaagcaatcctcctgcctcagcttccaaacccagctcattctatttttttttttaatgaattgaagcaaaagaaatacacacacacacacacacacacacacacacacacatacactctagtcagcagagtaaaaagacttttccgataggaagtaaaggagaccatgcagtcaattctatatattccattctgcttgctaggaagytagcatttctcagttttaaatgtgcagaccttacctggttaacaaaccagaaccttctggccaggcatgttggctcacacctgtaatcccagcactttgggaggccgaggcacgtggatcacttgaggtcaggagtttgcgaccagcctggccaacactgtgaaaccccacccctattaaaattataaaaaatcagcccagcatggtggcaggcacctgtaatcccagctactctggaggctgaagcaggagaatcgcttgaacccgggaggtggacggtacagtgagctgagattgcac

SEQ ID NO: 113307 - DNA, 601 bp, Human
cccccatacttaatccttccttatataagaacagttcttcaacattcagaaaaatattttaccaccacaatttccttctcaaaaagagtaacactaattcaaataagcatgagaaaacgatttttttttttttttcccagagatgagatcttgctgtattgcacaggctggattcaaactcctagggctcaagcaatcctcctgcctcagcttccaaacccagctcattctatttttttttttaatgaattgaagcaaaagaaatacacacacacacacacacacacacacacacacacayacactctagtcagcagagtaaaaagacttttccgataggaagtaaaggagaccatgcagtcaattctatatattccattctgcttgctaggaagctagcatttctcagttttaaatgtgcagaccttacctggttaacaaaccagaaccttctggccaggcatgttggctcacacctgtaatcccagcactttgggaggccgaggcacgtggatcacttgaggtcaggagtttgcgaccagcctggccaacactgtgaaaccccacccctattaaaattataaaaaatcagcccagcatg

SEQ ID NO: 113308 - DNA, 601 bp, Human
tcccccatacttaatccttccttatataagaacagttcttcaacattcagaaaaatattttaccaccacaatttccttctcaaaaagagtaacactaattcaaataagcatgagaaaacgatttttttttttttttcccagagatgagatcttgctgtattgcacaggctggattcaaactcctagggctcaagcaatcctcctgcctcagcttccaaacccagctcattctatttttttttttaatgaattgaagcaaaagaaatacacacacacacacacacacacacacacacacacatacactctagtcagcagagtaaaaagacttttccgataggaagtaaaggagaccatgcagtcaattctatatattccattctgcttgctaggaagctagcatttctcagttttaaatgtgcagaccttacctggttaacaaaccagaaccttctggccaggcatgttggctcacacctgtaatcccagcactttgggaggccgaggcacgtggatcacttgaggtcaggagtttgcgaccagcctggccaacactgtgaaaccccacccctattaaaattataaaaaatcagcccagcat

SEQ ID NO: 113309 - DNA, 601 bp, Human
aaagaggcagagggtagaaaacagaaaaatgctgctcagcaaagtagtaagactttttcccccatacttaatccttccttatataagaacagttcttcaacattcagaaaaatattttaccaccacaatttccttctcaaaaagagtaacactaattcaaataagcatgagaaaacgatttttttttttttttcccagagatgagatcttgctgtattgcacaggctggattcaaactcctagggctcaagcaatcctcctgcctcagcttccaaacccagctcattctatttttttttttaatgaattgaagcaaaagaaatacacacacacacacacacacacacacacacacacatacactctagtcagcagagtaaaaagacttttccgataggaagtaaaggagaccatgcagtcaattctatatattccattctgcttgctaggaagctagcatttctcagttttaaatgtgcagaccttacctggttaacaaaccagaaccttctggccaggcatgttggctcacacctgtaatcccagcactttgggaggccgaggcacgtggatcacttgaggtcaggagtttgcgaccagc

SEQ ID NO: 113310 - DNA, 601 bp, Human
ttcaagatttgtttgcagttcttcccatctcatctctcatgagggtctgcattcaaatcctatgttcctaagttacttcattttcccccccaccaacttcaatgtgattcaaagtaggaatttaactaatatttaatctatataatatccaccaggtaacaagctttttataacataaaaggtaacttagagaaattgcaattaatgaaaatatatattaattgagaaaaatcacataagcgaaaggtactaatgtaaagaatagtgttaaaatgaatatgaaaattaaattccaaagaaycaaattataaaacaaaggtgatatatacttctatttagtaaattaacaagtaaaaataagtaatttgactccagtgaggtcataagtagatgttttaaagccacatgctccttttctcctactagttacttgtagacactttgattatgatgttggtttttggtaagcggcctgggaaagattttctgctgaatgcaggaaggatgaaataacagaggaaacaagagttactaatacccaagagataaccaggcaaaggaactgaaaagagttcagtcacagctcctccttgcctctcct

SEQ ID NO: 113311 - DNA, 601 bp, Human
agtagtttggcgtttcacaaccataattacagcaaaaaacaaacctaataaaaaaggagttcaagatttgtttgcagttcttcccatctcatctctcatgagggtctgcattcaaatcctatgttcctaagttacttcattttcccccccaccaacttcaatgtgattcaaagtaggaatttaactaatatttaatctatataatatccaccaggtaacaagctttttataacataaaaggtaacttagagaaattgcaattaatgaaaatatatattaattgagaaaaatcacataagcraaaggtactaatgtaaagaatagtgttaaaatgaatatgaaaattaaattccaaagaatcaaattataaaacaaaggtgatatatacttctatttagtaaattaacaagtaaaaataagtaatttgactccagtgaggtcataagtagatgttttaaagccacatgctccttttctcctactagttacttgtagacactttgattatgatgttggtttttggtaagcggcctgggaaagattttctgctgaatgcaggaaggatgaaataacagaggaaacaagagttactaatacccaa

SEQ ID NO: 113312 - DNA, 601 bp, Human
tattcaaatattttaaaaattctaatccatctcacagagttcttcactgccttcctccatttcatatttgtatctttctccttcctcactgagaaccctgactcccaacatcagtacccatttgctcaatcctacaacacttctaaagtagtttggcgtttcacaaccataattacagcaaaaaacaaacctaataaaaaaggagttcaagatttgtttgcagttcttcccatctcatctctcatgagggtctgcattcaaatcctatgttcctaagttacttcattttcccccccaccamcttcaatgtgattcaaagtaggaatttaactaatatttaatctatataatatccaccaggtaacaagctttttataacataaaaggtaacttagagaaattgcaattaatgaaaatatatattaattgagaaaaatcacataagcgaaaggtactaatgtaaagaatagtgttaaaatgaatatgaaaattaaattccaaagaatcaaattataaaacaaaggtgatatatacttctatttagtaaattaacaagtaaaaataagtaatttgactccagtgaggtcataagtagatgttt

SEQ ID NO: 113313 - DNA, 601 bp, Human
aatgttccacatttgggatttgtttaatgcttcctcattatcagattagagctagatacccatagtcagaatgctaggtatagtactgaactagtacataatgttcattttatcctcactgctgatgttaactctgataagctagtaaggggttgtccaatttctcaactctctagtctattattttgcccttgcaagttataagcaatccacagaaagacatttacaaccatgaaaatatcttataaaaatttccctcccagacttagcatccattgattattcttttttatttatttttgctgtattttatttatttatttttttattatactttaagttctggggtacatgtgcacaatgtgcaggtttgttacatatgtatacatgtgccatgttggtgtgcttcacccattaactccattgattattctcactagagctgatctttactatggtggtggcaaaataattttccaaatccaggactcagaacatttaccaatcagcattctgctaaaagctaaaccatctcttctgctcatttattaccagtatggcagtatggactcatagattcctatttttagcaaagttcata

SEQ ID NO: 113314 - DNA, 601 bp, Human
agaatgttccacatttgggatttgtttaatgcttcctcattatcagattagagctagatacccatagtcagaatgctaggtatagtactgaactagtacataatgttcattttatcctcactgctgatgttaactctgataagctagtaaggggttgtccaatttctcaactctctagtctattattttgcccttgcaagttataagcaatccacagaaagacatttacaaccatgaaaatatcttataaaaatttccctcccagacttagcatccattgattattcttttttatttattattgctgtattttatttatttatttttttattatactttaagttctggggtacatgtgcacaatgtgcaggtttgttacatatgtatacatgtgccatgttggtgtgcttcacccattaactccattgattattctcactagagctgatctttactatggtggtggcaaaataattttccaaatccaggactcagaacatttaccaatcagcattctgctaaaagctaaaccatctcttctgctcatttattaccagtatggcagtatggactcatagattcctatttttagcaaagttca

SEQ ID NO: 113315 - DNA, 601 bp, Human
tcattttaaaaggtcaatgctccctcctcgtaagagagagaaaaacaaaaagcccttaagtgattaacgtttggcaaaagtgtttgtgaattgttccttaataattacaatttttgataagaaattaccaaaattaattttataactgctgtgataattgtaattcagaaattcaatttagaaaataatcactgaatacactccagtgcccggtacacagaaaggaataaatgaactaacgctcaaccaagaaggggatagtcaagtacacaaggcaagcctcagagctattatactttcrtcgaaaggtgtctattgctccaggtagtttttgaccatctgaaattatgtatattttaagtaaaaattcctcagattttgtttgatgaaactgacatatttgaataatacagagaccctttaaaaaacacagaatgttccacatttgggatttgtttaatgcttcctcattatcagattagagctagatacccatagtcagaatgctaggtatagtactgaactagtacataatgttcattttatcctcactgctgatgttaactctgataagctagtaaggggttgtccaatttctcaa

SEQ ID NO: 113316 - DNA, 601 bp, Human
cacacactgatacactataaatgtatatcagttactggtccctgaggatatgtgatcatgtatttgctatgtccgaaaaccagaggatctcagcatgatagttttggcaatgacctaccacagtgaaacaaaaaggatggagatacatgaatgggagaaaagatccacaacaaattcaaggaaaagcaagcaggacaggtagtattagtatcaagctaggatgaatttaggattaaaagcaataaaaagaagtacatgatttaataacaaaaagcatgatttgggtgacagaaatatcaaytgtatatctggagaaatcaaacctagtatctaaatacaaaggtattaaatatgcaaagcaaacttaattataatgtaaggcttcaagtatctcttatatggggtagagctagtaaagagagtaaaggaatttactaatataaactttaatacttaattgcataatcaaagagaaaatgttgtattctttaaatagtaaaaataatttcactgttgttatgtctaagaaatatccagaaaagacaacatatgatgttatagacaagattaacaaaatgttttcaaaagattttacagacta

SEQ ID NO: 113317 - DNA, 601 bp, Human
ttaacaactaacatccactatgccacactgctacattaccaactaatttcacaaaaggactagtcatcaaacacgtaaccacacactgatacactataaatgtatatcagttactggtccctgaggatatgtgatcatgtatttgctatgtccgaaaaccagaggatctcagcatgatagttttggcaatgacctaccacagtgaaacaaaaaggatggagatacatgaatgggagaaaagatccacaacaaattcaaggaaaagcaagcaggacaggtagtattagtatcaagctaggaygaatttaggattaaaagcaataaaaagaagtacatgatttaataacaaaaagcatgatttgggtgacagaaatatcaattgtatatctggagaaatcaaacctagtatctaaatacaaaggtattaaatatgcaaagcaaacttaattataatgtaaggcttcaagtatctcttatatggggtagagctagtaaagagagtaaaggaatttactaatataaactttaatacttaattgcataatcaaagagaaaatgttgtattctttaaatagtaaaaataatttcactgttgttatgt

SEQ ID NO: 113318 - DNA, 601 bp, Human
gcccccgctgaaggctgtgggtttactggaatgaggtcaaggaacacctggcctacccagggaggaaaaccacttaaaggcgttcttaaaccacaaacaatatcatgagtgatctgtgccttaaggacatgttcctgctgcagataactagccagacccatccctttattttggcccattcctttgtttcccataaggaatacttttagttaatctataatctatagaaacaatgctcatcactggcttgctgtcaataaatatatgggtaaatctctgttcgaggctctcagctctgaargttatgagacccctgatttccccactccacactctatatttctgtgtgtgtctttaatttctctagcgccactgggttggggtctccatgaccgagctggtcttggcagaaacctgtaaaggagccaaaaggcaattagaaggagaaaagaactgcaccccaagaattctatatccaggtaagacatgatttgcctgtctggaaaaaggaagacgttagcagttaggcaaaaaattcagattaaaaatctatatattcccatctgagaaaattactccaaagaacaaatgaatgtgaaca

SEQ ID NO: 113319 - DNA, 601 bp, Human
ggaaaatgggaataaagtaacttgttgggaacaggcacccaaatctggccataaactggcccctaaactggccataaacaaaatgtctgcagcactgtgacatgttcgtgatggccatgatgcccccgctgaaggctgtgggtttactggaatgaggtcaaggaacacctggcctacccagggaggaaaaccacttaaaggcgttcttaaaccacaaacaatatcatgagtgatctgtgccttaaggacatgttcctgctgcagataactagccagacccatccctttattttggcccatycctttgtttcccataaggaatacttttagttaatctataatctatagaaacaatgctcatcactggcttgctgtcaataaatatatgggtaaatctctgttcgaggctctcagctctgaaagttatgagacccctgatttccccactccacactctatatttctgtgtgtgtctttaatttctctagcgccactgggttggggtctccatgaccgagctggtcttggcagaaacctgtaaaggagccaaaaggcaattagaaggagaaaagaactgcaccccaagaattctatatccagg

SEQ ID NO: 113320 - DNA, 601 bp, Human
ctctatctcctagccagttccttctaaaatacagataatatcaattccatttactactgttcactacctctccagggtaagtcctaattccttactctggctttcctgatctatcacagtgtgatcctggcctgatttatttacttccattaactctagttattagataaacattcccgagttccacgccttctttcaggctatgctttctgtcttgaatgtcattcctacatatttataaagttttattcaagtgaaccatcttctctggaaccttcttggtcctattactaacaatgamaatgttttcatattttaccttacattttttctgttttatatgtggaatatataaaattgtctaggctccttcactaaccttacttactctaatagtatagcatttggcacagtaatagttatttatatctgccatcctagtcaggttttcactcctccaggatagggcttatccatcgttttattcacagcacctaacaatgtggtttgcacatagatggttttcaataaatgcttactgaatagtgatgaatcagttataactagcactgctacttagaacaatgaaagtttaaaagta

SEQ ID NO: 113321 - DNA, 601 bp, Human
tcttacacatgggttaagggtcattatagtagaaagagataaagaaaagctctaggaacttcctttgcctggcaaaatagtaatccaaaagcaatattgtgttggggcagggggtgggcatcaaaatttgaaagaagcaggaatggtgatatctatcacattcccatttaattatcagtccgtcctgcacatacatacatcatataaatctcaaatggctgtgaacaattataaacctcaacctttttcccaaaccactcatcccacattcttccctatggaattaatcatggctcctctytctcaaatctgtcagctcaatataccacttacgctttaatctaggaagcagaaccatccagtgatatagaatcaggagtttattataagagttaggccttatactactgtggtagaagcgagggagtaaagatcctgaaggagatagttggaggatcagaaaaatacttctaaccagagaccattaatgggagcttgtgaagaagtctataaaagcctgtatccccgtgtttgatggtgagcctaaagtctatgacagcagggcagacagttgggaagaaagcctggacataaaatagga

SEQ ID NO: 113322 - DNA, 601 bp, Human
atactggtctggcctgggggttgggcacccctgtactagaatgattatgtcatggagaaaaattaatatccagacctttcagaaatactctatactgattccagggaagtgatgccaactcttggggcacaacacgctactatgacacaacacatcaaagtgaagacttaaagaaatcaggtgatgggtgaagtcttaacacaagtttgacccatagcagacccagtcagtccacagactcaccctgtggtactttctcctattcctgaatgtataattggaatagacatacttaataacyggcagaatccccataggcactctcttacacatgggttaagggtcattatagtagaaagagataaagaaaagctctaggaacttcctttgcctggcaaaatagtaatccaaaagcaatattgtgttggggcagggggtgggcatcaaaatttgaaagaagcaggaatggtgatatctatcacattcccatttaattatcagtccgtcctgcacatacatacatcatataaatctcaaatggctgtgaacaattataaacctcaacctttttcccaaaccactcatcccacattcttcccta

SEQ ID NO: 113323 - DNA, 601 bp, Human
cttacccagttttcagatataagtcagtcccaacacccaaaggcccctgatgcaaggggaggccaggtccccttgcagaaagaccctgtagttttgccacaagtatatgctttaaattatgtaccaaatcatccccagaagggcctattgctatctactagagcagcggtcctcaacctttttggcaccaggaaccagttttatgtaagatgatttttccacaaatgtgggtgggggaatgctttggggaaaatttcatgtcaaatcatcaggcattagttagattctcataaggagcacrcaacttagatcccttgcatgagcagttcacgatggggtttgtgctcctatgagaatctaataccgccactgatctgacaggaggtagagctcaggtgttaatgcttgctcctccgccacttacctcctgctgttgcagcttggttctaacaggccacagacctatactggtctggcctgggggttgggcacccctgtactagaatgattatgtcatggagaaaaattaatatccagacctttcagaaatactctatactgattccagggaagtgatgccaactcttggggcacaacacgc

SEQ ID NO: 113324 - DNA, 601 bp, Human
caaccaactggctgctccctgtggtccagctgtggcctgccactcccctcttacccagttttcagatataagtcagtcccaacacccaaaggcccctgatgcaaggggaggccaggtccccttgcagaaagaccctgtagttttgccacaagtatatgctttaaattatgtaccaaatcatccccagaagggcctattgctatctactagagcagcggtcctcaacctttttggcaccaggaaccagttttatgtaagatgatttttccacaaatgtgggtgggggaatgctttggggaaratttcatgtcaaatcatcaggcattagttagattctcataaggagcacgcaacttagatcccttgcatgagcagttcacgatggggtttgtgctcctatgagaatctaataccgccactgatctgacaggaggtagagctcaggtgttaatgcttgctcctccgccacttacctcctgctgttgcagcttggttctaacaggccacagacctatactggtctggcctgggggttgggcacccctgtactagaatgattatgtcatggagaaaaattaatatccagacctttcagaaatac

SEQ ID NO: 113325 - DNA, 601 bp, Human
acattttccagcaagtttcttcacaaccaactggctgctccctgtggtccagctgtggcctgccactcccctcttacccagttttcagatataagtcagtcccaacacccaaaggcccctgatgcaaggggaggccaggtccccttgcagaaagaccctgtagttttgccacaagtatatgctttaaattatgtaccaaatcatccccagaagggcctattgctatctactagagcagcggtcctcaacctttttggcaccaggaaccagttttatgtaagatgatttttccacaaatgtkggtgggggaatgctttggggaaaatttcatgtcaaatcatcaggcattagttagattctcataaggagcacgcaacttagatcccttgcatgagcagttcacgatggggtttgtgctcctatgagaatctaataccgccactgatctgacaggaggtagagctcaggtgttaatgcttgctcctccgccacttacctcctgctgttgcagcttggttctaacaggccacagacctatactggtctggcctgggggttgggcacccctgtactagaatgattatgtcatggagaaaaatta

SEQ ID NO: 113326 - DNA, 601 bp, Human
cagagcagtgaagggacactacaagggcatagcctgggttctggtttggatgtttttctatgatgcagttgtcagctaaatattgtgtgggaagcctggtggcactcacctgcaaggctctagcagaccagctctagcctgccggtattctatggcaaatttccccaccaccaaagagtggcttctagcagaccaactctgattttccaacattttccagcaagtttcttcacaaccaactggctgctccctgtggtccagctgtggcctgccactcccctcttacccagttttcagatayaagtcagtcccaacacccaaaggcccctgatgcaaggggaggccaggtccccttgcagaaagaccctgtagttttgccacaagtatatgctttaaattatgtaccaaatcatccccagaagggcctattgctatctactagagcagcggtcctcaacctttttggcaccaggaaccagttttatgtaagatgatttttccacaaatgtgggtgggggaatgctttggggaaaatttcatgtcaaatcatcaggcattagttagattctcataaggagcacgcaacttagatcccttgcat

SEQ ID NO: 113327 - DNA, 601 bp, Human
tttgcatacactctccaagaacctattaactagaaaaaggaaagcagcaactttaaagaagagaaactccgcatataccacctttaacagtgatgaaggttaacattaccagtaatgagacatatctatatcatctactctgatatgacacactgaaaacagcacatcatttctgtggtattcttgcaaaaagtgcgtaacctcaatctaattatgagaaagtaccagacaaagccaaatcgaggtattgggaatcaagttcgaggattccctagaagaactcaaaggactcagatgttgyactcacagttacaagttattacaacaaaaggatgcacagaaaatcagcaaagggaaaagacacatggggtgatacatattacactgatgttgaaatgacaacattttagatatattgagttaaataaaatatgttattggaattaatttcacctgtttctactttttattatggttactagaaaaatttaattacatgtgtgactcacatatttctatagaagagtgccggtctaaatacattagaagttacaaaatggtgatagtctattattccttcttcattacatggctggaaaac

SEQ ID NO: 113328 - DNA, 601 bp, Human
acaagctttcatgagttcatcatctcctgactatatgatttaacataaggaaataaaacagctttgtcaacaactagtaatcattctaaaatagttggtaagaataggattgttcttattactcctttttatttttcttttatttatttatttatttttttgagacagagttttgctcttgtcatccaggctggagtgcagtggcttgatcttggctcactgcaacctccacctcccgggtttaagcgattctcccacctcagcctccagagtagctaagactacaggcgcgcaccagcasgcccggctaatttttgtatttttagtagagatgaggtttcaccatgttggccaagatattctcgatctcctgaccttgtgatctatgcacctcaacctctcaaagtgctggtataacaggcatgagccaccgtgcccggcctgttcttactactctttataaatacagaagacaatagaagaagagaaaactaatcattacattagctcttttcctctagaaaacctgatttctgctattacatatgaatagttttttatgctatgatatgaggttgattcttaataagacaaagaattt

SEQ ID NO: 113329 - DNA, 601 bp, Human
attgtatgtatataccacattttgcttaaccattcatctacagacactatatcccttccacattttagctattgtgaataatgctgctataaacatgagggtataaatctctttgaaacctcattttcagaagcagaattgctggatcatatgataattctatttttaattttttgaggaatgaccatactgttttccacagcagccatgccaatagtttacttatttttaatgaagatagcaacaacatctactttataggtttagtatgatgaattgaaatgataaataaaaatggctyagtataaagcctaaaaacattttgttggtactcttcaccttttttcccccaaagaaataaaaataccatatttaagctacattttatgttgaatttatatttgcatttgtcactatacaataaatttcattatcaaacaagctttcatgagttcatcatctcctgactatatgatttaacataaggaaataaaacagctttgtcaacaactagtaatcattctaaaatagttggtaagaataggattgttcttattactcctttttatttttcttttatttatttatttatttttttgag

SEQ ID NO: 113330 - DNA, 601 bp, Human
taatattctattgtatgtatataccacattttgcttaaccattcatctacagacactatatcccttccacattttagctattgtgaataatgctgctataaacatgagggtataaatctctttgaaacctcattttcagaagcagaattgctggatcatatgataattctatttttaattttttgaggaatgaccatactgttttccacagcagccatgccaatagtttacttatttttaatgaagatagcaacaacatctactttataggtttagtatgatgaattgaaatgataaatawaaatggcttagtataaagcctaaaaacattttgttggtactcttcaccttttttcccccaaagaaataaaaataccatatttaagctacattttatgttgaatttatatttgcatttgtcactatacaataaatttcattatcaaacaagctttcatgagttcatcatctcctgactatatgatttaacataaggaaataaaacagctttgtcaacaactagtaatcattctaaaatagttggtaagaataggattgttcttattactcctttttatttttcttttatttatttatttat

SEQ ID NO: 113331 - DNA, 601 bp, Human
catggtggctcatgcctttaatcctagcactttgggggggccgaggcaggagaatcgcttgagcccagaatttgagaccagcatggacaacatagtaagacctcgtctctacaaaaaattaaaaaattagccaagcatagtagcacacacctgtggtcccagctactcgagaggctgaggtaaagaggatcacttgagtctgggaggtcaaggctgcagtgagctgtgatcaaatcactgcactccagcctgggtaacagacaccctgtctcaaaaaaacaaaaaaacaagaaaggaaagraagagaaaaaagaaaagaataagaataagatgcagccataaaaatgaatgagatcatgtcctttgcagggacatggatgaagctggaagccatcaccctcagcaaactaacacaggaacagaaaaccaaacactgcatgttctcactcataagtggaaggtgaacaatgagaacacatggacacaaggaggggaacaacacacaccaaggcctgttgaggggtggaggacgaggggagggaacgtaggcaaggatgggtcaataggtgctgcaaactaccatggcacacatatacctatg

SEQ ID NO: 113332 - DNA, 601 bp, Human
aaataattatatcttaaaattattccttactttagaaaactgacaccaatttatactttatgttattaatgtatgtgatgcaattatataaagaagataaaaaaactttctcaaattttcactgtagccaacagaaatcattaaaaagcttgattaaatgagataatgtatataaactacatacaagggaaatcaagcatattagaagcattaaacacacaaatgatactattcttattattaacaagctggtaagacaaaaggtgaagcaaatttatggaaccaagaactcttctaagawgcttattaaattagaggattcttcatgttgggccaatacccagcaattcacagtttaaacacttccagctggtaagtgtttttttgaggcaagcaagggaaatgaagaacaaagggagaaggcaaaactaagagaaaacagctttcctgtaacactaaagaaattcaaaagcatcattaaataaatacagaaacacagaaaaacatcactggaataatagagcagaaaaattttaagtaaacttatgtttatgtatgaaaacaagaaagtaattagagagcttttgcttttaggaactat

SEQ ID NO: 113333 - DNA, 601 bp, Human
aaagtctataaataaaatacacacacacacacacacacacacacaccccccttccaaaacaggaagaaataatgcattcacataaaagaaattttaaaatgaatgatgtataaataattactaaattaaaattcttaatgtaaaataattatatcttaaaattattccttactttagaaaactgacaccaatttatactttatgttattaatgtatgtgatgcaattatataaagaagataaaaaaactttctcaaattttcactgtagccaacagaaatcattaaaaagcttgattaaaygagataatgtatataaactacatacaagggaaatcaagcatattagaagcattaaacacacaaatgatactattcttattattaacaagctggtaagacaaaaggtgaagcaaatttatggaaccaagaactcttctaagaagcttattaaattagaggattcttcatgttgggccaatacccagcaattcacagtttaaacacttccagctggtaagtgtttttttgaggcaagcaagggaaatgaagaacaaagggagaaggcaaaactaagagaaaacagctttcctgtaacactaa

SEQ ID NO: 113334 - DNA, 601 bp, Human
acctggcaggcagaggttgcagtgagccaagatggcaccactgtactccagcctgggtgacagagtgagaccccgtctcaaaacattaataaataaataataacataccaatattggttcattaattgtaataaatgtgccatgttaataatagggtacactgtttgtggggggcccaagaggtgtatatgggaactttctgttctattaatatctactcaatttttctgtaaatttaaaactgttctggaaactaaagtctataaataaaatacacacacacacacacacacacacacaacccccttccaaaacaggaagaaataatgcattcacataaaagaaattttaaaatgaatgatgtataaataattactaaattaaaattcttaatgtaaaataattatatcttaaaattattccttactttagaaaactgacaccaatttatactttatgttattaatgtatgtgatgcaattatataaagaagataaaaaaactttctcaaattttcactgtagccaacagaaatcattaaaaagcttgattaaatgagataatgtatataaactacatacaagggaaatcaagcatatta

SEQ ID NO: 113335 - DNA, 601 bp, Human
aaggctgaggcaagagaatctcttgaacctggcaggcagaggttgcagtgagccaagatggcaccactgtactccagcctgggtgacagagtgagaccccgtctcaaaacattaataaataaataataacataccaatattggttcattaattgtaataaatgtgccatgttaataatagggtacactgtttgtggggggcccaagaggtgtatatgggaactttctgttctattaatatctactcaatttttctgtaaatttaaaactgttctggaaactaaagtctataaataaaatayacacacacacacacacacacacacaccccccttccaaaacaggaagaaataatgcattcacataaaagaaattttaaaatgaatgatgtataaataattactaaattaaaattcttaatgtaaaataattatatcttaaaattattccttactttagaaaactgacaccaatttatactttatgttattaatgtatgtgatgcaattatataaagaagataaaaaaactttctcaaattttcactgtagccaacagaaatcattaaaaagcttgattaaatgagataatgtatataaact

SEQ ID NO: 113336 - DNA, 601 bp, Human
gtattctagatgggatcctggaaaagaaaaaggacatcaagtaaaaactaaggaaatctgaataagctacagaccttagttaaaaataacacaccaagtctggcaaacatgtgaaaccctgtctctaccaaataatacaaaaattagctgggcatggtggcacatgcctgtaagtcctagctactcagaaggctgaggcaagagaatctcttgaacctggcaggcagaggttgcagtgagccaagatggcaccactgtactccagcctgggtgacagagtgagaccccgtctcaaaacatwaataaataaataataacataccaatattggttcattaattgtaataaatgtgccatgttaataatagggtacactgtttgtggggggcccaagaggtgtatatgggaactttctgttctattaatatctactcaatttttctgtaaatttaaaactgttctggaaactaaagtctataaataaaatacacacacacacacacacacacacacaccccccttccaaaacaggaagaaataatgcattcacataaaagaaattttaaaatgaatgatgtataaataattactaaattaaaat

SEQ ID NO: 113337 - DNA, 601 bp, Human
ataaaaagaattgtacagtaccctaagaaggggagagtgtaacttttcagtgtttaagtgtaggcttcacatagtgatttccttccaaagagtacagtatgaaaaggaggaagaaatgggttatctttaaaatggagaaaactcacaaaccctactttagccaggtggtcaaggtcaacatcaaaaatcataaaatcatgttcatagtatgtactcttgatacagtgtgatagaaatcgcacttcatctgtgatcttctttccctaaacccataccccaagtctgattatgagaaaaacaagagacaaattctaaatgaggagcatcctataatacatttgagcagtgcttctcacaactggcaatgtcattaaaaacgcggaaagtatgagaaaatgtcacagccaagagtaccctaaggagatatgacaactaaatgtaatgcagtattctagatgggatcctggaaaagaaaaaggacatcaagtaaaaactaaggaaatctgaataagctacagaccttagttaaaaataacacaccaagtctggcaaacatgtgaaaccctgtctctaccaaataatacaaaaattagctgggcat

SEQ ID NO: 113338 - DNA, 601 bp, Human
atcagataaacatgataaagcaaaactacagatgagtgtctctcaagaacattgtcataaactgaatgtgtgcaatgtagaactcgcagtcaatgaaattggatattcactcaggagaatgataactaacttctctaatactttgtttaggtgtctccatcatttaggaggagatacctaaacaaagtattaaaagagaagcttggttactccttatggcttatagtaaaatgcaagagaaagagaaataaagctactgttaggcaaaaaagaaccagaacttaaagatgtggcaaattckgtctgttcatatttcaaaagatgagggctttctgaggagaacaccaaggttgtgcctgtactaccactcagtaaagagactacgaaattatctgagcagatacactgccagtgtgaactgtaaaggactgaatgaaggaaggcagacttcatggattctacaagatggaaacatacaaccatcaggtggtgaacatgcattatccttcaagaaaaagtaacaacaccaaatgtgatttagagatcatcagagagctgccattctcaccacagtcttaaagggcaaggatgatttccttca

SEQ ID NO: 113339 - DNA, 601 bp, Human
cccagatattttcactgggtgtattatacaaacatttaagaaatgacatcaattttctataatctgtttcagaaaatagaagcagagaggatacttcctaactcattctatgagaacattaccttaataccaaaatcagataaacatgataaagcaaaactacagatgagtgtctctcaagaacattgtcataaactgaatgtgtgcaatgtagaactcgcagtcaatgaaattggatattcactcaggagaatgataactaacttctctaatactttgtttaggtgtctccatcatttargaggagatacctaaacaaagtattaaaagagaagcttggttactccttatggcttatagtaaaatgcaagagaaagagaaataaagctactgttaggcaaaaaagaaccagaacttaaagatgtggcaaattctgtctgttcatatttcaaaagatgagggctttctgaggagaacaccaaggttgtgcctgtactaccactcagtaaagagactacgaaattatctgagcagatacactgccagtgtgaactgtaaaggactgaatgaaggaaggcagacttcatggattctacaagat

SEQ ID NO: 113340 - DNA, 601 bp, Human
tctagccagactaatcaagaagaaaaaaacagaaggcatacatttaccaataccataagtgaaagaagggacatcactattaatcacatggatattaaaaggataataaaagaacactaagaacactctatgctcactaatttgataatttagataaagtggatcaattctttgaaaggcacaagctaccaaaagtcatagaaggagaaacagataatctaacaaggccaatatttattttaaaaattgaacctataattaacctttccaaaaataaagcactaggcccagatattttcastgggtgtattatacaaacatttaagaaatgacatcaattttctataatctgtttcagaaaatagaagcagagaggatacttcctaactcattctatgagaacattaccttaataccaaaatcagataaacatgataaagcaaaactacagatgagtgtctctcaagaacattgtcataaactgaatgtgtgcaatgtagaactcgcagtcaatgaaattggatattcactcaggagaatgataactaacttctctaatactttgtttaggtgtctccatcatttaggaggagatacctaa

SEQ ID NO: 113341 - DNA, 601 bp, Human
agccttggttatttgaaaagatttttataaattgataaatctctagccagactaatcaagaagaaaaaaacagaaggcatacatttaccaataccataagtgaaagaagggacatcactattaatcacatggatattaaaaggataataaaagaacactaagaacactctatgctcactaatttgataatttagataaagtggatcaattctttgaaaggcacaagctaccaaaagtcatagaaggagaaacagataatctaacaaggccaatatttattttaaaaattgaacctataataaacctttccaaaaataaagcactaggcccagatattttcactgggtgtattatacaaacatttaagaaatgacatcaattttctataatctgtttcagaaaatagaagcagagaggatacttcctaactcattctatgagaacattaccttaataccaaaatcagataaacatgataaagcaaaactacagatgagtgtctctcaagaacattgtcataaactgaatgtgtgcaatgtagaactcgcagtcaatgaaattggatattcactcaggagaatgataactaacttctctaata

SEQ ID NO: 113342 - DNA, 601 bp, Human
acaacttacttcagaataacacgagtgttaaaaaaaaaaaaaaagaaagaaagaaaaagaaaaagcagtcaagagaaatgttaaaatattttgaactaaattaaaatgaaaatacaaacttgccaaaatttgtgggatgcagtcaaagcagtgatttcagggaaatttacagcattgaaggcatttatttgaaaagatctaaaaccagaaacaagcttctatttttgaaaattctagagaacgagcaatttaaccttaaagcactcagaaaaaaagaaataataaaaattagggcagaaaycaatgaacttgaaaacaggaacaacagagaatatcaataaaaccaaagccttggttatttgaaaagatttttataaattgataaatctctagccagactaatcaagaagaaaaaaacagaaggcatacatttaccaataccataagtgaaagaagggacatcactattaatcacatggatattaaaaggataataaaagaacactaagaacactctatgctcactaatttgataatttagataaagtggatcaattctttgaaaggcacaagctaccaaaagtcatagaaggagaaacag

SEQ ID NO: 113343 - DNA, 601 bp, Human
agttgatgagcaacactaatcgactgaattcagctgacatttatagaataattcatccaacaatagcagaataaatatttttctcaaactctcatggaacattctaaaagacagacacattctgggccacaaaatacaccataacaaatttaaggtttttttcagatgataatggaattcaactagaagtcagtaacagaaagacgctggaaaatcccagaatatttggagattaaacaacttacttcagaataacacgagtgttaaaaaaaaaaaaaaagaaagaaagaaaaagaaaaakcagtcaagagaaatgttaaaatattttgaactaaattaaaatgaaaatacaaacttgccaaaatttgtgggatgcagtcaaagcagtgatttcagggaaatttacagcattgaaggcatttatttgaaaagatctaaaaccagaaacaagcttctatttttgaaaattctagagaacgagcaatttaaccttaaagcactcagaaaaaaagaaataataaaaattagggcagaaatcaatgaacttgaaaacaggaacaacagagaatatcaataaaaccaaagccttggttatttgaaa

SEQ ID NO: 113344 - DNA, 601 bp, Human
tgagatactctgttacaaggcacaagcactacccacaaagcactgtattgttattagaaagcagatatagattacttgtaaatgtatattgcaaaccctaggacaaccacttaaaaaaaactgaagtataatttatatattaagagaagagagaaaatggaataatataaaatgttcaatttcaaccagagatgtcagaaaaagagaagattttaaaaatgaaaagaacaagtacaacaaataaaaaacagatataaacatggttgatattaatccaacgatatcaaaattcacttcaacygttaaggacctaaacatattaattaaaaaacagagactgtcagagaagattttttttaaaaagacccaactaatattttctataagaaacccattttagacataaagatgcaggtaagtgaaaagagatggagaaatacgtaccaagttaaaactaaccaaaagaaggttggagtacagatggttcctgacttaacgacagttgaaatgacaatttttcaacactatggtgacgtacaagcaacatgcattcagcagaaagtatactttgagtacctatacaaccattctgtgtttcact

SEQ ID NO: 113345 - DNA, 601 bp, Human
acttggcagggtgcagcagttcacacctgtaatcccagcactttggaaggccaagctgggtggggatggcttgacctcaggagtttgagatcagcctgggcaacatggcaaaaccccatctctacgaaaaatacaaaaatcagccaggtgttgtggtgcatccctgtagtcccagctacttggaagaaggctgaggtggaaggattgtttgagcccaggaggttgaggctgcagtgaacctaatctgtgccactgaagcttgagcaacagagagagactctgtcttcaccccccacccccsctccaaaaaaaagaaaaaagaaatgtcccaaatgcaaagagcaaaaaaaagaatagcatattccaagaactgtgggatgattttaaaaggtttaaaaatgtaactagaataccaaaaggagaagaaaaacgactgaagcagaataaatataagtaataatggccaagaattttccaaaattaatgataaatatcaaactacagatccaggaagctaaaaaagaaaaaaaacaatcaccgagcaggataaaaactgaaaaaatctacacacaggcacattatatttaaactacaaaaaatc

SEQ ID NO: 113346 - DNA, 601 bp, Human
ggccttaaaaaggaaggaaattctgacatataccacatcatgaatgaaccttgaggatattatgctaaatgaaataagccaattcaaaatcatagatggaaagtagaaagccaggggctggaggaggaagcaatgggaagtcaatgtttaatgggttacagagtttcagtttcacaggataaaaaaagttctagagatggatggttgtgatggtggcataatattaggaatgtatttatactactactgaattgtacacttaaaaatgattaagatactaaattttacagtttttatattktaccacactaacaaaaaaatgaagaaaggaaatacagtaagtcaaattcactgcaagagaaatgaagaatgcctatgataggctcatcagtaggttgaaaacagaacttggcagggtgcagcagttcacacctgtaatcccagcactttggaaggccaagctgggtggggatggcttgacctcaggagtttgagatcagcctgggcaacatggcaaaaccccatctctacgaaaaatacaaaaatcagccaggtgttgtggtgcatccctgtagtcccagctacttggaagaaggctgag

SEQ ID NO: 113347 - DNA, 601 bp, Human
tcaaactaaaggccaatctacttcacttcctattatccaaaatattatacactatgtccagcattcaacaaaataatcacaatgtatgctaacaggcaggaaaaaccacagtctgaagagacaaagcaaacacctgaaccagactcagatataacataaattatggaatgagatagtgattttaaagtaacaacaattaatatgtcaagaactctaatggatagatagtatgcaagaacaaattgttaatgtcagcagagagatggaaactctaagaatgaatgaaaagaaaatatacaayaataaaaaataaacaaactggacttcacagaaagattttaagatgtattcaccaaaagataccatcgacagggcaaaaggcaacctacagatggaaaaaaaattgcaaatcatatatccaataaaggtttaacatcaagaatacagctgacctttgaacaatgtcaggggcactgacctcccatgcagctgaaaatccacatgtaacttttgattcccccaaaacttaactactaatagcctgctgttgaccagaagccttaccaataacataatcaattaacatatattttgtatatgt

SEQ ID NO: 113348 - DNA, 601 bp, Human
agacatgatattagcaaaaagaggagtttgtgtcatgattaaaactcaatgttataccgtcatcccaaacaacaccgcccctgatggaagtataacaaaggcattgcaaggtctgactgctctgtccaatgagttagccaacaactcaggggtaaatgacccctttacagaatggctagaaaagtggtttggtaaatggaaaagaataatatcctcaattcttccttccctcgcagctgtaatgggtgtatttattcttgtcaggtgctgtgtcacaccatgcatctgtgggttggtgcasaggctcataaaaatggcacttactaaaaccttccttaactgtcctccaccttatccagagaagcttcttttggaaaatcaagcagaacaactaagccaagacatgttaaaaagtttgttaggaaatgcaagaggaggggttgttagatatgagttccaaatttcttttcaaataatcaatatgtcaatatgtaaaattctttgccttctacttttaaacttaacttcctcaaaaagcaacctttttggattacctgctccaccctgactcattcccattacctgctctgtaataaccatt

SEQ ID NO: 113349 - DNA, 601 bp, Human
cgggtcagccctgagggccatccagcttccatctcccaacactaagctcactttgtgtctctcacgacaggcaggaaacttagagttccttggagacctgaagggatgcagtgagcttaaaaattttcaaaagcttaccaatcagtccttattcatccctgagtagatgtgtagtggtattatgatggacctttactggacactgtcaagtaactaaagtggcacttatgctttagtccaattggctatcccttttaccctggcatttcatcaaccagaaaaagaaaaaaaaaaaaaaaaagacatcataaagcaaaagaagccccttatgggtcttttgactctcacatctatttagacacaattagagtcccaaggggagtaccagatcaatttaaagcccgaaatcaaatagctgcaggatttgagtcaatatcttggtgggtgacaattaataaaaatgtagattggataaactacatctattataaccaacagcgatttattaactacactagagatgttgttaaagaatagctgagcaattaggggatactagccagatggcttgggaaaattgtgataggcttagacatgatat

SEQ ID NO: 113350 - DNA, 601 bp, Human
ggtagctcttttccaggattctaccgcctggagtaacacatcatgccaagctcgctctctgctatatgtcaaagtccgacaccctgcgggtcagccctgagggccatccagcttccatctcccaacactaagctcactttgtgtctctcacgacaggcaggaaacttagagttccttggagacctgaagggatgcagtgagcttaaaaattttcaaaagcttaccaatcagtccttattcatccctgagtagatgtgtagtggtattatgatggacctttactggacactgtcaagtaacyaaagtggcacttatgctttagtccaattggctatcccttttaccctggcatttcatcaaccagaaaaagaaaaaaaaaaaaaaaaagacatcataaagcaaaagaagccccttatgggtcttttgactctcacatctatttagacacaattagagtcccaaggggagtaccagatcaatttaaagcccgaaatcaaatagctgcaggatttgagtcaatatcttggtgggtgacaattaataaaaatgtagattggataaactacatctattataaccaacagcgatttattaactacac

SEQ ID NO: 113351 - DNA, 601 bp, Human
gcttgccttgttataccctgtggggacttgccaaggcaaagacagctctctacttcagaaaagtacctctgtccctcctgactctcgtcagactgggcattagagaattgggaccatttaatccggggagattttgataaagaccccagtgtcaaccaggagtcttgtcccaccaatgtagagcttttatgctgtagctggtccaaagttctgtggaccactaaagagcaagaatagactgctccaactggtttttgtaatttcctaaaaccatacattcattttactagagggacagctrtcccccaactgtaagctaaaccagtgtaatcctatacaggttattatcttaaaccctcaaagttcttccccttttctaagttggttcccttctttaagccagttttatgatatgggggctgaggtttcagggacagaccctattagattctttgaaatgtgtttctttaatcccccgctgcctgtaccttcctctaagccttcttccaaaaccttttacaacggaagaatttctcctcctctgtctaacaacaagaccaaaatagctattgtagaagttaaagacttaaaacaaactttg

SEQ ID NO: 113352 - DNA, 601 bp, Human
attcaatctgtaccggcaactgctctcctaacagaagaaagtagaaaaacaacttttagaggaaacctcattgtgagcacaccacatcaggtcagaactatcctaagtccaaaaaaaaaaaaaaaaaaaaaaaagcaaaaaggtagcttactgacttaagaactttaaagtataaggctattccattagaaaaagatgatttaacattaaccactgaaaattcccttaacccagcaggtttcctaacatgggatctaaatcttaattaccatacaaaggtccgaccaaacctaggaggaastcccttcaggacaggaggatagatggttcctcctgggtgactgaaggaaaaagacacaatgggtattcagtaagtgataaggaaactcttgtagaagcagagttaggaaaagtgcctaataattagtctgctcaaatgtgtggcatatttgcactcagccaagccttaaagtactacagaatcaggaaagacccatctataccaattctaagttaatatggactgaatgaggtcttattaaaagcaaagaataattgaaatcccaaacttacaaggttttcaacaaaagtaaagtttgct

SEQ ID NO: 113353 - DNA, 601 bp, Human
cattcaatctgtaccggcaactgctctcctaacagaagaaagtagaaaaacaacttttagaggaaacctcattgtgagcacaccacatcaggtcagaactatcctaagtccaaaaaaaaaaaaaaaaaaaaaaaagcaaaaaggtagcttactgacttaagaactttaaagtataaggctattccattagaaaaagatgatttaacattaaccactgaaaattcccttaacccagcaggtttcctaacatgggatctaaatcttaattaccatacaaaggtccgaccaaacctaggaggawctcccttcaggacaggaggatagatggttcctcctgggtgactgaaggaaaaagacacaatgggtattcagtaagtgataaggaaactcttgtagaagcagagttaggaaaagtgcctaataattagtctgctcaaatgtgtggcatatttgcactcagccaagccttaaagtactacagaatcaggaaagacccatctataccaattctaagttaatatggactgaatgaggtcttattaaaagcaaagaataattgaaatcccaaacttacaaggttttcaacaaaagtaaagtttgc

SEQ ID NO: 113354 - DNA, 601 bp, Human
gcattcaatctgtaccggcaactgctctcctaacagaagaaagtagaaaaacaacttttagaggaaacctcattgtgagcacaccacatcaggtcagaactatcctaagtccaaaaaaaaaaaaaaaaaaaaaaaagcaaaaaggtagcttactgacttaagaactttaaagtataaggctattccattagaaaaagatgatttaacattaaccactgaaaattcccttaacccagcaggtttcctaacatgggatctaaatcttaattaccatacaaaggtccgaccaaacctaggaggwactcccttcaggacaggaggatagatggttcctcctgggtgactgaaggaaaaagacacaatgggtattcagtaagtgataaggaaactcttgtagaagcagagttaggaaaagtgcctaataattagtctgctcaaatgtgtggcatatttgcactcagccaagccttaaagtactacagaatcaggaaagacccatctataccaattctaagttaatatggactgaatgaggtcttattaaaagcaaagaataattgaaatcccaaacttacaaggttttcaacaaaagtaaagtttg

SEQ ID NO: 113355 - DNA, 601 bp, Human
tgcattcaatctgtaccggcaactgctctcctaacagaagaaagtagaaaaacaacttttagaggaaacctcattgtgagcacaccacatcaggtcagaactatcctaagtccaaaaaaaaaaaaaaaaaaaaaaaagcaaaaaggtagcttactgacttaagaactttaaagtataaggctattccattagaaaaagatgatttaacattaaccactgaaaattcccttaacccagcaggtttcctaacatgggatctaaatcttaattaccatacaaaggtccgaccaaacctaggagtaactcccttcaggacaggaggatagatggttcctcctgggtgactgaaggaaaaagacacaatgggtattcagtaagtgataaggaaactcttgtagaagcagagttaggaaaagtgcctaataattagtctgctcaaatgtgtggcatatttgcactcagccaagccttaaagtactacagaatcaggaaagacccatctataccaattctaagttaatatggactgaatgaggtcttattaaaagcaaagaataattgaaatcccaaacttacaaggttttcaacaaaagtaaagttt

SEQ ID NO: 113356 - DNA, 601 bp, Human
gtatttccttggtggttgggactgaggaaaaagctgcagggtggtaaagcattccttggttaagacataccaaggagagagaaaccgcaggggcggtaaagcattccttagtcaggactagggaaagaaagccacagggggtggtgaagtattcctcagttgggatgtcttggaggttaaaaagaggtgagagatctccattcaggagggggttgaaactcagaaagaggtgagaaatccccatggggggcggggtgttgaacctcagaaagaggtgagaaatccccatgagggggagttraatctcaaaaagaggtgagaaatccccatgagtgggggttgaacctcacacaaacctccggtagtaagaaaaatattcagaacccccctttcctttcttctcaggggaagaaagagtagctccactccagccagtccctcccctaggggaaggggaaggagaggggagaacagcagcataagcggctggcacaggcagggaaagaccagcaaagaggaaagagaaactgggagaggaaatcagagagaaacagagagaaagagacagagagtcagagggagagagagagagaaagagaga

SEQ ID NO: 113357 - DNA, 601 bp, Human
tttgtggcaccaaaacttcacttataacaattccggggctggccggggattacattcccttcccggggcggtctctggttgtctctcgtgaggaggcgtggcccgcccccttgtggcagcctcaggggtgagaaatcaggacccacccagtgtgaggaataacccaagccctcagcaacgtggaaagaaactggccagaaacctagcttaaaggatcctcatatactgccatgatgattctgtgtacagaccaaggaaggatgttgcagatggtgaagtatttccttggtggttgggactraggaaaaagctgcagggtggtaaagcattccttggttaagacataccaaggagagagaaaccgcaggggcggtaaagcattccttagtcaggactagggaaagaaagccacagggggtggtgaagtattcctcagttgggatgtcttggaggttaaaaagaggtgagagatctccattcaggagggggttgaaactcagaaagaggtgagaaatccccatggggggcggggtgttgaacctcagaaagaggtgagaaatccccatgagggggagttgaatctcaaaaagaggtgagaaat

SEQ ID NO: 113358 - DNA, 601 bp, Human
gctaaggttaatttattgttgaagaaaacttttaaataaatttagtgtagccgaagtgtgctgtgtttataaaatctacaggagtatgtagtaatgtcataggccttcacactcactcaccactcactgacttacccagagcaacttccagtcctgcaagttctattaggtgcctgatacaggtgtaccattttaaaaaatcttttgtaccttatttttactgtacgatttcttgtttagatatgttataatatgtaaatacaattgtgttacaattgcctacaatatttagtatagtaayatgctgtacacatttgtagcctaggagcaatccgctatgccatatagcctaggtgtgtggtaggttataccatctaggacagtgatccccaacctttttggcaccaggcactagtttcatggaagaaaatttttccacagacaggggaagggggagatggtttctggatgaaactcttccacctcagatcataaggagcacatgacctagatccctcacacgtgcagttcataatagagttcctgctcttttgagaattgtcaggcatgagttctaaatttcttttcaaagaatcaatat

SEQ ID NO: 113359 - DNA, 601 bp, Human
ccatgcccggctaatttttgtatttttagtagagacgggatttcaccatgttggccaggctggtctcaagctcctggcctcaggtgatccgcctgcctcagcctcccaaagtgataagattacaggcgtgagccaccgcgctcagccgtgtttgggttttaacctaactctttttacaaaagagtcaaaaggtttaaaaaaaaatcctaaaagtttgtaaagtaaaaaagttatagtgagctaaggttaatttattgttgaagaaaacttttaaataaatttagtgtagccgaagtgtgcwgtgtttataaaatctacaggagtatgtagtaatgtcataggccttcacactcactcaccactcactgacttacccagagcaacttccagtcctgcaagttctattaggtgcctgatacaggtgtaccattttaaaaaatcttttgtaccttatttttactgtacgatttcttgtttagatatgttataatatgtaaatacaattgtgttacaattgcctacaatatttagtatagtaatatgctgtacacatttgtagcctaggagcaatccgctatgccatatagcctaggtgtgtggt

SEQ ID NO: 113360 - DNA, 601 bp, Human
tagaataaggatatcaagaaagaaaatatttttatacagttctacaatgtgtttgggttttgttttttgtcttttgaggcagagtctcgctctgtcacccagactggagtgcagtggtgcaatgtgggctcattgcaacctccgcctcccaggttcaagcgattctcctgcctcagcctccccagtagctgggattacaagcacgccccaccatgcccggctaatttttgtatttttagtagagacgggatttcaccatgttggccaggctggtctcaagctcctggcctcaggtgatccrcctgcctcagcctcccaaagtgataagattacaggcgtgagccaccgcgctcagccgtgtttgggttttaacctaactctttttacaaaagagtcaaaaggtttaaaaaaaaatcctaaaagtttgtaaagtaaaaaagttatagtgagctaaggttaatttattgttgaagaaaacttttaaataaatttagtgtagccgaagtgtgctgtgtttataaaatctacaggagtatgtagtaatgtcataggccttcacactcactcaccactcactgacttacccagagcaacttccagt

SEQ ID NO: 113361 - DNA, 601 bp, Human
tcccttctctgtcctttgctttatcatgctttcagcccacactctacaatgtccttaacttgactgtacacaaatctgattgctttccttacctgctcaaatctttcactgaatcccccaaatctaaaagataatggctaaactcttcagaatgatctggcctctacctactgtttatatctcattataacaaccttccttacagtctaaggtccaaaaataacaagccacctacaatcttcaaattactccatgttgtttcaagtctccactgcctttaaatattctagtctgcctggamataccttcctaccaagtctgtctgataaattcctatttctccttcaaaattcagctctcatgtaaatattctctaatgcttccttctccacactaaagtggagttttctatcattatcatttctacaatgctacctttttaaatcttgttttctctctattagacttaggaacaactaagacattggctatgtctaagccaccttgtatcctaagcacctagcacaaaggttggcatacacatgcctcaaaaatatttattaaattatatacttaaaatggattcacaagaattccatca

SEQ ID NO: 113362 - DNA, 601 bp, Human
ttaaaagatgtgtatttaacaaaatgttttatttctttcaaaagaatttaatttgaagttctcagggtacttgtaccaaagtacatattatcataaaaataggtaagaaattcaaagatgacctaacagaattccttgtcatctttcttactttacatatgaagaaacaaaaagccattcgtgtttaatgattcacctgtcagtacatctactcatttcatcgtccaagaagtgttgagcatctccaggctggcatttggtgcacagtaaagaataaaaacacatccctactctgtggctrgcggtttagaggagaactaaaaccttggttgagctcaactcctagtctaacatgtttccattgcattggttatagtcagaattcacttacaaagcattcattctccaatggtgcatgctagtaatatttaatggtgccattaattagatagaatatcctaagtaaaaaagttaaacttttccactacctattaaagactttgggcattatcaatatgttacagttcctatgagataaaattattattaaatctatacttttcagatttcaagaccttcacatattttttctgccctacct

SEQ ID NO: 113363 - DNA, 601 bp, Human
acttttctgactgcctcgaaaatcacaggctatcacttggaattcagttatctgctattcttaaacaaatgtggacttttttattccttctgtggttcaactcagacactgcaactttgaactgaaataaatgattcactctctagtctaaatgtattcaactggttactgagaaaatttcagatttatactgcttcttccaacttgattacagtactttaatacctgcattccaaatgttaaactacctctaatcctttacatttgtaataaaaacaaatactttacatatttattattrcaacttccagtgtttactctgtgaaacttatgaagagattgcatttttaccttgtacatttattcagcttggctaaagaactcaatttaaattttatctatattaaaaagcctctgaaatacaaggacacttggttttcaatttgcatttaaaagatgtgtatttaacaaaatgttttatttctttcaaaagaatttaatttgaagttctcagggtacttgtaccaaagtacatattatcataaaaataggtaagaaattcaaagatgacctaacagaattccttgtcatctttcttact

SEQ ID NO: 113364 - DNA, 601 bp, Human
tgtaagtgtattactggcaaattcaatagccttagagaggtcatcatggttagccttcttcaatccctctgcctagaatactgcaaggtatcaataaatgcttacttaatgaaggaatgccacatttgacatttggctttcccttcacttagcttccgtgaaacttttctgactgcctcgaaaatcacaggctatcacttggaattcagttatctgctattcttaaacaaatgtggacttttttattccttctgtggttcaactcagacactgcaactttgaactgaaataaatgattcaytctctagtctaaatgtattcaactggttactgagaaaatttcagatttatactgcttcttccaacttgattacagtactttaatacctgcattccaaatgttaaactacctctaatcctttacatttgtaataaaaacaaatactttacatatttattattgcaacttccagtgtttactctgtgaaacttatgaagagattgcatttttaccttgtacatttattcagcttggctaaagaactcaatttaaattttatctatattaaaaagcctctgaaatacaaggacacttggtttt

SEQ ID NO: 113365 - DNA, 601 bp, Human
taaaaattagtggaagagaggatacagagtatccaaaaccagatgtttagttgatatatttcttttaaaatatacgttcacaaatctcattgcaacagaaggctatcccttttcatagtataaaaatggttaaaagcaatgatacatatttagagttacaaaaaataaacatctaagtaaagcagtttcaagcctaatgtacaagttatttggataagaaaatgggcattaagaaaatagcagacttgagatttaggttcactaggaccacttagtgtaagtgtattactggcaaattcartagccttagagaggtcatcatggttagccttcttcaatccctctgcctagaatactgcaaggtatcaataaatgcttacttaatgaaggaatgccacatttgacatttggctttcccttcacttagcttccgtgaaacttttctgactgcctcgaaaatcacaggctatcacttggaattcagttatctgctattcttaaacaaatgtggacttttttattccttctgtggttcaactcagacactgcaactttgaactgaaataaatgattcactctctagtctaaatgtattcaactg

SEQ ID NO: 113366 - DNA, 601 bp, Human
tttattttactcacctcttcctttctcaaatcacaaagatctcagatggatacaaatatctcaagaaatacgcacctatttttgatttcaattcaacaagtaattagtgagcaactacagtgtcaactcttcttaggttatgcataatataacttttgtaaattaaattatatgttcctgcaaaactgttttcagaagaaggagagaaggtggcagtctgacaagggagctcaggatccaaggaacaaaatgatgatcaatactttgggttttctttttgtctcatgtatttcagactggrtactggagacaccagcaacgcaaaaacgccaatggaggagacccagaaaagaaaagccccaagaaaagcatgccctctctatccaggaagcgggcagcctagcaagacagaagcttttcgacaataaccactccactctagctaaccaccacagaaaaaaacagcagcccacccccaccaaccctgccagcaaaggccaagtggtgaagctagatgtccatcctctgtaggctgtaaaaagaagtcccaatcttctgctggggtagaaacagagaaggctgagtgggggagccacccaca

SEQ ID NO: 113367 - DNA, 601 bp, Human
atataatactttttatctttcctcctctaaattataaattgtttactaaaggtgtagaaattgttgatttgaaaattaatttggtagaactgctttaggtgtttattttactcacctcttcctttctcaaatcacaaagatctcagatggatacaaatatctcaagaaatacgcacctatttttgatttcaattcaacaagtaattagtgagcaactacagtgtcaactcttcttaggttatgcataatataacttttgtaaattaaattatatgttcctgcaaaactgttttcagaagawggagagaaggtggcagtctgacaagggagctcaggatccaaggaacaaaatgatgatcaatactttgggttttctttttgtctcatgtatttcagactggatactggagacaccagcaacgcaaaaacgccaatggaggagacccagaaaagaaaagccccaagaaaagcatgccctctctatccaggaagcgggcagcctagcaagacagaagcttttcgacaataaccactccactctagctaaccaccacagaaaaaaacagcagcccacccccaccaaccctgccagcaaaggcca

SEQ ID NO: 113368 - DNA, 601 bp, Human
ctgcatgttgtgcacatgtaccctaaaacttaaagtataattaaaaaaaatgtaaactgagcactcattccatttgtgaaaagatcacctgactcatttgaaactttatctttcagggtgtgggacagcctcaaaataagtgagaacttatggtttagaatagaaagcctccactggctccacaaaggagctatagtgtagtaatacaacaccagactcatttaatctacagcactagaagaattaaaagataaatgatcatccaaaatgaatttcatgtaacaatcctaaaagactgagrttattgttcaatataatactttttatctttcctcctctaaattataaattgtttactaaaggtgtagaaattgttgatttgaaaattaatttggtagaactgctttaggtgtttattttactcacctcttcctttctcaaatcacaaagatctcagatggatacaaatatctcaagaaatacgcacctatttttgatttcaattcaacaagtaattagtgagcaactacagtgtcaactcttcttaggttatgcataatataacttttgtaaattaaattatatgttcctgcaaaactgt

SEQ ID NO: 113369 - DNA, 601 bp, Human
gtgcagcacaccaacttggcacatgtatacatatgtaactaacctgcatgttgtgcacatgtaccctaaaacttaaagtataattaaaaaaaatgtaaactgagcactcattccatttgtgaaaagatcacctgactcatttgaaactttatctttcagggtgtgggacagcctcaaaataagtgagaacttatggtttagaatagaaagcctccactggctccacaaaggagctatagtgtagtaatacaacaccagactcatttaatctacagcactagaagaattaaaagataaatgwtcatccaaaatgaatttcatgtaacaatcctaaaagactgaggttattgttcaatataatactttttatctttcctcctctaaattataaattgtttactaaaggtgtagaaattgttgatttgaaaattaatttggtagaactgctttaggtgtttattttactcacctcttcctttctcaaatcacaaagatctcagatggatacaaatatctcaagaaatacgcacctatttttgatttcaattcaacaagtaattagtgagcaactacagtgtcaactcttcttaggttatgcata

SEQ ID NO: 113370 - DNA, 601 bp, Human
tcattctcagcaaactatcgcaaggacaaaaaaccaaacactgcatgttctcactcatagatgggaactgaacaatgagaacacatggacacaggaaggggaacatcacacaccgaggcctgttgtggggtggggggagcagggagggacagcattaggagatatacctaatgttaaatgacgagttactgggtgcagcacaccaacttggcacatgtatacatatgtaactaacctgcatgttgtgcacatgtaccctaaaacttaaagtataattaaaaaaaatgtaaactgagcactyattccatttgtgaaaagatcacctgactcatttgaaactttatctttcagggtgtgggacagcctcaaaataagtgagaacttatggtttagaatagaaagcctccactggctccacaaaggagctatagtgtagtaatacaacaccagactcatttaatctacagcactagaagaattaaaagataaatgatcatccaaaatgaatttcatgtaacaatcctaaaagactgaggttattgttcaatataatactttttatctttcctcctctaaattataaattgtttactaaaggtgt

SEQ ID NO: 113371 - DNA, 601 bp, Human
tagataaatatttaaatgcatttaaactaagggggaaggcaaagatgaaatgaaaattaaataagcctgttcccaaattccaattatttcacacaacagtattctttcacatggtagcatcgatagtttataaacctatcccaaattttcagtgtcttatattgtgtatgtatatataaagtgcagatatagaatatatctaatgacaagtatatgtactatatttatgtttgttatatacgtatcacatttttctttacattgtaaaaaattaaatggaattgtttattttcaaataacygccatatttcttaacaagaaaatatttttttaaaattattgtcttgtattacgggctttttattacgctacatatgaaacaggagatatgataatgatttaacattcttgatgcatcagactgaaaaattagatatttacagaccatgtctataacaaaattctaattggataatcttttcttcccccttgctctcattgtgaaagatatataaatttaatttggttacgggcacggtctattgggctaagcacaggatggtggttaaagaaaacatttagagttccaatcttggtctgt

SEQ ID NO: 113372 - DNA, 601 bp, Human
gaaactatatctatatgttatgggctgcatgtttgtgttccctcaagtcatgtgttcaaaccctaaccctcaaagagatggtatgaggtggtggggcctttgtgatgcaattaagtcatgagagtagaatcctcatgatgggattaatgcctttatatgagactcaataacacttgcttcctttctctctgccatgtgagggtacaacaagaaggctgccatatggaaaccaggaccagaacctgaccatgctggcaccctaattttgaacttcccatcctctaaaactatgaaaagtagrtatctgttgtttaagttacccagtctatggtattcttattatagcagcccaatctgacactgtatttagataaatatttaaatgcatttaaactaagggggaaggcaaagatgaaatgaaaattaaataagcctgttcccaaattccaattatttcacacaacagtattctttcacatggtagcatcgatagtttataaacctatcccaaattttcagtgtcttatattgtgtatgtatatataaagtgcagatatagaatatatctaatgacaagtatatgtactatatttatgtttgt

SEQ ID NO: 113373 - DNA, 601 bp, Human
aaaaagaaaaatcacaaaagaaatctccatgatgttacaatacaaatgaattgctacatcaggatgctaactctcaaagacaatcctgcaaatgtgcttccataatcaacatatttagcagaataagagatgaatctagaattcaggcccttaattttgagtggtaacttttccccaacatataacaaactactctaaaaagaaactatatctatatgttatgggctgcatgtttgtgttccctcaagtcatgtgttcaaaccctaaccctcaaagagatggtatgaggtggtggggcctytgtgatgcaattaagtcatgagagtagaatcctcatgatgggattaatgcctttatatgagactcaataacacttgcttcctttctctctgccatgtgagggtacaacaagaaggctgccatatggaaaccaggaccagaacctgaccatgctggcaccctaattttgaacttcccatcctctaaaactatgaaaagtaggtatctgttgtttaagttacccagtctatggtattcttattatagcagcccaatctgacactgtatttagataaatatttaaatgcatttaaactaaggg

SEQ ID NO: 113374 - DNA, 601 bp, Human
gagaaatgataatctatttttaccatgagaaattaagactactgggaaaacaatctaactaggtgaagtacactattaatagaaagtaaaactaaaaatgaatctataatttgatagtctaaagagaagcaagctggaataaaaacaaaatcaacatatccacaccaaaggaccagatatcagaaaggggtcacatgttgatctttcctttagggggataaatttaatctaaaacatgtacttgagaataggcaaagtgtaaaacacttcattacacactgtgaggatcaagtaaacagcwcatataaggcaaaataaaataaatgctaataatcaaatactatgggacttcaaacataggaagaattaatttggactcgggaaataaaaggtataataaataggttgtgttgttttttaaaaatagagtcccactctgtcatccagactggaatgcagtggtgtgatcatagctcactgcagctttgaattcctggactccagcgatcctcccacctcagccttccaagtagctaggactacaggcacatatcaccatgtccagctaattttctggttactttttgtagagatagggtct

SEQ ID NO: 113375 - DNA, 601 bp, Human
attagaatggaatttatatttagaagtaattgagaaatgataatctatttttaccatgagaaattaagactactgggaaaacaatctaactaggtgaagtacactattaatagaaagtaaaactaaaaatgaatctataatttgatagtctaaagagaagcaagctggaataaaaacaaaatcaacatatccacaccaaaggaccagatatcagaaaggggtcacatgttgatctttcctttagggggataaatttaatctaaaacatgtacttgagaataggcaaagtgtaaaacacttmattacacactgtgaggatcaagtaaacagctcatataaggcaaaataaaataaatgctaataatcaaatactatgggacttcaaacataggaagaattaatttggactcgggaaataaaaggtataataaataggttgtgttgttttttaaaaatagagtcccactctgtcatccagactggaatgcagtggtgtgatcatagctcactgcagctttgaattcctggactccagcgatcctcccacctcagccttccaagtagctaggactacaggcacatatcaccatgtccagctaat

SEQ ID NO: 113376 - DNA, 601 bp, Human
aataaaagtgttcttaaccaaactaatcttggtgtagtactttacagttatatagactccctttacaaacacacattatacctcatttaatctatataacaattccatgcaattctgcttagtgggtcttagactatcaatgtactttggataatattaacttgctacatcttaaattaataggtttgaggtagcatgttcacgcccacttgcagagagtcagcctttaccgctaaggagtttaagaatttttagtaactgcaaatacatgaacatagcaaccatactgataaatacctamacggataaactattaaatggacaggcagtaaggagcatttgttagttcactcattcacccatttactcattttttgagcacctattgtgtggtaggcactgttatagttggattggatatctaaatggcatttattagaatggaatttatatttagaagtaattgagaaatgataatctatttttaccatgagaaattaagactactgggaaaacaatctaactaggtgaagtacactattaatagaaagtaaaactaaaaatgaatctataatttgatagtctaaagagaagcaagctg

SEQ ID NO: 113377 - DNA, 601 bp, Human
tttctaatttcaaatgaacagaaaatctagtcttgttcttaaataatctctagagacaaatttaatctttcaacatccagtctttgaatattttgtgcaaataaacccaaactactaatatttcattcaaaataaaaagcttcacttttaaattgtagtgctgacatctagaaatttgcttttcaataatgatctgtcaacagtacatacttagttattattcatttataacttttctcataattacatcttccaattatttaggaacacctgaagacaccttaccaagaattagatactmgtgaagagcttagttccaatcttgacaatttatacaatccagtctatttgctcaaacatacactgcatattctaagaaatgtagttactgttcagtaatattatataacatgtattattagttccatattaataaaagtgttcttaaccaaactaatcttggtgtagtactttacagttatatagactccctttacaaacacacattatacctcatttaatctatataacaattccatgcaattctgcttagtgggtcttagactatcaatgtactttggataatattaacttgctacat

SEQ ID NO: 113378 - DNA, 601 bp, Human
ttatgaggattggccaggtgcagtggctcacacctgtaatcccagcactttgggaggctgaggcggagggatcatgaggtcaggagttcgagaccagtctgacgaacatggtgaaaccctgtctctaaaaatacaaaaagtagccaggcatgctggcatgcgcctgtaatcccagctactgaggaggctgaggcaggagaaccacttgaacccggaaggaggaggttgcagtgagccaagattgcaccactgcattccagcctgggtgacagagtgagactcagtcttcaaaaaaaaaaaaggaggattaagaaaagaatcttatgctggaacactaacagctctcaaactggaccgaggctgagagagagaatataaagaaggaaaatgaggccaaaacaggtacaacatctgaactccttttagaacgcaagctaaagctgcagttatccaatatataattgtattgtaatgtttaagatcatacagatcagtgctgtttaatagtgctatctagaaatacaagcacatatataattttagattttgtagtagtcatattaaaaaagatgaattttaataatacattgtatttaactgt

SEQ ID NO: 113379 - DNA, 601 bp, Human
ccttcacctgaaaggaacatgctatctagaaaagatgtgaacactattacacttggttctttgtgctttcaacatatgaaaagtctcctaagtaaaaaggcagaaaaaattgaacaggtaactacccatttaatgcttcaaagtagcaaactgtctgggatccttaatgtcagtgcctgtttccctgcctgaaactcatgggtgaatgccacacactatgcataaagtagccttgagtaggtgaatttggcaataataagcacacttcatagcttccctaacattaaaaaaaaaaaaaaaaggcaaactgtaaaaaatccaccattctgagaccactttttcctaatctagagagactgatggcaatccttttccaatcatgataaatgctattacccaaagcattcacacgatctctaaagtacaaaaggccttctaggatgtagatactacattttgtgctggaacaacagattctactcttcaaaatattatgttttaataaaagaaaccaaaaaaatcaagatctaagtagacaagcagaagcactagcgcactcagtttcgaggagtggaccagagaagaattcatctgccagtat

SEQ ID NO: 113380 - DNA, 601 bp, Human
aaaccacctaaaatcacatgcaatttggagtatgtttttattcttttgggggtggaggggtggggcgggggagggagtatacaggtcttgagccttcacctgaaaggaacatgctatctagaaaagatgtgaacactattacacttggttctttgtgctttcaacatatgaaaagtctcctaagtaaaaaggcagaaaaaattgaacaggtaactacccatttaatgcttcaaagtagcaaactgtctgggatccttaatgtcagtgcctgtttccctgcctgaaactcatgggtgaatgycacacactatgcataaagtagccttgagtaggtgaatttggcaataataagcacacttcatagcttccctaacattaaaaaaaaaaaaaaaaggcaaactgtaaaaaatccaccattctgagaccactttttcctaatctagagagactgatggcaatccttttccaatcatgataaatgctattacccaaagcattcacacgatctctaaagtacaaaaggccttctaggatgtagatactacattttgtgctggaacaacagattctactcttcaaaatattatgttttaataaaaga

SEQ ID NO: 113381 - DNA, 601 bp, Human
ttttacaagaaaatagaggtccctctgtattttatttttcaaggtataatctttactattagataaaacacatgactagtgggaagaaaaaaagacactgtaaatttatctattttatataaataacttagggatacaaagaactggcactataaggaagagcactaatagattccttgtcagatatcaggtaacataggcacattaatatgattctgtaatttaaagggttccaagcagcaatctgaaagttagaaaaaaaactctttcgactagcactttttcaaatagaattctactrtaatacctgaaaatggcatgcttgtttccaactatttcacaaggtaaaaatgtaacttaagcaaatatcaaggaagcttaaaataaagtgaaacaactttctatgtctaaaagacacaaataaatgttttataacttctttaacttagcttgacatagtttttggaattaaattacctatataaaaatttactcataaatggttttagatacacactttaaaaaccagcaagaacctatcacacgaatcattactttaaaactaaataataccaaactggtatatatttaggtctgccaa

SEQ ID NO: 113382 - DNA, 601 bp, Human
caagtcttagaatgaatatgcatcaatgagataagtatgtcatcaatgcattgaagtgcttttttttggtagaaaagaaataactctgtatttggtggtaaaatgaggtaaagcaaggtgttgtctctgagatcagataaattttacaagaaaatagaggtccctctgtattttatttttcaaggtataatctttactattagataaaacacatgactagtgggaagaaaaaaagacactgtaaatttatctattttatataaataacttagggatacaaagaactggcactataaggaasagcactaatagattccttgtcagatatcaggtaacataggcacattaatatgattctgtaatttaaagggttccaagcagcaatctgaaagttagaaaaaaaactctttcgactagcactttttcaaatagaattctactgtaatacctgaaaatggcatgcttgtttccaactatttcacaaggtaaaaatgtaacttaagcaaatatcaaggaagcttaaaataaagtgaaacaactttctatgtctaaaagacacaaataaatgttttataacttctttaacttagcttgacatagt

SEQ ID NO: 113383 - DNA, 601 bp, Human
aaacatacttgagaaatgtaatacagattttttagtgaaagaatatgaagcaaacttatatgtagattacttttccctaaaatattttggtatgcaaaaccaaaactgacagctaaagttctgacatgatctgaacaagataaagattacctggtcttagggaaatttaaggaaggattcctataaatgagatgacagatgaagcataaatagaaatatgtaatgaagaagcttaacagcttcctaaaattcttccttaatttagttcaagaaaaagaaaccagaggtattcatgcaaaakttttaaatgctgtggtattacatccttagctggtactaacacatctgaagtcatctgtggtataagagtcaagaaacatcactttgcaaatgttctgactatggtcagcacagataaagtgaatttattgctgtggtcaaactgaaattttccacttcattttctgaagtttggttgttattattatggaactcaaaaactcagagcctcctttcactttctagcaggtgatactcaaaatggggttgatatgtaaaagagcctctctaagactaacacttctgtgtcaggagtctaatg

SEQ ID NO: 113384 - DNA, 601 bp, Human
gtttcatttagcatcttaatttttttccacttaataaatcatggatactccccaaattcattaacaaataataattaagaagtttggttaaggataatctcccagaacataatcaaatctaagtgataaaatcagtttgggcctgaaaagctctatccaacctcttcagagggtatcttcattcaacatggtctgcttctcaaaaagggaaatagagaaaaaaagagaaaggcaacaacaggggaggaaaactaggccaaacttctattcatcttggctctttcccatcttcaccctctttgagtcatccattaattgatcatattatatattacttataggatatgtcagactctggaccaggtagagctcccccaactcatgggagctcatcatcttaaagggcagcaagtttgaagaaacctaaaaaaaaaaactggtaaatttgattacaggctcacatgaaccatgtagtaaagtagtcttctcattactaaagacttctcaaccctaacactaaattgctggttttatggaattcctttagatgcactatgactcaacattgaaaccactgataaaaatttcatattttaagagt

SEQ ID NO: 113385 - DNA, 601 bp, Human
ttgcaaactatgcatccaacaaaggtctaatatccggaatctatcagtaactgaaacaactgaacaagcaaaaaccaaataatcccattaagaaataggcaaaagatatgagtagagatctctcaaaattcgacacataaacagccaacaaacatatgaaaaaatgctccacatcactactcatcagggaaatgcaaatcaaaaccaaaatgaaataccatctcacaccagtaagaacaactattatttaaaaagtcaaaaaacaacagatactggcaagtctatggagaaaaggaaatgmttctacacttgggaggaatgtaaagtagctcagccactgtaggaagcagtttggcaatttctcaaagaacgtaaaacagaactaccatttgatccagcaatcccattactggggatgtatccaaagaaaacaaatcattctaccaaaaagacacacatacttgcatgttcactgtgacactattcacaataccaaagacatggaatcaacctaggtgtccatcaatggtggactagataaagaacatgtggtacacatacaccatggaatactacacagccataaaaaggacaaaatcat

SEQ ID NO: 113386 - DNA, 601 bp, Human
attgcaaactatgcatccaacaaaggtctaatatccggaatctatcagtaactgaaacaactgaacaagcaaaaaccaaataatcccattaagaaataggcaaaagatatgagtagagatctctcaaaattcgacacataaacagccaacaaacatatgaaaaaatgctccacatcactactcatcagggaaatgcaaatcaaaaccaaaatgaaataccatctcacaccagtaagaacaactattatttaaaaagtcaaaaaacaacagatactggcaagtctatggagaaaaggaaatrcttctacacttgggaggaatgtaaagtagctcagccactgtaggaagcagtttggcaatttctcaaagaacgtaaaacagaactaccatttgatccagcaatcccattactggggatgtatccaaagaaaacaaatcattctaccaaaaagacacacatacttgcatgttcactgtgacactattcacaataccaaagacatggaatcaacctaggtgtccatcaatggtggactagataaagaacatgtggtacacatacaccatggaatactacacagccataaaaaggacaaaatca

SEQ ID NO: 113387 - DNA, 601 bp, Human
tacccaggcatggtggcacacgcctgtagtcccagtaaaaggatcacttgagcctaggaggctgaggctgcagtgagccatgatagtgccactgtactcaggtctgggcaacagagcaaggccctgtctcaacaaacaaacaaaaaaacacaatggatttttttaacgtggtatgcacctacaatggaacattattcagccttaaaaggaatgacattctgacatgttataatatggataaaacttgaaaacattatgctaagtgacataagtcagacacaaaaagacaaatattgtatgrtttgaatcatataaggtatacagaatatgcaaactcacaaattcagaaaatagaatagtggttaccaggggtgaagaagagagaggaatgaggagttactgtttaatggctacagagtttctgtttgggatgatgagaaagttctggaaatggaaagtgaaaatagtggcaggaaattaataatgcacttaatgccactgatttgtacatttgaaaatggtttcaatgctgaatagtaggctgtcatgacagaaaaaaggtggttaaaatggtaaatttcatggttcacggatcttatca

SEQ ID NO: 113388 - DNA, 601 bp, Human
tattcccaaaaagtgagacagagatctaataataataatatttttccattctattagatgatgaacttctgaagcagtttatggtcatcacaaccttagaatatgctcagcaaaaatgtgaaaagtagtcatataatactctcttttcctcacacaaatttatcagactttccgaatgacttaaatagtatgaaacaataattaaaacagcaatttcataaaagatttttactgtagttttaaaattgattattttgtacaccaatgttcactgtagcattattcacagtagccaaaaggyagaaacaacccatatgcccatcaataataaatttttcacggtggctcatgcctgtaatcctaacatttttggaggctgaattaagaagattgcttgaggccaggagtttaagttcagcctgataacacagtgagacctcgtctctacaaaaaataaaaaattacccaggcatggtggcacacgcctgtagtcccagtaaaaggatcacttgagcctaggaggctgaggctgcagtgagccatgatagtgccactgtactcaggtctgggcaacagagcaaggccctgtctcaacaaacaa

SEQ ID NO: 113389 - DNA, 601 bp, Human
taaaagcgattaactagaaggctatattgtcagtcttaagttttttgtttataaataactacacttatcctagatatatgcattgttcaactaaaagttaaaagttaacataaagtatgagggagttcaacctccgtagcatgactaagttctattctaagcattcaaggcaaagttctagaatctcatgtgctgagctgataacaggagaaagcatgagatgtccattaataaagtaactctcagtgcacagcgctggcaatgttatgtagtacgcataactctaaaatgtcttaaaatsatgagtataaacaattacatagctgactaggatcactctttataagtgacttaaagtctcacttaccctcgtggtgaaattaattagattattcccaaaaagtgagacagagatctaataataataatatttttccattctattagatgatgaacttctgaagcagtttatggtcatcacaaccttagaatatgctcagcaaaaatgtgaaaagtagtcatataatactctcttttcctcacacaaatttatcagactttccgaatgacttaaatagtatgaaacaataattaaaacagc

SEQ ID NO: 113390 - DNA, 601 bp, Human
caatagccaagttatggaatcaacctaaatgttcattgacagatgaatggataaagaaaatgtggtatacataaacaaatggaatactatttagcctttaaagaaagatattctgtcatttgtgacaacatggaagaatcttgaggatgttatgctaagtgaaataacgcaggcacagaaagacaaatactgcatgatgttctcacttacatgtgaaattgaaaagaatctaacttatagacgagagttgaatggttggtggtgaccaaaggttaggggatgggggaaacagggagatgtkgatcaaagcgtacagtttcaattagacaagaagaaaaaggtttttgggatacactgcacagcataatgactacagttaataacagtgtagtctacacttcaaaattgctaagacagcaaatttcaaacgtgctcaccacaaaaaagtgtaattatgtgaagtgaagaatgtcaattagcttggtttaataattctactttgtatacatataacatcactttgtacctcataaatattgtaatcgtaatgacaatttgtcaatttacaataaaaaaatctctaaattgatccttcctgatc

SEQ ID NO: 113391 - DNA, 601 bp, Human
ggttcctccaaaaactaaaagtagaattatgatatgatccagcaatcccacttctgggtatatatctaaaggatttgaaatcagtatgacaaagagatatctgcactcttgtgtttactgcagcactattcacaatagccaagttatggaatcaacctaaatgttcattgacagatgaatggataaagaaaatgtggtatacataaacaaatggaatactatttagcctttaaagaaagatattctgtcatttgtgacaacatggaagaatcttgaggatgttatgctaagtgaaataacrcaggcacagaaagacaaatactgcatgatgttctcacttacatgtgaaattgaaaagaatctaacttatagacgagagttgaatggttggtggtgaccaaaggttaggggatgggggaaacagggagatgttgatcaaagcgtacagtttcaattagacaagaagaaaaaggtttttgggatacactgcacagcataatgactacagttaataacagtgtagtctacacttcaaaattgctaagacagcaaatttcaaacgtgctcaccacaaaaaagtgtaattatgtgaagtgaagaa

SEQ ID NO: 113392 - DNA, 601 bp, Human
aaccagtttttgcaaggaaaaaagaaaccttttgtatactattggtgggaatgtaagttagtacatccatatggaaaactatatagaggttcctccaaaaactaaaagtagaattatgatatgatccagcaatcccacttctgggtatatatctaaaggatttgaaatcagtatgacaaagagatatctgcactcttgtgtttactgcagcactattcacaatagccaagttatggaatcaacctaaatgttcattgacagatgaatggataaagaaaatgtggtatacataaacaaatgraatactatttagcctttaaagaaagatattctgtcatttgtgacaacatggaagaatcttgaggatgttatgctaagtgaaataacgcaggcacagaaagacaaatactgcatgatgttctcacttacatgtgaaattgaaaagaatctaacttatagacgagagttgaatggttggtggtgaccaaaggttaggggatgggggaaacagggagatgttgatcaaagcgtacagtttcaattagacaagaagaaaaaggtttttgggatacactgcacagcataatgactacagttaata

SEQ ID NO: 113393 - DNA, 601 bp, Human
caaagtgaagagacaacctacagatttggagaaaatatctgtaagcgagacatttgataagggattaatacccaaaatatataaggaactcaaaaaaactcaaaagcaagaaaacaatctgattgaaaaatgggcaaagaacttgaatagacatttctcaaaagacaacatacaaatggccaacaggtatatgaaaaattgttcaatatcactaagcattagggaaatgtaaattagaatcacaatgagataccacctcatacctaccaccacattttcaaaatgacaaaagataaccagwttttgcaaggaaaaaagaaaccttttgtatactattggtgggaatgtaagttagtacatccatatggaaaactatatagaggttcctccaaaaactaaaagtagaattatgatatgatccagcaatcccacttctgggtatatatctaaaggatttgaaatcagtatgacaaagagatatctgcactcttgtgtttactgcagcactattcacaatagccaagttatggaatcaacctaaatgttcattgacagatgaatggataaagaaaatgtggtatacataaacaaatggaatact

SEQ ID NO: 113394 - DNA, 601 bp, Human
gcacagcaaaaaaacaacaaagtgaagagacaacctacagatttggagaaaatatctgtaagcgagacatttgataagggattaatacccaaaatatataaggaactcaaaaaaactcaaaagcaagaaaacaatctgattgaaaaatgggcaaagaacttgaatagacatttctcaaaagacaacatacaaatggccaacaggtatatgaaaaattgttcaatatcactaagcattagggaaatgtaaattagaatcacaatgagataccacctcatacctaccaccacattttcaaaaygacaaaagataaccagtttttgcaaggaaaaaagaaaccttttgtatactattggtgggaatgtaagttagtacatccatatggaaaactatatagaggttcctccaaaaactaaaagtagaattatgatatgatccagcaatcccacttctgggtatatatctaaaggatttgaaatcagtatgacaaagagatatctgcactcttgtgtttactgcagcactattcacaatagccaagttatggaatcaacctaaatgttcattgacagatgaatggataaagaaaatgtggtataca

SEQ ID NO: 113395 - DNA, 601 bp, Human
ttaaatgtaagatctgaaactgtaaaactactggaaaaaaaatagatcaaaaactacataacattggtctgggcaatgattttttgaatttgaccctaaaagttcaggcaacaaaagcaaaaatagacaaatggatttacatcaaactaaaaaccttctgcacagcaaaaaaacaacaaagtgaagagacaacctacagatttggagaaaatatctgtaagcgagacatttgataagggattaatacccaaaatatataaggaactcaaaaaaactcaaaagcaagaaaacaatctgattsaaaaatgggcaaagaacttgaatagacatttctcaaaagacaacatacaaatggccaacaggtatatgaaaaattgttcaatatcactaagcattagggaaatgtaaattagaatcacaatgagataccacctcatacctaccaccacattttcaaaatgacaaaagataaccagtttttgcaaggaaaaaagaaaccttttgtatactattggtgggaatgtaagttagtacatccatatggaaaactatatagaggttcctccaaaaactaaaagtagaattatgatatgatccagca

SEQ ID NO: 113396 - DNA, 601 bp, Human
aacaaatacagtcaagttgtagaatataaaatcaacacacaaaaatcagtagcatttctatatcctaacaacaaactatccaaaaatgaaatcaacaatcccatttataatagttaaaaaatgaataaaatgcttagaaataaatttagaaagtgaaaggcctacacacgaaaaattataaaacactgatgaaagaaacagaagacacaagtaaatggaaagatactccttgttcatggattagaagaattaatattgttaaaaagtccatactacccagtgattacagattcaatacaayccctatcgaaattacaatgacatttttcacaaaaatagaaaaaaaaattctaaaattcctatgggactacaaaaaaccctgaatagccaaggcaattttgagcaaaaagaataaagtgggaggtatcacactactactaatttcaaactgtattacaaagctatagtaattaaaacagcatggtactgccataaaaatagatacgctgaccaatggaagagaatagacagctcagaaatgaatccacatatttatggtcaattgatttttgacagaggttctctccctctctctcctccc

SEQ ID NO: 113397 - DNA, 601 bp, Human
caaataaatgaaatcagaaatgaaagaagagatattacaacggataccttagaaatacaaaggatcataagagattattatgaacaactatatgccaataaattagataatagaagaaacgggtaaattcctggacatacataacctatcagaactgaatcataacgaaatagaaaattagaacaaaccaattacaagtaaggagattgaatctgtaataaaaagtctctcatcaaagaaaatcccagaacctgatggcttcaggctgattttgaccaaacatttaaagaactaatatacyaccaaactcttcccaaaaatccaagaggagaaaatacttccaaattcttttaacaaagccagcattaccctgataccaatgccagacagaacattacaagaaaactatggaccaatatccttgatgaacgtaaatgcaaagctcctcaatgaaatactagcaaatcaaattcaatagcacattaaaaggatcatacaccacaatcagtaggatttatccccggaatgaaaggacagttaaacatacacaagtctataaatgtgataagccacattaacaaaatgaagaacaaaactcaag

SEQ ID NO: 113398 - DNA, 601 bp, Human
gattcaaataaatgaaatcagaaatgaaagaagagatattacaacggataccttagaaatacaaaggatcataagagattattatgaacaactatatgccaataaattagataatagaagaaacgggtaaattcctggacatacataacctatcagaactgaatcataacgaaatagaaaattagaacaaaccaattacaagtaaggagattgaatctgtaataaaaagtctctcatcaaagaaaatcccagaacctgatggcttcaggctgattttgaccaaacatttaaagaactaatatactaccaaactcttcccaaaaatccaagaggagaaaatacttccaaattcttttaacaaagccagcattaccctgataccaatgccagacagaacattacaagaaaactatggaccaatatccttgatgaacgtaaatgcaaagctcctcaatgaaatactagcaaatcaaattcaatagcacattaaaaggatcatacaccacaatcagtaggatttatccccggaatgaaaggacagttaaacatacacaagtctataaatgtgataagccacattaacaaaatgaagaacaaaact

SEQ ID NO: 113399 - DNA, 601 bp, Human
ttacatcttaaggaaacagaaaaagaaaaagcccaaagttagcagaaagaaggaaacaataaagatcaaagcagaaatttaaaaattagtgactagaaaatagaagaataaatcaatgaaactaagaattgattttctgaaaagataaacaaaattggcaaacccttacctagactgagaaaaaaagattcaaataaatgaaatcagaaatgaaagaagagatattacaacggataccttagaaatacaaaggatcataagagattattatgaacaactatatgccaataaattagataayagaagaaacgggtaaattcctggacatacataacctatcagaactgaatcataacgaaatagaaaattagaacaaaccaattacaagtaaggagattgaatctgtaataaaaagtctctcatcaaagaaaatcccagaacctgatggcttcaggctgattttgaccaaacatttaaagaactaatatactaccaaactcttcccaaaaatccaagaggagaaaatacttccaaattcttttaacaaagccagcattaccctgataccaatgccagacagaacattacaagaaaactatgg

SEQ ID NO: 113400 - DNA, 601 bp, Human
caaataattctaaataaaaagggcaatcaaaaaattaccttgagacaaacaaaaagcaacacaccaaaactgatgagatgcagcaaaagcagttctaagagggaaatttatacaaataaacacaataaacacctagagcaaaaaagatctcaaacaacctaatattacatcttaaggaaacagaaaaagaaaaagcccaaagttagcagaaagaaggaaacaataaagatcaaagcagaaatttaaaaattagtgactagaaaatagaagaataaatcaatgaaactaagaattgattttytgaaaagataaacaaaattggcaaacccttacctagactgagaaaaaaagattcaaataaatgaaatcagaaatgaaagaagagatattacaacggataccttagaaatacaaaggatcataagagattattatgaacaactatatgccaataaattagataatagaagaaacgggtaaattcctggacatacataacctatcagaactgaatcataacgaaatagaaaattagaacaaaccaattacaagtaaggagattgaatctgtaataaaaagtctctcatcaaagaaaatccca

SEQ ID NO: 113401 - DNA, 601 bp, Human
ggatatgaaaaaagggaagaaggaaaagagggaaggattagaaaaagacagaaggaaaattttgggggtgatggacatgtttatcatcttatcctgggaacagtgatttcatatgtaaaaactgattaacttgcaaactttaaatatgtgcagtttattataaatcaattattcctcaaacctgtaaacaatacagacttcatctctcaaattttgtttaaaatatatatatataaaagaaaatctacagctgttcacagaccatacagcgaaataagtctgcaaataattctaaataaamagggcaatcaaaaaattaccttgagacaaacaaaaagcaacacaccaaaactgatgagatgcagcaaaagcagttctaagagggaaatttatacaaataaacacaataaacacctagagcaaaaaagatctcaaacaacctaatattacatcttaaggaaacagaaaaagaaaaagcccaaagttagcagaaagaaggaaacaataaagatcaaagcagaaatttaaaaattagtgactagaaaatagaagaataaatcaatgaaactaagaattgattttctgaaaagataaacaaaat

SEQ ID NO: 113402 - DNA, 601 bp, Human
tgtatgtttccactgatataaatttatagaaaatgaatactaaacagcagatgattgccagagaagggagtgaggatatgaaaaaagggaagaaggaaaagagggaaggattagaaaaagacagaaggaaaattttgggggtgatggacatgtttatcatcttatcctgggaacagtgatttcatatgtaaaaactgattaacttgcaaactttaaatatgtgcagtttattataaatcaattattcctcaaacctgtaaacaatacagacttcatctctcaaattttgtttaaaatatayatatataaaagaaaatctacagctgttcacagaccatacagcgaaataagtctgcaaataattctaaataaaaagggcaatcaaaaaattaccttgagacaaacaaaaagcaacacaccaaaactgatgagatgcagcaaaagcagttctaagagggaaatttatacaaataaacacaataaacacctagagcaaaaaagatctcaaacaacctaatattacatcttaaggaaacagaaaaagaaaaagcccaaagttagcagaaagaaggaaacaataaagatcaaagcagaaatttaa

SEQ ID NO: 113403 - DNA, 601 bp, Human
agcttccaggaaaccctgaagtcattcatccctttcttagtaaagaactgcataaacataatatagaaacaaaaatctcacataatcttggcataatgattttaaatacaaatacattaaacttttaaaaagaaacataactacattaaaatgtacagactcagccaagatagagttacaagaccacaaacacaacaaaatgatggttttcagaaactgaacaacaggtagagcaagccagtgataactgaaagagaggaggcaaatgaagtgcagcccatgactactctggcttactacstggagctttcagaccacagtgcaagaaagaagaatgcaagcctatacaccctaaaatatttgctctctggttatttgccagcccctgccctaaataaatgaaattgtatgtccacaaagaggctgtacccaagtttcaaagcaatttattcataatagccaaaaattagaaatatctcaaatgtccatcaactagtaaatggataagtaaatggtgatatagtcatacaacaaaataatactcagcaaaaaaaaaaagggctattgataaatgtgacagcatggatgaatgtaatattga

SEQ ID NO: 113404 - DNA, 601 bp, Human
tggtgggaggtgaccagctcatgggaatggatttcccccttgctgttctcataatagtgaatgagttctcacgagacatggttgtttaaaagtgtgtagcacctccccctttgcgctctcttcctcctgctctggccatgtaagatgtgcctccttcctgtttgccttccaccatgattgtaagttttctgagccctccttaggcatgcttcctgtaccgtctgcacaactgtgagtcaattacacctctttctttataaattacccagtcttaggtagttctttatagcaatgcaagaaygaaccaatacagttaagtgcaagaacaaactaatacagttatatttatgtaaggatcaaaatcacgcaacagcaaacactaattttacagatgactacctaagtagtaaaagtgtaaagaagagcaaagaagtaaaaaccacagaggttgggatactggctatctttgggtgggagaaagctgtgattgaaaaaaggcatgttagggcctctaggatgctggcaatattatttttattgccctaagtagttattaaatgggtgttagttacataaaatttcattaagctgtatatttatg

SEQ ID NO: 113405 - DNA, 601 bp, Human
aagtgcctatatataatattatacaccaatgaaaaggaatgaattccatacaacatcatgaatgaatttcaaaatcctaatactgaacaaaagaagctacatgtcaaagagcaaagtgtggtttggatttgtgtccccgcccaaatctcatgtcaaattgtaatccccaatgttggaggaggggcctggtgggaggtgaccagctcatgggaatggatttcccccttgctgttctcataatagtgaatgagttctcacgagacatggttgtttaaaagtgtgtagcacctccccctttgckctctcttcctcctgctctggccatgtaagatgtgcctccttcctgtttgccttccaccatgattgtaagttttctgagccctccttaggcatgcttcctgtaccgtctgcacaactgtgagtcaattacacctctttctttataaattacccagtcttaggtagttctttatagcaatgcaagaacgaaccaatacagttaagtgcaagaacaaactaatacagttatatttatgtaaggatcaaaatcacgcaacagcaaacactaattttacagatgactacctaagtagtaaaagtg

SEQ ID NO: 113406 - DNA, 601 bp, Human
cagtattaaagcttatcaacacacccccttcactaccaacatataatgcactgagaaaagcactattttcataagttcttgccaaaaaatgcaaaagacccaactaagtgacagtctacaaaataactgaccagtattcttttaaaagtatcaaggtcatgaaaaacaagaagaaagtattatcacagattggatgaaagagccatgacaactaaatgtaatataggatcttagagtggatcctagatgagaaaaagtatattattggggaaactggcaaaattagaacaataaatgtacrtaagttgatagcattgtaccaatgtttattttcagattttaataaatgtcctatggttatgtaagatattaaaaatgggggaaaccacgtgaaagatatacaggaatactctatgaaatatttttgcaacttttctgtaagtctagaattattttaaaattaaaaaaaaaaaaattggtcgagggcagtggctcacacctataatcctagcgcttgaggagaccaaggtgggaggatcacttgaagccaggagctcaagactggcctgggcaatgtagcaagaccttatgtctacaatga

SEQ ID NO: 113407 - DNA, 601 bp, Human
tgtctcaaaaaaaaaaaaaaagtctataccaatataaataaatttatgagaagagacagttcttgtttacagtaaaatttatcttaatacatgaaaaaataatgagaaaaatttaaattcaccaatatttaaaatatttaccaaactgaaatttaaaaccaccacagtaataattgttgcaagcaaaaaacatcaaaaggtattaaaattagaaaatgaaagtttagtgagaaacattatattgcatagtctcaaagtttctccccagaaaaacacgtaacaattacaaaaaaaaaaaaaatagcaactttagagaaacactgcaaataaccttaaccaagtaattatggttaactatcaccagtattaaagcttatcaacacacccccttcactaccaacatataatgcactgagaaaagcactattttcataagttcttgccaaaaaatgcaaaagacccaactaagtgacagtctacaaaataactgaccagtattcttttaaaagtatcaaggtcatgaaaaacaagaagaaagtattatcacagattggatgaaagagccatgacaactaaatgtaatataggatcttagagtgga

SEQ ID NO: 113408 - DNA, 601 bp, Human
acagagtgagactctgtctcaaaaaaaaaaaaaaagtctataccaatataaataaatttatgagaagagacagttcttgtttacagtaaaatttatcttaatacatgaaaaaataatgagaaaaatttaaattcaccaatatttaaaatatttaccaaactgaaatttaaaaccaccacagtaataattgttgcaagcaaaaaacatcaaaaggtattaaaattagaaaatgaaagtttagtgagaaacattatattgcatagtctcaaagtttctccccagaaaaacacgtaacaattayaaaaaaaaaaaaaatagcaactttagagaaacactgcaaataaccttaaccaagtaattatggttaactatcaccagtattaaagcttatcaacacacccccttcactaccaacatataatgcactgagaaaagcactattttcataagttcttgccaaaaaatgcaaaagacccaactaagtgacagtctacaaaataactgaccagtattcttttaaaagtatcaaggtcatgaaaaacaagaagaaagtattatcacagattggatgaaagagccatgacaactaaatgtaatatag

SEQ ID NO: 113409 - DNA, 601 bp, Human
agcactttgggaggtgggcagatcacctaaggtcagcggttcgagaccagcctgaccgatgtggcgaaaccccgtctctactaaaaatacaaaaattagccaggcatggtggcaggtgcctgtaatcccagttactcaggaagttgaagcaggagaatcacttgaacccaggaggcggaggttgcagtgagccgagatcgcgccattgcactccagcctggggcaacagagtgagactctgtctcaaaaaaaaaaaaaaagtctataccaatataaataaatttatgagaagagacagttyttgtttacagtaaaatttatcttaatacatgaaaaaataatgagaaaaatttaaattcaccaatatttaaaatatttaccaaactgaaatttaaaaccaccacagtaataattgttgcaagcaaaaaacatcaaaaggtattaaaattagaaaatgaaagtttagtgagaaacattatattgcatagtctcaaagtttctccccagaaaaacacgtaacaattacaaaaaaaaaaaaaatagcaactttagagaaacactgcaaataaccttaaccaagtaattatggttaactatcacc

SEQ ID NO: 113410 - DNA, 601 bp, Human
tctataccaggccaggtgtggtggctcacacctataatcccagcactttgggaggtgggcagatcacctaaggtcagcggttcgagaccagcctgaccgatgtggcgaaaccccgtctctactaaaaatacaaaaattagccaggcatggtggcaggtgcctgtaatcccagttactcaggaagttgaagcaggagaatcacttgaacccaggaggcggaggttgcagtgagccgagatcgcgccattgcactccagcctggggcaacagagtgagactctgtctcaaaaaaaaaaaaaaagtctataccaatataaataaatttatgagaagagacagttcttgtttacagtaaaatttatcttaatacatgaaaaaataatgagaaaaatttaaattcaccaatatttaaaatatttaccaaactgaaatttaaaaccaccacagtaataattgttgcaagcaaaaaacatcaaaaggtattaaaattagaaaatgaaagtttagtgagaaacattatattgcatagtctcaaagtttctccccagaaaaacacgtaacaattacaaaaaaaaaaaaaatagcaactttagagaaacac

SEQ ID NO: 113411 - DNA, 601 bp, Human
cttgcattattcatgggtcaactttattcttaagtccataccaataggccaggtgtggtggctcacatctataatcccagcactttgggaggccaaggcaggaggactgcttgaggccaggagttcaagaccagcctagtcaacatagtgagaacttgtctctataaaaaataaacaagtacattttttaaaaagtctataccaggccaggtgtggtggctcacacctataatcccagcactttgggaggtgggcagatcacctaaggtcagcggttcgagaccagcctgaccgatgtggygaaaccccgtctctactaaaaatacaaaaattagccaggcatggtggcaggtgcctgtaatcccagttactcaggaagttgaagcaggagaatcacttgaacccaggaggcggaggttgcagtgagccgagatcgcgccattgcactccagcctggggcaacagagtgagactctgtctcaaaaaaaaaaaaaaagtctataccaatataaataaatttatgagaagagacagttcttgtttacagtaaaatttatcttaatacatgaaaaaataatgagaaaaatttaaattcaccaat

SEQ ID NO: 113412 - DNA, 601 bp, Human
cagtgcccttgcattattcatgggtcaactttattcttaagtccataccaataggccaggtgtggtggctcacatctataatcccagcactttgggaggccaaggcaggaggactgcttgaggccaggagttcaagaccagcctagtcaacatagtgagaacttgtctctataaaaaataaacaagtacattttttaaaaagtctataccaggccaggtgtggtggctcacacctataatcccagcactttgggaggtgggcagatcacctaaggtcagcggttcgagaccagcctgaccratgtggcgaaaccccgtctctactaaaaatacaaaaattagccaggcatggtggcaggtgcctgtaatcccagttactcaggaagttgaagcaggagaatcacttgaacccaggaggcggaggttgcagtgagccgagatcgcgccattgcactccagcctggggcaacagagtgagactctgtctcaaaaaaaaaaaaaaagtctataccaatataaataaatttatgagaagagacagttcttgtttacagtaaaatttatcttaatacatgaaaaaataatgagaaaaatttaaatt

SEQ ID NO: 113413 - DNA, 601 bp, Human
actgtgtatgttattggtaaggcttccagtcaacagtaagctattagtagttaggtttgggggggagtcaaaaattatatgcagattttctactgcaagggagtcagtgcccttgcattattcatgggtcaactttattcttaagtccataccaataggccaggtgtggtggctcacatctataatcccagcactttgggaggccaaggcaggaggactgcttgaggccaggagttcaagaccagcctagtcaacatagtgagaacttgtctctataaaaaataaacaagtacattttttwaaaagtctataccaggccaggtgtggtggctcacacctataatcccagcactttgggaggtgggcagatcacctaaggtcagcggttcgagaccagcctgaccgatgtggcgaaaccccgtctctactaaaaatacaaaaattagccaggcatggtggcaggtgcctgtaatcccagttactcaggaagttgaagcaggagaatcacttgaacccaggaggcggaggttgcagtgagccgagatcgcgccattgcactccagcctggggcaacagagtgagactctgtctcaaaaaaaaa

SEQ ID NO: 113414 - DNA, 601 bp, Human
actcaagtctaatgaatagcatatttatgttctcttccttgttattttcttaatattttcttttctctagctttattataagaatatagtgtataacacatgtaactacaaaatacatgttaattgactgtgtatgttattggtaaggcttccagtcaacagtaagctattagtagttaggtttgggggggagtcaaaaattatatgcagattttctactgcaagggagtcagtgcccttgcattattcatgggtcaactttattcttaagtccataccaataggccaggtgtggtggctyacatctataatcccagcactttgggaggccaaggcaggaggactgcttgaggccaggagttcaagaccagcctagtcaacatagtgagaacttgtctctataaaaaataaacaagtacattttttaaaaagtctataccaggccaggtgtggtggctcacacctataatcccagcactttgggaggtgggcagatcacctaaggtcagcggttcgagaccagcctgaccgatgtggcgaaaccccgtctctactaaaaatacaaaaattagccaggcatggtggcaggtgcctgtaatcc

SEQ ID NO: 113415 - DNA, 601 bp, Human
gccttcacaatgatgacaaggatgaagacttttaggatgatccactcaagtctaatgaatagcatatttatgttctcttccttgttattttcttaatattttcttttctctagctttattataagaatatagtgtataacacatgtaactacaaaatacatgttaattgactgtgtatgttattggtaaggcttccagtcaacagtaagctattagtagttaggtttgggggggagtcaaaaattatatgcagattttctactgcaagggagtcagtgcccttgcattattcatgggtcawctttattcttaagtccataccaataggccaggtgtggtggctcacatctataatcccagcactttgggaggccaaggcaggaggactgcttgaggccaggagttcaagaccagcctagtcaacatagtgagaacttgtctctataaaaaataaacaagtacattttttaaaaagtctataccaggccaggtgtggtggctcacacctataatcccagcactttgggaggtgggcagatcacctaaggtcagcggttcgagaccagcctgaccgatgtggcgaaaccccgtctctactaaa

SEQ ID NO: 113416 - DNA, 601 bp, Human
tcctcttcctcagccttcacaatgatgacaaggatgaagacttttaggatgatccactcaagtctaatgaatagcatatttatgttctcttccttgttattttcttaatattttcttttctctagctttattataagaatatagtgtataacacatgtaactacaaaatacatgttaattgactgtgtatgttattggtaaggcttccagtcaacagtaagctattagtagttaggtttgggggggagtcaaaaattatatgcagattttctactgcaagggagtcagtgcccttgcattrttcatgggtcaactttattcttaagtccataccaataggccaggtgtggtggctcacatctataatcccagcactttgggaggccaaggcaggaggactgcttgaggccaggagttcaagaccagcctagtcaacatagtgagaacttgtctctataaaaaataaacaagtacattttttaaaaagtctataccaggccaggtgtggtggctcacacctataatcccagcactttgggaggtgggcagatcacctaaggtcagcggttcgagaccagcctgaccgatgtggcgaaacccc

SEQ ID NO: 113417 - DNA, 601 bp, Human
aatgatggaaagcatgtcaaaaagacacagaagccaacttgaaagagttcccaatggtcaaaatcaaaacactaaaataaaattatagtattggattataacccataaaataaaatacagctctgacccttgaataacatgggtttgaaccacgtaggtccacttatacgcagatttcttccacctctgtcctcactgagacagcaagaacaacccctcctcttcctcagccttcacaatgatgacaaggatgaagacttttaggatgatccactcaagtctaatgaatagcatatttatkttctcttccttgttattttcttaatattttcttttctctagctttattataagaatatagtgtataacacatgtaactacaaaatacatgttaattgactgtgtatgttattggtaaggcttccagtcaacagtaagctattagtagttaggtttgggggggagtcaaaaattatatgcagattttctactgcaagggagtcagtgcccttgcattattcatgggtcaactttattcttaagtccataccaataggccaggtgtggtggctcacatctataatcccagcactttgggagg

SEQ ID NO: 113418 - DNA, 601 bp, Human
gtggttaaataagctacggttaaatccacacagtggaataatatgcagcggtaaaaaatgaggacaatctctacttaccaataggaaatgatttccaggatatatttactgtgttaagtgaaaaaaagaaggcgcaagagaggatatatagtatgctatcctttggtaaagaaaaagtacaataacattcatgtgtctgtttctttgtacaaaggaattacaggaaggctaaaacagaaactaaagagactggtttcccatgagggataggtgaaaacaggtagaaatcatgggggaataraaatagggcagcaggatgagtgaagagtgacatatctatgagagtatctttttatacagttaggacttagaaccattacaatgtttcatataccaaacgatcaattaaaatcaatcagtatgttgagagaacctaaaaaggaatgaaaataattatatttacaaatgaataatacacatgaagggggatggggacgaaaaggagctaatttaagtaacttcagaaaatagtattttgactatattctctaaggctaccaacaaaaagaaatgtagacaaacactgtacttaagtcaataa

SEQ ID NO: 113419 - DNA, 601 bp, Human
tggcaaaaaaacaccataaacaaagtcaaaagataactgacaaactgggagaaaatatttgtaacatataccacagaaaagggactactaactttaatatataaagaactcttaaacattgagaagaaatgggaaaaacacattaaaaagataattcaaaaatataaaacatggacattaagcgtatgtaaaaatattcaaactcacttgtaactagaaaaatgcaaattaaaacaacactgagatacaattcccacttaccagattggcaaaattaaaaggtatggaccacacattctgstggccaggctgtggaaaacagacactctcgtatactactattggaaatgcaaactagtataacccgtctggagggaaatttggcaaaactacacatgcacttagcttttgacccagtcatcttccttctgacaatgtccttgaagatgtacctccaaaaactaaaaaatacatatacacaaggctatttattgcagcactgtttgcagttgcaaaatgttaaggacaacccaaacgctcagacatggcagagtggttaaataagctacggttaaatccacacagtggaataatatgcagc

SEQ ID NO: 113420 - DNA, 601 bp, Human
tactggtatatctgtctacattaaaattaataatttatgtttatcaagagatagactaagatccaaacttcgcacaagtcacaagaataaactccaaatggattgggaatctaagtacaaaaaaaggagaaaccttacaagtattaaaagaaaacctgagtaaattcctcttcaatcttgatataacaaggaaataagagaaaatgttggtaaatcatactatgtaaaaatttttttaaatggcatggcaaaaaaacaccataaacaaagtcaaaagataactgacaaactgggagaaaayatttgtaacatataccacagaaaagggactactaactttaatatataaagaactcttaaacattgagaagaaatgggaaaaacacattaaaaagataattcaaaaatataaaacatggacattaagcgtatgtaaaaatattcaaactcacttgtaactagaaaaatgcaaattaaaacaacactgagatacaattcccacttaccagattggcaaaattaaaaggtatggaccacacattctgctggccaggctgtggaaaacagacactctcgtatactactattggaaatgcaaact

SEQ ID NO: 113421 - DNA, 601 bp, Human
taatctttctaataaatagtgcagggataactggctatccacacagatgaaaataatgccatacaggaaaatactggtatatctgtctacattaaaattaataatttatgtttatcaagagatagactaagatccaaacttcgcacaagtcacaagaataaactccaaatggattgggaatctaagtacaaaaaaaggagaaaccttacaagtattaaaagaaaacctgagtaaattcctcttcaatcttgatataacaaggaaataagagaaaatgttggtaaatcatactatgtaaaawtttttttaaatggcatggcaaaaaaacaccataaacaaagtcaaaagataactgacaaactgggagaaaatatttgtaacatataccacagaaaagggactactaactttaatatataaagaactcttaaacattgagaagaaatgggaaaaacacattaaaaagataattcaaaaatataaaacatggacattaagcgtatgtaaaaatattcaaactcacttgtaactagaaaaatgcaaattaaaacaacactgagatacaattcccacttaccagattggcaaaattaaaaggtat

SEQ ID NO: 113422 - DNA, 601 bp, Human
ttaatcaatgaatttataataagattcctggatactagatcaattagagaaaaatagcagttgtattaccagcaacatgcagttaaaaaatgaaactatggatgatccaattcaaaatgaaatgataaaaaatatttttaatctaggaataaaactaacaaaagaagtgaaagaccttaattaataaaagtatcaaacattattgcaagaaatttaagaaaacctaagtaaatgaaagaatacaacatgttcataggtaggaaattacaacactgttaccacataaaatgttcacaacccratttatatattaaatgcaatctaaaaactcctgacagaatttgtatgagaaactttataagctcattcgaaaatatatgaggaaaagcaaaacaacaaaaatattaaaaatcatcctaaagaagaacaaagtaggaggacttgcttactagatatcaagacttcttctcatgaagctttagcaataatgaaaatgtgattgacgtaaggacaaacaagtacgtcagtagaatagaacagagaacctagaaacagacctacgcataggcactgaatttataacaaaggtggcactgcagag

SEQ ID NO: 113423 - DNA, 601 bp, Human
cctctccttcctcccacataaagcaaattttgaacaaataaaataatgcagatcatagcctcagaacataactcagctagaaatcaataacatataagtaaccagaaaaatctccatgtctgtaaagacagaagtgtacttataaataacccatagatcagaggtaaaatcataattgaaattatgaaatgtcttcaaccaaatagcaaaataacaatatatcaaaacttgtaggttgcagttaaatccaagttataaagaaatttacaatccaaaatatatatatgaaaaagaagaaatrctttatagaaattgatgagttaagtatccacctcaagaaattagaaaaatgacagtaactgaaacccaacaaaaatagaagcaaagagataacaattagcagaaattcatgaaacggaaaacacactggagagtatcaaaaacactaaaaactattccttctaagacaataattgaattgattctgaatgaggctgacaaagaaaacacacaaataatcagtaggacaaagaaaaaagaaaacagcctaaatgtagtaataaataataagaggatattataaatacttttatcccaacaa

SEQ ID NO: 113424 - DNA, 601 bp, Human
ttactctttgaatcttctagtgggatgtaaatttaaaaagtgtattccataaagcaaattttttttcctttttttaaaatttccaacttttattttaagttccggggtacgtgtgcagaatgtgcaagtttgttacatcagtacacatgtgccatgatggtgtgctgcaaagatcatcccatcacccaggtattaagcccagcatccactagctactcttcctgatcctctccttcctcccacataaagcaaattttgaacaaataaaataatgcagatcatagcctcagaacataactcrgctagaaatcaataacatataagtaaccagaaaaatctccatgtctgtaaagacagaagtgtacttataaataacccatagatcagaggtaaaatcataattgaaattatgaaatgtcttcaaccaaatagcaaaataacaatatatcaaaacttgtaggttgcagttaaatccaagttataaagaaatttacaatccaaaatatatatatgaaaaagaagaaatgctttatagaaattgatgagttaagtatccacctcaagaaattagaaaaatgacagtaactgaaacccaacaaaa

SEQ ID NO: 113425 - DNA, 601 bp, Human
aacaaaataccttgaaacaacttatagcaccttgaatactgacttacataaaattccactgcttaggaagttatccaaagaccagactacatccaatacatctactattagaaaacaaacaaccaaacaaatagaaagcaaatacactgaatataggatcagtagtgccatcttcaacttaagaaaatgcatatcattgataaggtctacattactctttgaatcttctagtgggatgtaaatttaaaaagtgtattccataaagcaaattttttttcctttttttaaaatttccaacttytattttaagttccggggtacgtgtgcagaatgtgcaagtttgttacatcagtacacatgtgccatgatggtgtgctgcaaagatcatcccatcacccaggtattaagcccagcatccactagctactcttcctgatcctctccttcctcccacataaagcaaattttgaacaaataaaataatgcagatcatagcctcagaacataactcagctagaaatcaataacatataagtaaccagaaaaatctccatgtctgtaaagacagaagtgtacttataaataacccatagatcagagg

SEQ ID NO: 113426 - DNA, 601 bp, Human
tatttttaaattgcaacaaaataccttgaaacaacttatagcaccttgaatactgacttacataaaattccactgcttaggaagttatccaaagaccagactacatccaatacatctactattagaaaacaaacaaccaaacaaatagaaagcaaatacactgaatataggatcagtagtgccatcttcaacttaagaaaatgcatatcattgataaggtctacattactctttgaatcttctagtgggatgtaaatttaaaaagtgtattccataaagcaaattttttttcctttttttraaatttccaacttttattttaagttccggggtacgtgtgcagaatgtgcaagtttgttacatcagtacacatgtgccatgatggtgtgctgcaaagatcatcccatcacccaggtattaagcccagcatccactagctactcttcctgatcctctccttcctcccacataaagcaaattttgaacaaataaaataatgcagatcatagcctcagaacataactcagctagaaatcaataacatataagtaaccagaaaaatctccatgtctgtaaagacagaagtgtacttataaataac

SEQ ID NO: 113427 - DNA, 601 bp, Human
aaccctgactcacttggtaccaggtaattgttttgcccttaagttaggcgaacattaccataacctttatacaaatgctaacaactgtaagatatttgcttgcaactaaatacttctatactgtggctaccaaagaggatgttttggaaagtagcaataaggaggcattgttggacaaaaacaatttatcacagctttagaagttaataggcaagactaatatccattttgctttcaattttccaaacacaaacattaaccaatatctattctgaaaagaaagccccaaaattgtttccasaaaagtttctcataaaagaaagtagaacttgtcaggtaatagaataaacatttaaaagaacttcactcacccaatattgatgatacatcaaacacagaaaaactgctttaaaagtaaattgagtctgtaattatttcaaattaaaagtttaaaaggagcaagggattctttctaaaaataagctaaataactcaaaattaactgttctatctacaagccataactatagtacccgttatcagatatatttttaaattgcaacaaaataccttgaaacaacttatagcaccttgaatactg

SEQ ID NO: 113428 - DNA, 601 bp, Human
aataaacacatttatatgtatattttaaaatagaaaccctgactcacttggtaccaggtaattgttttgcccttaagttaggcgaacattaccataacctttatacaaatgctaacaactgtaagatatttgcttgcaactaaatacttctatactgtggctaccaaagaggatgttttggaaagtagcaataaggaggcattgttggacaaaaacaatttatcacagctttagaagttaataggcaagactaatatccattttgctttcaattttccaaacacaaacattaaccaatatstattctgaaaagaaagccccaaaattgtttccagaaaagtttctcataaaagaaagtagaacttgtcaggtaatagaataaacatttaaaagaacttcactcacccaatattgatgatacatcaaacacagaaaaactgctttaaaagtaaattgagtctgtaattatttcaaattaaaagtttaaaaggagcaagggattctttctaaaaataagctaaataactcaaaattaactgttctatctacaagccataactatagtacccgttatcagatatatttttaaattgcaacaaaa

SEQ ID NO: 113429 - DNA, 601 bp, Human
aatttcttaaatatatcagttggcacatatatatgtatgtatgtatatttcacttttaaaaaacactgttctttcttattcatatacttctttcttattcattatcccttaccatatattatattaccacctttgtttgagtggattttaacatgtgtcataatttaaaggcctgctatgcataagataatactttgagaacacaaattctcacttttaaaatggatttctttaaatacttttaactttcaaaaattattttaacaaattgtatatgtaattatagtcaagtaatatgtamcacttcatcatgcacggtgcttatatacaatatagcaatcacacattttaaattcccagagtaaagcattaattcagcactaataaacacatttatatgtatattttaaaatagaaaccctgactcacttggtaccaggtaattgttttgcccttaagttaggcgaacattaccataacctttatacaaatgctaacaactgtaagatatttgcttgcaactaaatacttctatactgtggctaccaaagaggatgttttggaaagtagcaataaggaggcattgttggacaaaaacaat

SEQ ID NO: 113430 - DNA, 601 bp, Human
actttgggaagccgaggaggggggatcacctgaggtcaggagtttgagaccagcctgaccaacgtggagaaaccccgtctctactaaaaatacaaaaattagccaggcgtggtggcgcatgcttgtaatcccagctactcaggaggcttaggcagaagaatcgcttgaactcaggaggcagaggttgcagtgagccgagatcacgccattgcactccagcccgggcaagaagagcaaaactctatctcaaaaaaaaaaaaaaaagcctacaaagtattaaagggtcactaagagaatattwatagctgctaaatacaattctgaattaagccaacttagcaaaaagtttttcttacatttggaatgtaagtgatgacatcataatttgaaacatactgttgatggttacaaacacgactaaaggcatttgtttagtagattcaaataggaaatgtcccctaatctaagaaatggagaatttcttggcccatcatttgacaaataagaaattaaccaacaaaactttaaatcgctcccaaatcattgctggtatcataaattgaatgttagttatatatagcagtagtttaatttatttcct

SEQ ID NO: 113431 - DNA, 601 bp, Human
tctaatataaaaaaatggtaatggttatggtctctgcattatcccttccttcttattcccacagttctaatatgcccatctctcttaaatgcaatgaaacattgagaatgaagaaatactatcattataactgtgcttgtggagtatgtaaggaactggtagtggtacagggtataggaaggacataattaaatattcttgtgtttaactgacctaaatgtagatatatctcatctttcttttatcacaaatcttttcataatggacattgtgaataaatggatacaactccagtctgaayacgattacacataaagaagaagaaaaaaactgcccatattccttgcccagaggaactatgcaacgtcacttctcagagtctcaacattaaaagttaatggccttttaacataatagaattctaatgatctctaggatgactataaattccattgcatgaatctgagaatggaacactgtgtggtatctagagtcaaaacaaaaaactaaacaacaactgcaaactcaaaacaatcaaaaagttctcggcatgccatactgatataatcatagaaaattagaacacaagattatcgtaacc

SEQ ID NO: 113432 - DNA, 601 bp, Human
agaactcgaagtttcaaattaaccatgaagaatttcaaatggcatatattttattttgcacgcaatatggagtcatattgaaagatgtacttatttcttataaaacaataaacatgaaaataaaaatcaaaccaaatagaggtctaatataaaaaaatggtaatggttatggtctctgcattatcccttccttcttattcccacagttctaatatgcccatctctcttaaatgcaatgaaacattgagaatgaagaaatactatcattataactgtgcttgtggagtatgtaaggaactgrtagtggtacagggtataggaaggacataattaaatattcttgtgtttaactgacctaaatgtagatatatctcatctttcttttatcacaaatcttttcataatggacattgtgaataaatggatacaactccagtctgaacacgattacacataaagaagaagaaaaaaactgcccatattccttgcccagaggaactatgcaacgtcacttctcagagtctcaacattaaaagttaatggccttttaacataatagaattctaatgatctctaggatgactataaattccattgcatg

SEQ ID NO: 113433 - DNA, 601 bp, Human
acctaaatatatcgtaccaaaatctaacaggaaaacctgacaaatacctataaccttaacaaaaggtaccctccaataaggggtataacagagaaactcaccattggaaagtagcggaataaaggtatttgctatgaagggatctggaaaagtttgaatagatgggatttgggattagcctcactcaaagagtgggtacacaaagggagaaacttacacaatgtcctgagaaaaagatttgagataaagagggcacaagtatggacagagtaagaaataatttagttggagatgagaactygaagtttcaaattaaccatgaagaatttcaaatggcatatattttattttgcacgcaatatggagtcatattgaaagatgtacttatttcttataaaacaataaacatgaaaataaaaatcaaaccaaatagaggtctaatataaaaaaatggtaatggttatggtctctgcattatcccttccttcttattcccacagttctaatatgcccatctctcttaaatgcaatgaaacattgagaatgaagaaatactatcattataactgtgcttgtggagtatgtaaggaactggtagtgg

SEQ ID NO: 113434 - DNA, 601 bp, Human
ccatctcaaataataataatgatcagtaaaatgttgagaatgaaaaatgtagaacactctaatatattagtaattctaacaaaattacagagggcccttgaataacacaagtttgaacagcatgagtccacttatacagggatcgtttttcaataaaagttacactgagtgtgcctgcctctcctgcctccccttccacctcttccacctcttctgcctctgccaccacggagacagcaagactaacccctcttcctcctccttctcagcctagtcaacgtgaagataacaaggatgaagrcctgtatgatgatgcaccaccactatgcactgtacaggagataatataaacctaaatatatcgtaccaaaatctaacaggaaaacctgacaaatacctataaccttaacaaaaggtaccctccaataaggggtataacagagaaactcaccattggaaagtagcggaataaaggtatttgctatgaagggatctggaaaagtttgaatagatgggatttgggattagcctcactcaaagagtgggtacacaaagggagaaacttacacaatgtcctgagaaaaagatttgagataaagag

SEQ ID NO: 113435 - DNA, 601 bp, Human
cttagcctcccaaagtgctggaacacgatatttttatatgttgattattattagcaaggttttgatggattccagataagagaacatccaggaaaagtacactgaaaatgaacaaacataccttgatttgtgcaaagggtctttcataacctccaacatacaggaggccaacattctgaggaagtaacctacaaagaaaaaaaagcattatttataaaatactccttcttataaataaggttgtataattatcaaaatttgaataatagatataatatagatatactataaaatatattaratggatgctgtgagaaaagtaataactgtgtaattattcttatctttcacactatgagatagtaaccagaaaataaataattttatatttcagaaaataatgggagccaagtgtggttgtgtgtgcctatagtcctagtacctcgacagactgaagcaggaggattgcttgactccaggagtccaaggttgtagtgtgctatgactgcacctgtgaatagccactccctttagtctgggcaatataacgagaccccatctcaaataataataatgatcagtaaaatgttgagaatgaaaa

SEQ ID NO: 113436 - DNA, 601 bp, Human; identical to SEQ ID NO: 28694

SEQ ID NO: 113437 - DNA, 601 bp, Human; identical to SEQ ID NO: 28695

SEQ ID NO: 113438 - DNA, 601 bp, Human; identical to SEQ ID NO: 28696

SEQ ID NO: 113439 - DNA, 601 bp, Human; identical to SEQ ID NO: 28697

SEQ ID NO: 113440 - DNA, 601 bp, Human; identical to SEQ ID NO: 28698

SEQ ID NO: 113441 - DNA, 601 bp, Human; identical to SEQ ID NO: 31475

SEQ ID NO: 113442 - DNA, 601 bp, Human; identical to SEQ ID NO: 31476

SEQ ID NO: 113443 - DNA, 601 bp, Human; identical to SEQ ID NO: 31477

SEQ ID NO: 113444 - DNA, 601 bp, Human
atttcagaggatgacactgatgcttcctgggctggctgagttggaggacaattcgaaggcagagaaaccaggtgggagtggcctttatccctcaacactgtgagacgtgatggtggcctgacctcagagaggagggggcagactcttaaaacagttaattgcccaaatcacaggggcagctggggccttggtgtttctggtcattgcgtgtggaacaggacccctcatgaggactgaaagctgacgctcttcctccccctgcagcctctcgcatgacagggttgagcagggccagtgacagtggatggggctctggctcagggcatgaagatcatcattttggtctacaaatgcccctggttcccttttagacaattcaggggaggtatgagaccaagagagatacaaaagattctccttccaatttggctcaagtcagaataaattcaggtcaaaaaatgaaagcagttggatcactcttgtttcctaagtacagggagcagttcatatctgttagagacattttatttagaggcaagaaatggttaataagatgagacccttgggtctaggagcgtttgctctttgttttcttccttag

SEQ ID NO: 113445 - DNA, 601 bp, Human
gccatgttggccaggctggtctcgaactcctgacctcaggtgatccacccgcctcggcctcccaaagtgctgggactacaggcgtgacccaccacgcccggccaggtttttcgttttcaaaaatgaggtagggtgtctattttgcccaggctggtctcgaactcttggattcaagcgatatttcctcctcagcctccagagtagctggtatagactataggggcccactgccccggccggcaagataattatttactctcaccaaatttgattcaatcgttttggccaagtttttaaaaayaggaatattcccagggaccatgtttgaagaaatacaaactcaagtaagcagaggtgaaatgacctgagagatttgctttaatacacttcggcaaagaaagaaaaaaggtatggatgaaactttgtgacaaacgcaactgttaaatgtaggtgatggcatatagggattcatctcacctttcctcttttgtctatgcttaaaagttttcacagtaacttttcaaaaaaaattattatttccaaacaaacttactgtcctatcaattaaacacaagtcactggatgagaacgctgttgtctt

SEQ ID NO: 113446 - DNA, 601 bp, Human
agaccggcaagtataaatgctttatggtaattacagaagtgaaacaattctgaatgtcgatttattgtttgtatgcagctacagtaatttattaataagtttatactcttcaggcatctctcaacattaaatacgcattataatactttatactttgaagttatgtcctgtttgatattaaagctgttattaaaataacagctagtaagttttttgactctttccaataggatacaattttataaactgaattggtggttagtcacaaggacctcactaagcaaagcttccttgctatatcgttattacatatgatacttcttgttcttttttttattggctctggagttgaaacatatcctatttctaatttaagtagtgtagacttattctaatgtcattgggtatacaattcattttttcttcctttttaaattgtggtaagatgtacataaaatgtgccacttcaccattttaagtgtacaattcagtgtcattaagtacatacattgtgcaaccatcaccattatccaacttcagaactttttcattatcccaaactgaaactctgtacctattaaacaataacaccctattacac

SEQ ID NO: 113447 - DNA, 601 bp, Human
gtggtcagacatataaatcaatggaacagaactgagtctagaaactgactcacatttacagtcaatccattttcttttttttccccatgttactgagtccatgcataacaatcaattttcaacaagagtaccaagacaattaagtgagaaaagaatagtctcttcaacaaatggtgctgaacaactggatatttacatgtaaaagaataaagtactcggccaggcacggtggctcatgcctgtaatcccagcactctgggaggccaaatcaggtgcatcacgaggtcaggagttcaagacyagcctgaccaacatagtgaaaccccgtctctaccaaaaatacaaaaaattagccaggcgtggtgacgggtacctgtaatcccagctactcgggaaactgaggcaggagaatcgcctgaacccaggaggcggaggttgcagtgagccaagattgtgccattgtgcactccagcctgggcgacagtgcgagactccgtctaaaaaaaaaaaaaaaaaagaagaagaaagcttttttaatatatatatattaaaaaaaaaaactcaaaatgtaccaaagacttaaatgcaaaagataaaacta

SEQ ID NO: 113448 - DNA, 601 bp, Human
cagataccacttatctactaaccatttttaaaatttggtgtgcattaaagttaaccatatccagaattctctgatgatggctacaaaaaaagccctggagtaccgccaacaacatagggcttcttttttttgggctgagaaaccaaccaactagttgagcattggatgcttggtctagaaatgccaagacaaatcacctgccctgttaaaaatcatggagtcaccaaaaacaaagctccaataatcttccccaaaagaaccctcaagaacatgacaattcttaccactgagtttaagatgaaaaaaaaaaaaaaagaacagaataagaaagaacataagtatgtctgctgatagcatgaagtaaactctttgaattataattttacttttaaaatattggatgcctcgaaaaaacaaaagcacatgtatcacttcattctgagaaatttgttaggcaatttcatcattctgcaaacattacagagtgtacttacacaaacctagatggtacagcctacaacacacctagaatatatggtaaagcctattactcctaggctatttgtatatctaaacatagaaaacgtatggtaaaaatatg

SEQ ID NO: 113449 - DNA, 601 bp, Human
aacctccagccccctttctctccccagagattagacttcctcaagcatcagccctcctatcacatggttggtctttctggtgaccagcccccatcctgaatcatctcattaacataaactcagttatgatccaaaaggctcatgaataacaaagaaagatacttctatcacttggaaaattccaaaggttttagacacattatgccaggaaccccaggaaaaaggctagtcacattctttattatacaccaaaaaacaaacttaaaactctctactccaggtgaatagggttgtaaatttaaaaaaaaaaaaacaaagtaaacttaaaaaaacctctcaacttacaaaaataaagataaacatagaaaaagatatccaaggccactgatgcccactcattttaggggcactaaactccactctgaagtaagagcagtcttgctgaaaattattaggatttcagataccacttatctactaaccatttttaaaatttggtgtgcattaaagttaaccatatccagaattctctgatgatggctacaaaaaaagccctggagtaccgccaacaacatagggcttcttttttttgggctgagaa

SEQ ID NO: 113450 - DNA, 601 bp, Human
aataattttttaaaattagccaggtgtggtgccacgcacctctggttctagctactagggaggctgaggtaggaggattgcctgagcccgggaggtcaaggctgcagtgagctatgatcgcaccactgcattccagcctgggtgacagaagaagacccttgtctcaaaaaaattcaggggttcccatgacccctctggttcaatattcactagaactcacagaactcagaaaagcactgtatttacaattatagttttattataaaggatacaaatttgggccagtgaaatgaagagacayacggcaaggtctgtaagggtcctgaacacaaacttctgtcccctttccccatggaatcaccctcccagcccatcaatggatttacctaccaggatgatccaccaattttgtgttgagagtttttactggcgtttcctaacatagacacgattgaatcattggccacataactaaactcaacctccagccccctttctctccccagagattagacttcctcaagcatcagccctcctatcacatggttggtctttctggtgaccagcccccatcctgaatcatctcattaacataaactca

SEQ ID NO: 113451 - DNA, 601 bp, Human
tgtcagaaaaaaaaaaaaaaaagaatgaaaacagggccaggcgcagtgtctcacgcctgtaatcccagcactttgggaggccaaggcgggcagatcacttgatgtcagttcgagaccagcctggccaacatggcgaaaccccatctctaatatagctggacatggtggcgcatgcccgtaatcccagctactcaggaggctggggcaggagaatcccttgaaccagggaggcagaggttgcagtgagccaagattgcaccattgcactccagcctgggtgacggggcaagattctgtctcaaaaaaaaaaaaaaaaaaaaaatggagtttcccagcatccagcctggcactgcctcagaccagttcttcacacagcttgcatggggtataaatatggtgatgttccttccctttataaagctgtttaatgtgtccctggcctgtagaagcatctcccaaacttccatggccacagaaccatttcaaattgatagaacaccagctagcactcacaatatctactaaattgaatctatatgcttagattagagcaaagagaaggaaaaaatggcctcggtaactgatgccaaaagaaaaaaat

SEQ ID NO: 113452 - DNA, 601 bp, Human
aactagccgggcatggtggtgtgcacctgtagtcccagctactaggggactgaggcagcagaatcgcttgaacctgggaggtgaaggttgcagtgagccgagattgcactactgcactccagcctgggcgacagagcaacactccatgtcagaaaaaaaaaaaaaaaagaatgaaaacagggccaggcgcagtgtctcacgcctgtaatcccagcactttgggaggccaaggcgggcagatcacttgatgtcagttcgagaccagcctggccaacatggcgaaaccccatctctaatatarctggacatggtggcgcatgcccgtaatcccagctactcaggaggctggggcaggagaatcccttgaaccagggaggcagaggttgcagtgagccaagattgcaccattgcactccagcctgggtgacggggcaagattctgtctcaaaaaaaaaaaaaaaaaaaaaatggagtttcccagcatccagcctggcactgcctcagaccagttcttcacacagcttgcatggggtataaatatggtgatgttccttccctttataaagctgtttaatgtgtccctggcctgtagaagcatctc

SEQ ID NO: 113453 - DNA, 601 bp, Human
tggtaacttattccaaaaacggaatatgacccaacccaagccattccttctctggaatattctaaactggggatacagaatagctcgctctttagtttggatcaggaactgctttaggcactgtggagccaatggagtagatctaccgcaagggaataagagggtcatacatgcattttggaaagattattctaataatagtatcaccaatggaataagacacggagtgggaagaccagtaatgggcctactgtaatattcctgacaaaaaaatgaagaaagcttgaatggtaacgggaayggagaaaagggaacacattaggaaacatttggggattgccttttgtctcactggaaatactgtcctaaaacagagaacctgactccttaattctcttgcacatagatgactactgtgaacactcgattcatatgataagtacttaccaagtacctagaaaccagtaagaatgaagtagttataagcatagattctgagccaggctgcttgggttcaaatccagtcacctcacttactagcagtgtgaccttgaataagttacttaacctctgtgcctcactttcctcatctataaaacca

SEQ ID NO: 113454 - DNA, 601 bp, Human
aaaaataataataataataaggtaataggctgggcgcagtggctcacgcctgtaatcccagcactttggaaggctgaggcaggtggatcacgagatcaagagattgagaccatcctggccaagatggtgaaaccccgtctctactaaaaatacaaaaattagttgggcatggtggcacatgcctgtagtcccaccgattcgggaggctgaggcaggagaattgcttgaacccaggaggtggaggttgcagtgagccgagattgcgccaccatactccatcctggtgacacagcaagactaygtctcaataaataaataaataaataaataaataggccagacgtggtggctcacgcctgtaatcccagcactttgggaggccaaggtgggtggatcacctaaggtctggagttcgagaccagcctggccaacatggtgaaaccccatttctactaaaaatacaaaaaattagccaggcattttggcgggcgcctgtaatcccagctgaggctgaggcaggagaattgcttgaacccggcgggtggaggttgcagtgagccaaggtcgcaccattgcgctccagcctgggcaacaggaacga

SEQ ID NO: 113455 - DNA, 516 bp, Human
taaaaaaattagctgggcgtggtggcacgcgcctgtaatcccagctactcaggaggctgaggcaggagaatcgcttgaacccagaaggtggtggttgcagtgagccaagatcacaccattgcactgcagcctgggtgacagtgcgagactccatctcaaaaaaaaaaaaaaaaaaaaagaagctagaagctggctttattactaatacttctccawccttgcctcctatacctctctcccctgttcccatctgaccatctaaaaccctccttctgcccagaaaaggaatattttcacagcctgtgtgtgtacatccactgataccctccttctcattcttccaggcagttcctatatccctcccctagaatcctgtacatttataagtgaaaacaccctaggcacattgaaactggttcattgtctgtctagagtatagaccatgaactcttagaagactggcattttgtcagactcatttctaaatctctagcatctagcacagtgctcagcaca

SEQ ID NO: 113456 - DNA, 601 bp, Human
gacataatgctccgtacatattgaagcacaaagaactaaagataagaggcaaataattctgactggaaaagaataggaggtacctcttctagtttctggatacagaagacaaaagtccatttgcatagaaatttgggcaagagagccttaattcttccttgggtataatgaagttgtccgccgggcataggggctcacacctgtaatcccagcaagaggactgctgagaccaagggttcgagaccaacctgggcaaggtggcaagaccctatctctaccaaaaaaaaaaaaaaaaaaaaaattagctggcaggatggtatgcacgtgtagtcctagatatttgggaggctgaggcaggaggattgctggaatccaggagttcgaggtttcagtgagctatcatcaagccactgcattacagcctgggctacagagtaagatcctgtctctttaaaaaaaaaggctggacatggtggctcacgcctgtaatcccagcattttgggaggccgaggcggcggatcacgaggtcaggagattgagatcatcctggctaacacagtgaaaccctgtctctactaaaaatacaaaaaattagccagg

SEQ ID NO: 113457 - DNA, 601 bp, Human
ctctgagaactttgtaaacacaactgtgttctacagacagcaaaagcttctctaaacttgtgttagtcacatggtcaaattagacataatgctccgtacatattgaagcacaaagaactaaagataagaggcaaataattctgactggaaaagaataggaggtacctcttctagtttctggatacagaagacaaaagtccatttgcatagaaatttgggcaagagagccttaattcttccttgggtataatgaagttgtccgccgggcataggggctcacacctgtaatcccagcaagagkactgctgagaccaagggttcgagaccaacctgggcaaggtggcaagaccctatctctaccaaaaaaaaaaaaaaaaaaaaaattagctggcaggatggtatgcacgtgtagtcctagatatttgggaggctgaggcaggaggattgctggaatccaggagttcgaggtttcagtgagctatcatcaagccactgcattacagcctgggctacagagtaagatcctgtctctttaaaaaaaaaggctggacatggtggctcacgcctgtaatcccagcattttgggaggccgaggcggcgg

SEQ ID NO: 113458 - DNA, 601 bp, Human
tttttgcaaaagtcttttacaatagacctaagcccctcaaaaccaagcagtgggtcagttcatagtcttctacactcaatcacaaatagttgttcaatgtgataatattaagacaatataggaaatacagtatttctttgaaaacaaactataccttcaatatattcaacctggcaattttatttctgcccacatctatattccatctaatttgtatcattccaattgaataagaagtctaccaaatttattgataatgttatgatataaagtagtgaaattttctttttttctttctttytttttttttttttttttgagacggagtctcgctctgtagcccaggctggaatgcagtggcgcgatctcggctcactgcaagctccgcctcccacgttcacgccattctcctgcctcagcctccggcgtagctgggactacaggcgcccgccaccatgcccggctatatttttgtattttttaagagatgggttttttgtttttgttttgttttgttttgttttgagacggagtctcgctctgtcgcccaggctggagtgcagtggtgacatctcggctcactgcaagctccgcctcccgg

SEQ ID NO: 113459 - DNA, 601 bp, Human
cataggtaattttacttttagataatgttctgtgatgggagcttatctttttattcaaaatatctgttttttcaatatattcctatcttaaaataacattttagaagtatgttatgaaatagaacacatacctgatactcgtctattaaatctgctaggaactggaactgcaaaataaagaagcaacatttagtcattattatgtcaccaggccgcatttttatcctccctttttgcaaaagtcttttacaatagacctaagcccctcaaaaccaagcagtgggtcagttcatagtcttcyacactcaatcacaaatagttgttcaatgtgataatattaagacaatataggaaatacagtatttctttgaaaacaaactataccttcaatatattcaacctggcaattttatttctgcccacatctatattccatctaatttgtatcattccaattgaataagaagtctaccaaatttattgataatgttatgatataaagtagtgaaattttctttttttctttctttttttttttttttttttttgagacggagtctcgctctgtagcccaggctggaatgcagtggcgcgatctcgg

SEQ ID NO: 113460 - DNA, 601 bp, Human
ccctctcccgtgatgcgcccacgctggggctccggaccctgggtcctctgagcagacaagctcggggaactgccgggagaagcagaagggcacagcccaacccgaagactgcggtcatctgaacaaaactgaccaggaagggagctctctccgggcctttttttttttttttttttttcaaaactctgtcgaaatcccatcttgaaaagcgttctttttgaattcgcacttgaattaacagcgatccatagagcttaaaataccgactttatctcggtgagcactgtgccagcttgagtggtgtgtttccgattcggttgaaagcgtatttcctttccgtggaggggcggcggtggtagtgcctgcaagaacactgcagcttgagaaactggcaggctcactgattagtcacataccactgctcatttaagtattgttcgacaaaacaattttctcatttggagcaagaaagattcagatctgtaaggcgccctcaagatcaaaaagttattaacagtgctgggaggtattgtaaatattttttgagataattcctgcgaatactgtgttttaaaagtcccttagagagcttgcagggagt

SEQ ID NO: 113461 - DNA, 601 bp, Human
cctccacctcatgggttcaagcgattctcctgccttaggctcccaagtagctgggatacaagtgcgcaacaccatgcccggatgatttttgtatttttaatacagacagggtttcaccatgttggccaggctgatctctaactcctgacctcaggtgatccacttgccttggcctcccaaagtgctgagattacaggggtgagccaccgtctctggccatccatcttcatttttttgagagcagatttgattttagggaataacagttcatttgaatccaaataatttagggaatttggastcaagtctgataagaaagataaggcaatcaggttggtgatactactgttttaggtcagataggagttataactataaagtaacaacacataattttttgtgtgacttcttgaactggacctgaagtctacttccaaaaaaatctccgaattttattttatttatttatttattttgtagagatagggtcttactgtgttgcccaggttggtctcaaactcctggcctcaagcagttcccccaccttggcctcccgaagtgctgggattatagggatgagccaccacacccagcccctgaa

SEQ ID NO: 113462 - DNA, 601 bp, Human
ccagcctggagtgcagtggcacgatcttggctcactgcaccctccacctcccaggttcaagcaattctcccaccttagcctcccgagtagctgggattacaggtgtgcaccaccatgcccagccaatttttgtatttttaatagagatggggtttcaccatgttggctaggctggtctcaaactcttgacctcaagcgatcctcctgcctcggcctcccaaagtgctgagagtaataggtatgagccactgtgcccggctaataaaatatttttaaattaaggtatgtgcatatatatatwtttttgacatactgctagtgcatacttaatagactacagtatcatgtaaatataacttttatatgcactgggaaaccaaaaaatttatgtcactcatttttttgtgatattcactgtgttgtggttgtctggaactgaactcatgatatctttgaggtacacctgtatgtatgtgttaaggatttacaaaattaaccagctttcccgtgcagtgttcaagtcttttaataatttattatagggaagaagaagtggtggtttgtaaattctgtacttgacaaatggatactgggttttggg

SEQ ID NO: 113463 - DNA, 601 bp, Human
caaaacattgaagtttatttaatgattatccttgtgtgttatgtactggattcacggtcagcagtagatgagtgagaatgacatcctaatattgtaataactgcttctaatttttatatttctttcagttattttttactataccaatgattttataaaatgtgaattaatttgataattttggaaaagttcatgtaaattcacaattgggggaaaaacttgttaaacagtatgtcctgaattttagtttggagaacctgtttatcataaagataatttcattttatgatgttgttcatgraaacaaggttttacttgtagctctacttttacagatgtgattgagaggcgtatttgagctttgccatggaccaagctccttgccaaacctactataaaagttattacatttaatcctaacatatccaacagatgaaatataaacataattctcatttcatgaaagaatttaattaacatcctcaagattatatagctattaagtggcagaactggaattaaaatccagatagtctaattccaaagtcccagctcttatttaatcactctgttggagtattataaacatgtaataataaat

SEQ ID NO: 113464 - DNA, 601 bp, Human
gtaccaagtcctgaagaactccaacatacagagtttgagtagaagcagcacatgcagtggagacagagatggagctgccagaggggtcatagaaaaccaatggaagtgttgatatagactccaggatggacagtatttagagaaagtggtgactatgtcaattactaatcttagaaaagtggatttggtagcagaggtcattaatgaccttgagaagagcagtttcagtggaattggattgaggaaagaatgggattgaaatgagtcagttgtgtagatgtgtgcttctcacaccttaagmggtatattaatcacctggaaatcttgtcaaaaagtaaattctattttagggcccaagatctcctttcctttccttttcctttcttttcttttttcctttcctgttgtctgcagagatcctgcattttctaatgagctcccagataatgtcaatgctgccggtccatggagcacactttgaatagcaaaggtataaattagtggttctcaaactgtaatatgtattagaataacatggagagcttgataaaatacagattattagacccacttcaaagtttcttattccattaactctggg

SEQ ID NO: 113465 - DNA, 601 bp, Human
cttattgccaggctggagtgcgatggtgcaatctcagctcactgcaacctccgcctcctgggatcaagtgattctcctgcctcagcctcctgagtagctgggattacaggcacctgccactgcgcctaattttgtatttttagtagagatggggtttcaccatcttggtcagactggtctcgagctcctgacctcgtgatcctcccgcctcggcctcccaaggtgctggattacaggcatgagccactgtgcctggcgacgatttctaaaaataattaaaatacacatcgcatttttgctrtagatgtcctccatgatctagctgctgcctgcatctcttacgtcatcccttcccactctccccttgctccctgtgctctacccacacagcctttctgtctttctgtcactcactccagcatgccatacgtttcctacctctgtttcttttttcgtttgtttgcacttgctcttctgagagatagcagagtcaagtggtcagtagcataagctctggatccagactccctgctctgccgcttttaagctttgtgaccgtggtcaagttacctaacttctctctgcttcagtttcttacttg

SEQ ID NO: 113466 - DNA, 601 bp, Human; identical to SEQ ID NO: 21583

SEQ ID NO: 113467 - DNA, 601 bp, Human
tttgccatgttgcctaggctggtctcgaactcctgagctcaggtggtcgccctcctaggccactcaaagtgctgggattacagacatgagccgccacacccagccatttcagtattttctaaagttattttgggatatgcataagaaactaaacatcttcacctacacttgcagggtttgcaaatttaaataccttcagggtcacacaaagaacataaatgaggttcagtgttacacaattgggagtggtggggtctgtggcaaaatacatctgcacctcctaaaagtattcaaattcacwttgaaacaaaacaagtaaacaaacgaaaacctacacttctggccaaaccagacataatttaggctagagtggttctacaagctgcctgtttagagcaggctataatttgaacacaaatttttaaatgctaattagcaaaatctctataattactttcagatttatagttttttttttttctttttcttttcttttttttttttttgaggtggagtctcgctctgtcacccaggctggagtgcagtggcacgatcttagctcactgcaacctccgcctcccaggttcaagcgattctccta

SEQ ID NO: 113468 - DNA, 601 bp, Human
tgtattagttgtgtgtgtaggtatataaagagaggtcacacacacacacgtttattcttataatatattaataatagatctaaattactgacctgctttcttccctccaaaattcataaaaaaatgaaaatagaaatgaaatcagcattctttatagctcagctgatatatattattacccaatctcaggaataggaatgattcttagacagtaaataaaacttacacttatttttaaaaattcagcctcttagccaggcacggtagctcactcctgtaatcccagcactttgggaggccrtggtgggtggatcacttgagatcaggagttcgagaccagcctggccaacatgatgaaaccccgcctctactaaaaatacaaaaattagccaggcatggtggcgagtacctgtaatcccagctactcgggaggctgaggcacgagaatcgcttaatcccaggaggtggaggttgcagtgagccgagcttgtgccactgcactccagcctgggcgacagagcaaggctctgtctcaagaaaaaaaaaaaaaatcagcctttttagaaccgatctactttctatgtttccatagctgtgtaat

SEQ ID NO: 113469 - DNA, 601 bp, Human; identical to SEQ ID NO: 21584

SEQ ID NO: 113470 - DNA, 601 bp, Human; identical to SEQ ID NO: 46437

SEQ ID NO: 113471 - DNA, 601 bp, Human; identical to SEQ ID NO: 46438

SEQ ID NO: 113472 - DNA, 601 bp, Human; identical to SEQ ID NO: 46439

SEQ ID NO: 113473 - DNA, 601 bp, Human; identical to SEQ ID NO: 46440

SEQ ID NO: 113474 - DNA, 601 bp, Human; identical to SEQ ID NO: 46441

SEQ ID NO: 113475 - DNA, 601 bp, Human; identical to SEQ ID NO: 46442

SEQ ID NO: 113476 - DNA, 601 bp, Human; identical to SEQ ID NO: 46443

SEQ ID NO: 113477 - DNA, 601 bp, Human; identical to SEQ ID NO: 46444

SEQ ID NO: 113478 - DNA, 601 bp, Human; identical to SEQ ID NO: 46445

SEQ ID NO: 113479 - DNA, 601 bp, Human; identical to SEQ ID NO: 46446

SEQ ID NO: 113480 - DNA, 601 bp, Human; identical to SEQ ID NO: 46447

SEQ ID NO: 113481 - DNA, 601 bp, Human; identical to SEQ ID NO: 46448

SEQ ID NO: 113482 - DNA, 601 bp, Human; identical to SEQ ID NO: 46466

SEQ ID NO: 113483 - DNA, 601 bp, Human; identical to SEQ ID NO: 46467

SEQ ID NO: 113484 - DNA, 601 bp, Human; identical to SEQ ID NO: 46468

SEQ ID NO: 113485 - DNA, 601 bp, Human; identical to SEQ ID NO: 46469

SEQ ID NO: 113486 - DNA, 601 bp, Human; identical to SEQ ID NO: 46470

SEQ ID NO: 113487 - DNA, 601 bp, Human; identical to SEQ ID NO: 46471

SEQ ID NO: 113488 - DNA, 601 bp, Human; identical to SEQ ID NO: 46472

SEQ ID NO: 113489 - DNA, 601 bp, Human; identical to SEQ ID NO: 46473

SEQ ID NO: 113490 - DNA, 601 bp, Human; identical to SEQ ID NO: 46474

SEQ ID NO: 113491 - DNA, 601 bp, Human; identical to SEQ ID NO: 46475

SEQ ID NO: 113492 - DNA, 601 bp, Human; identical to SEQ ID NO: 46476

SEQ ID NO: 113493 - DNA, 601 bp, Human; identical to SEQ ID NO: 46477

SEQ ID NO: 113494 - DNA, 601 bp, Human; identical to SEQ ID NO: 46478

SEQ ID NO: 113495 - DNA, 601 bp, Human; identical to SEQ ID NO: 46479

SEQ ID NO: 113496 - DNA, 601 bp, Human; identical to SEQ ID NO: 46480

SEQ ID NO: 113497 - DNA, 601 bp, Human; identical to SEQ ID NO: 46481

SEQ ID NO: 113498 - DNA, 601 bp, Human; identical to SEQ ID NO: 46482

SEQ ID NO: 113499 - DNA, 601 bp, Human; identical to SEQ ID NO: 46483

SEQ ID NO: 113500 - DNA, 601 bp, Human; identical to SEQ ID NO: 46484

SEQ ID NO: 113501 - DNA, 601 bp, Human; identical to SEQ ID NO: 46485

SEQ ID NO: 113502 - DNA, 601 bp, Human; identical to SEQ ID NO: 46486

SEQ ID NO: 113503 - DNA, 601 bp, Human; identical to SEQ ID NO: 46487

SEQ ID NO: 113504 - DNA, 601 bp, Human; identical to SEQ ID NO: 46488

SEQ ID NO: 113505 - DNA, 601 bp, Human; identical to SEQ ID NO: 46489

SEQ ID NO: 113506 - DNA, 601 bp, Human; identical to SEQ ID NO: 46490

SEQ ID NO: 113507 - DNA, 601 bp, Human; identical to SEQ ID NO: 46491

SEQ ID NO: 113508 - DNA, 601 bp, Human; identical to SEQ ID NO: 46492

SEQ ID NO: 113509 - DNA, 601 bp, Human; identical to SEQ ID NO: 46493

SEQ ID NO: 113510 - DNA, 601 bp, Human; identical to SEQ ID NO: 46494

SEQ ID NO: 113511 - DNA, 601 bp, Human; identical to SEQ ID NO: 46495

SEQ ID NO: 113512 - DNA, 601 bp, Human; identical to SEQ ID NO: 46496

SEQ ID NO: 113513 - DNA, 601 bp, Human; identical to SEQ ID NO: 46497

SEQ ID NO: 113514 - DNA, 601 bp, Human; identical to SEQ ID NO: 46498

SEQ ID NO: 113515 - DNA, 601 bp, Human; identical to SEQ ID NO: 46499

SEQ ID NO: 113516 - DNA, 601 bp, Human; identical to SEQ ID NO: 46500

SEQ ID NO: 113517 - DNA, 601 bp, Human; identical to SEQ ID NO: 46501

SEQ ID NO: 113518 - DNA, 601 bp, Human; identical to SEQ ID NO: 46502

SEQ ID NO: 113519 - DNA, 601 bp, Human; identical to SEQ ID NO: 46503

SEQ ID NO: 113520 - DNA, 601 bp, Human; identical to SEQ ID NO: 46504

SEQ ID NO: 113521 - DNA, 601 bp, Human; identical to SEQ ID NO: 46505

SEQ ID NO: 113522 - DNA, 601 bp, Human; identical to SEQ ID NO: 46506

SEQ ID NO: 113523 - DNA, 601 bp, Human; identical to SEQ ID NO: 46507

SEQ ID NO: 113524 - DNA, 601 bp, Human; identical to SEQ ID NO: 46508

SEQ ID NO: 113525 - DNA, 601 bp, Human; identical to SEQ ID NO: 46509

SEQ ID NO: 113526 - DNA, 601 bp, Human; identical to SEQ ID NO: 46510

SEQ ID NO: 113527 - DNA, 601 bp, Human; identical to SEQ ID NO: 46511

SEQ ID NO: 113528 - DNA, 601 bp, Human; identical to SEQ ID NO: 46512

SEQ ID NO: 113529 - DNA, 601 bp, Human; identical to SEQ ID NO: 46513

SEQ ID NO: 113530 - DNA, 601 bp, Human; identical to SEQ ID NO: 46514

SEQ ID NO: 113531 - DNA, 601 bp, Human; identical to SEQ ID NO: 46515

SEQ ID NO: 113532 - DNA, 601 bp, Human; identical to SEQ ID NO: 46516

SEQ ID NO: 113533 - DNA, 601 bp, Human; identical to SEQ ID NO: 46517

SEQ ID NO: 113534 - DNA, 601 bp, Human; identical to SEQ ID NO: 46518

SEQ ID NO: 113535 - DNA, 601 bp, Human; identical to SEQ ID NO: 46519

SEQ ID NO: 113536 - DNA, 601 bp, Human; identical to SEQ ID NO: 46520

SEQ ID NO: 113537 - DNA, 601 bp, Human; identical to SEQ ID NO: 46521

SEQ ID NO: 113538 - DNA, 601 bp, Human; identical to SEQ ID NO: 46522

SEQ ID NO: 113539 - DNA, 601 bp, Human; identical to SEQ ID NO: 46523

SEQ ID NO: 113540 - DNA, 601 bp, Human; identical to SEQ ID NO: 46524

SEQ ID NO: 113541 - DNA, 601 bp, Human; identical to SEQ ID NO: 46525

SEQ ID NO: 113542 - DNA, 601 bp, Human; identical to SEQ ID NO: 46526

SEQ ID NO: 113543 - DNA, 601 bp, Human; identical to SEQ ID NO: 46527

SEQ ID NO: 113544 - DNA, 601 bp, Human; identical to SEQ ID NO: 46528

SEQ ID NO: 113545 - DNA, 601 bp, Human; identical to SEQ ID NO: 46529

SEQ ID NO: 113546 - DNA, 601 bp, Human; identical to SEQ ID NO: 46530

SEQ ID NO: 113547 - DNA, 601 bp, Human; identical to SEQ ID NO: 46531

SEQ ID NO: 113548 - DNA, 601 bp, Human; identical to SEQ ID NO: 46532

SEQ ID NO: 113549 - DNA, 601 bp, Human; identical to SEQ ID NO: 46533

SEQ ID NO: 113550 - DNA, 601 bp, Human; identical to SEQ ID NO: 46534

SEQ ID NO: 113551 - DNA, 601 bp, Human; identical to SEQ ID NO: 46535

SEQ ID NO: 113552 - DNA, 601 bp, Human; identical to SEQ ID NO: 46536

SEQ ID NO: 113553 - DNA, 601 bp, Human; identical to SEQ ID NO: 46537

SEQ ID NO: 113554 - DNA, 601 bp, Human; identical to SEQ ID NO: 46538

SEQ ID NO: 113555 - DNA, 601 bp, Human; identical to SEQ ID NO: 46539

SEQ ID NO: 113556 - DNA, 601 bp, Human; identical to SEQ ID NO: 46540

SEQ ID NO: 113557 - DNA, 601 bp, Human; identical to SEQ ID NO: 46541

SEQ ID NO: 113558 - DNA, 601 bp, Human; identical to SEQ ID NO: 46542

SEQ ID NO: 113559 - DNA, 601 bp, Human; identical to SEQ ID NO: 46543

SEQ ID NO: 113560 - DNA, 601 bp, Human; identical to SEQ ID NO: 46544

SEQ ID NO: 113561 - DNA, 601 bp, Human; identical to SEQ ID NO: 46545

SEQ ID NO: 113562 - DNA, 601 bp, Human; identical to SEQ ID NO: 46546

SEQ ID NO: 113563 - DNA, 601 bp, Human; identical to SEQ ID NO: 46547

SEQ ID NO: 113564 - DNA, 601 bp, Human; identical to SEQ ID NO: 46548

SEQ ID NO: 113565 - DNA, 601 bp, Human; identical to SEQ ID NO: 46549

SEQ ID NO: 113566 - DNA, 601 bp, Human; identical to SEQ ID NO: 46550

SEQ ID NO: 113567 - DNA, 601 bp, Human; identical to SEQ ID NO: 46551

SEQ ID NO: 113568 - DNA, 601 bp, Human; identical to SEQ ID NO: 46552

SEQ ID NO: 113569 - DNA, 601 bp, Human; identical to SEQ ID NO: 46553

SEQ ID NO: 113570 - DNA, 601 bp, Human; identical to SEQ ID NO: 46554

SEQ ID NO: 113571 - DNA, 601 bp, Human; identical to SEQ ID NO: 46555

SEQ ID NO: 113572 - DNA, 601 bp, Human; identical to SEQ ID NO: 46556

SEQ ID NO: 113573 - DNA, 601 bp, Human; identical to SEQ ID NO: 46557

SEQ ID NO: 113574 - DNA, 601 bp, Human; identical to SEQ ID NO: 46558

SEQ ID NO: 113575 - DNA, 601 bp, Human; identical to SEQ ID NO: 46559

SEQ ID NO: 113576 - DNA, 601 bp, Human; identical to SEQ ID NO: 46560

SEQ ID NO: 113577 - DNA, 601 bp, Human; identical to SEQ ID NO: 46561

SEQ ID NO: 113578 - DNA, 601 bp, Human; identical to SEQ ID NO: 46562

SEQ ID NO: 113579 - DNA, 601 bp, Human; identical to SEQ ID NO: 46563

SEQ ID NO: 113580 - DNA, 601 bp, Human; identical to SEQ ID NO: 46564

SEQ ID NO: 113581 - DNA, 601 bp, Human; identical to SEQ ID NO: 46565

SEQ ID NO: 113582 - DNA, 601 bp, Human; identical to SEQ ID NO: 46566

SEQ ID NO: 113583 - DNA, 601 bp, Human; identical to SEQ ID NO: 46567

SEQ ID NO: 113584 - DNA, 601 bp, Human; identical to SEQ ID NO: 46568

SEQ ID NO: 113585 - DNA, 601 bp, Human; identical to SEQ ID NO: 46569

SEQ ID NO: 113586 - DNA, 601 bp, Human; identical to SEQ ID NO: 46570

SEQ ID NO: 113587 - DNA, 601 bp, Human; identical to SEQ ID NO: 46571

SEQ ID NO: 113588 - DNA, 601 bp, Human; identical to SEQ ID NO: 46572

SEQ ID NO: 113589 - DNA, 601 bp, Human; identical to SEQ ID NO: 46573

SEQ ID NO: 113590 - DNA, 601 bp, Human; identical to SEQ ID NO: 46574

SEQ ID NO: 113591 - DNA, 601 bp, Human; identical to SEQ ID NO: 46575

SEQ ID NO: 113592 - DNA, 601 bp, Human; identical to SEQ ID NO: 46576

SEQ ID NO: 113593 - DNA, 601 bp, Human; identical to SEQ ID NO: 46577

SEQ ID NO: 113594 - DNA, 601 bp, Human; identical to SEQ ID NO: 46578

SEQ ID NO: 113595 - DNA, 601 bp, Human; identical to SEQ ID NO: 46579

SEQ ID NO: 113596 - DNA, 601 bp, Human; identical to SEQ ID NO: 46580

SEQ ID NO: 113597 - DNA, 601 bp, Human; identical to SEQ ID NO: 46581

SEQ ID NO: 113598 - DNA, 601 bp, Human; identical to SEQ ID NO: 46582

SEQ ID NO: 113599 - DNA, 601 bp, Human; identical to SEQ ID NO: 46583

SEQ ID NO: 113600 - DNA, 601 bp, Human; identical to SEQ ID NO: 46584

SEQ ID NO: 113601 - DNA, 601 bp, Human; identical to SEQ ID NO: 46585

SEQ ID NO: 113602 - DNA, 601 bp, Human; identical to SEQ ID NO: 46586

SEQ ID NO: 113603 - DNA, 601 bp, Human; identical to SEQ ID NO: 46587

SEQ ID NO: 113604 - DNA, 601 bp, Human; identical to SEQ ID NO: 46588

SEQ ID NO: 113605 - DNA, 601 bp, Human; identical to SEQ ID NO: 46589

SEQ ID NO: 113606 - DNA, 601 bp, Human; identical to SEQ ID NO: 46590

SEQ ID NO: 113607 - DNA, 601 bp, Human; identical to SEQ ID NO: 46591

SEQ ID NO: 113608 - DNA, 601 bp, Human; identical to SEQ ID NO: 46592

SEQ ID NO: 113609 - DNA, 601 bp, Human; identical to SEQ ID NO: 46593

SEQ ID NO: 113610 - DNA, 601 bp, Human; identical to SEQ ID NO: 46594

SEQ ID NO: 113611 - DNA, 601 bp, Human; identical to SEQ ID NO: 46595

SEQ ID NO: 113612 - DNA, 601 bp, Human; identical to SEQ ID NO: 46596

SEQ ID NO: 113613 - DNA, 601 bp, Human; identical to SEQ ID NO: 46597

SEQ ID NO: 113614 - DNA, 601 bp, Human; identical to SEQ ID NO: 46598

SEQ ID NO: 113615 - DNA, 601 bp, Human; identical to SEQ ID NO: 46599

SEQ ID NO: 113616 - DNA, 601 bp, Human; identical to SEQ ID NO: 46600

SEQ ID NO: 113617 - DNA, 601 bp, Human; identical to SEQ ID NO: 46601

SEQ ID NO: 113618 - DNA, 601 bp, Human; identical to SEQ ID NO: 46602

SEQ ID NO: 113619 - DNA, 601 bp, Human; identical to SEQ ID NO: 46603

SEQ ID NO: 113620 - DNA, 601 bp, Human; identical to SEQ ID NO: 46604

SEQ ID NO: 113621 - DNA, 601 bp, Human; identical to SEQ ID NO: 46605

SEQ ID NO: 113622 - DNA, 601 bp, Human; identical to SEQ ID NO: 46606

SEQ ID NO: 113623 - DNA, 601 bp, Human; identical to SEQ ID NO: 46607

SEQ ID NO: 113624 - DNA, 601 bp, Human; identical to SEQ ID NO: 46608

SEQ ID NO: 113625 - DNA, 601 bp, Human; identical to SEQ ID NO: 46609

SEQ ID NO: 113626 - DNA, 601 bp, Human; identical to SEQ ID NO: 46610

SEQ ID NO: 113627 - DNA, 601 bp, Human; identical to SEQ ID NO: 46611

SEQ ID NO: 113628 - DNA, 601 bp, Human; identical to SEQ ID NO: 46612

SEQ ID NO: 113629 - DNA, 601 bp, Human; identical to SEQ ID NO: 46613

SEQ ID NO: 113630 - DNA, 601 bp, Human; identical to SEQ ID NO: 46614

SEQ ID NO: 113631 - DNA, 601 bp, Human; identical to SEQ ID NO: 46615

SEQ ID NO: 113632 - DNA, 601 bp, Human; identical to SEQ ID NO: 46616

SEQ ID NO: 113633 - DNA, 601 bp, Human; identical to SEQ ID NO: 46617

SEQ ID NO: 113634 - DNA, 601 bp, Human; identical to SEQ ID NO: 46618

SEQ ID NO: 113635 - DNA, 601 bp, Human; identical to SEQ ID NO: 46619

SEQ ID NO: 113636 - DNA, 601 bp, Human; identical to SEQ ID NO: 46620

SEQ ID NO: 113637 - DNA, 601 bp, Human; identical to SEQ ID NO: 46621

SEQ ID NO: 113638 - DNA, 601 bp, Human; identical to SEQ ID NO: 46622

SEQ ID NO: 113639 - DNA, 601 bp, Human; identical to SEQ ID NO: 46623

SEQ ID NO: 113640 - DNA, 601 bp, Human; identical to SEQ ID NO: 46624

SEQ ID NO: 113641 - DNA, 601 bp, Human; identical to SEQ ID NO: 46625

SEQ ID NO: 113642 - DNA, 601 bp, Human; identical to SEQ ID NO: 46626

SEQ ID NO: 113643 - DNA, 601 bp, Human; identical to SEQ ID NO: 46627

SEQ ID NO: 113644 - DNA, 601 bp, Human; identical to SEQ ID NO: 46628

SEQ ID NO: 113645 - DNA, 601 bp, Human; identical to SEQ ID NO: 46629

SEQ ID NO: 113646 - DNA, 601 bp, Human; identical to SEQ ID NO: 46630

SEQ ID NO: 113647 - DNA, 601 bp, Human; identical to SEQ ID NO: 46631

SEQ ID NO: 113648 - DNA, 601 bp, Human; identical to SEQ ID NO: 29781

SEQ ID NO: 113649 - DNA, 601 bp, Human; identical to SEQ ID NO: 29782

SEQ ID NO: 113650 - DNA, 601 bp, Human; identical to SEQ ID NO: 29783

SEQ ID NO: 113651 - DNA, 601 bp, Human; identical to SEQ ID NO: 29784

SEQ ID NO: 113652 - DNA, 601 bp, Human; identical to SEQ ID NO: 29785

SEQ ID NO: 113653 - DNA, 601 bp, Human; identical to SEQ ID NO: 29786

SEQ ID NO: 113654 - DNA, 601 bp, Human; identical to SEQ ID NO: 29787

SEQ ID NO: 113655 - DNA, 601 bp, Human; identical to SEQ ID NO: 29788

SEQ ID NO: 113656 - DNA, 601 bp, Human; identical to SEQ ID NO: 39778

SEQ ID NO: 113657 - DNA, 601 bp, Human; identical to SEQ ID NO: 39779

SEQ ID NO: 113658 - DNA, 601 bp, Human
aatctgtaaaatggggctaaggagggattgtgtttccaatccccagctcctgccataaaattcccttggtacaaagtgctctcctaagagaagtgcagccttttagtattccagatgacatgcacattccctaaggaggctcctgccagtttatctgcaccagacttgcatgattcaaggaaagttaccaagcagccaaggttacaccactggcttcctggtagatgagtcagctataaacagaggactctatagttctactttcccccattctcagagggacaagcaagagcactgtccrtaaccacgcagatccttacgttgatctgagacattgtacttaagcacaattgcaccttctcaaggtgtgaggctgctgggcagaccatgactccccttatacagatgaggaaacagacacaggggttgacttttccgaggtcatggagcaagttactggtggggctggttcctggccagcgtttattctcccactctggttcctgaacacctgcttggtttggaagagggtttttttccatgatgataggtataagtctccctcccattcccccaaagaaaagcccccagcccacccttg

SEQ ID NO: 113659 - DNA, 601 bp, Human
gagagttggagccacctccccaccccttctggatgctggctggtagtaaacaaagacaaagagaccttaggaggcagctgaatcccaacgagagggaggatgggggcaggaggacccttagcccattccaaaacagaaaaagccaccatcaccctaaagagttggattattttcaaaattcttattagctttgtggtagagaaaggaagaagtgtatgtttggagagtgagaaactaggactcaaagaggcaaaattcttttcacaagatcacacagcaaagcaggaagaggtgaaggggraaccaggaatctggtctcctagtccgcaataccactccaccaactctgcctcagcagtcagccaagagcatgcgtttgggagggttccaacgttgtctctcaaaggctgaggtagggaagatgacagccaagcccacccagtgaccctggtggggtctagggctcttccgaacatcacctccatgctccgagtggccctgacgtggccttacgtatctgagcccattgctctgttgcttcctggacacttctgtatcaggacctttccccctctaaaggatccaggtggctgagggatgc

SEQ ID NO: 113660 - DNA, 601 bp, Human
ttattatgaatgatatatgtatgttgcaggatatttagaaaaatacaactgaataatagcggctctctctgaagagtggatgagccaaatgaaaggggattttcttttactttctaagttaatttccatagcacttgaaaattttacaagagcatctatttcctgtgtagtcagcaaaacaataaagatataagaagggaggccaggcacagtggctcaggcctataatcccagcaccttgggaggccaaggcaggaagatcacttgaagccaggagttcgagaccagcttgggcaatacrgtgagaccccccctccccccactacaaatttaaaaattaagcaggtgtggtggcgcacgcctgtagtcccagctacttgagaggctgaggcaggaagatggcttgagcccaggtagtccaagcctgcagtgagctatgattgcaccactgcactccagcctgggcaacagagccagaccctatctttaaaaaaataactaactaaataaataaagatataagaagaaaacaatgtgatagacaccttttcttcccttgtaagaaatatgtatatgtctccaggtggggggatctgcctat

SEQ ID NO: 113661 - DNA, 601 bp, Human
tggcctcaagcagtccacctacctcagcctcccaaagtgctgggattacaggcgtgagccaccacacctggcttgagaaccagtattctaaggaaagcagtggtgctggaactcttcaggctaacgggttttcatctataaattgatttagaggaacttaagaggagggagtataaatggaaggcaatatttgttccttccatttatgtgagattttacatctttcagaatgcttccacaacattaccttgtacagctctcaccataactctgtaaagtagagagggcataaatagttatkcccattttagagataaagaaactgaggctcagagagattgacttgcccaacatcacatggacagtcatagagcaggcggtagaattattaatattatacctcttactcaggtacctcttacctgttcaactcctagaaaatctgaatgtacaaggctcagggagaacaaggtctccctgaggtctcttttcactgaggggtgaagcctcctctaggcatggcttcccaagtgtccgtggtcagatgaaaggtaaagaagtattgtctcactttaaattgggggaaactgaggcacggtag

SEQ ID NO: 113662 - DNA, 601 bp, Human
tgagtttcttgaggttgttaaacctccttcaaacctttctagaaaaaaagatggagtaaaaataaatacttattctaagttccagaaaaactccaaggaaaagatggcccctagagatctgtactttacttctttgggttcagagcgttcagtggggcggggctccgtgctagccttgcctgctctagcctccctctgctcccctaaatctttccaacctgaagaaagcagcccagggccaaggtgtttgcagcatgggcgggaagcacaaacagcagccataatggcagtgtccgccggyatgtttgaggctcgctgcaggccagcgctgcgagtgtattattatcctctttaatcttcatggcagctgcatgaggagggtgctatcattgtccccatttcacaggagaagaaactgaggttcacagaggtggtgtcctctaatctgggtacgacagagggaggagaagaaccaggtgtcggtgcctcagcaagaaaggccagtcactctgccgccccccaaatggtaggtgaaggggccagagaagaaatggcagaacatgaaggacctggtgcaaaacagggctccacagagggatga

SEQ ID NO: 113663 - DNA, 601 bp, Human
atccctgggtgccaggtacctgtaatcccagctacttgggaggctgaggcaggaggatcacttgagcccaggattttggggcggtagtatgttatgatcacacttatgaatagtgctgaactctagcctgggcaacacagcaagaccctgtctcaaaaaaaaggaaaaatccccaggagattctttgccacagcaaagtctaggaggcacggcctgagccctgcctgatttcccacccacaaatgcctccttccccatcacagcactgaccagtgaccttgaccatgcattcagctcagtyctggtctctagtagaccatccaggctcaaggcgtgagagcctaaaggacctctcactacttatgtgatctcgcaagtcaggctgtgacctcgggacctggttctgatcactgcacttttcccacagattcattcccaccttaggcacgggttctggtaatggaactcagtaacaacatttatgctgcactcataatgactagaggatgggctttccatacaaaatcctgtttaattataataacccactttgcagatgagatgggttcaataactgtctcaaagtcacactgttggtaag

SEQ ID NO: 113664 - DNA, 601 bp, Human
tatgatcacacttatgaatagtgctgaactctagcctgggcaacacagcaagaccctgtctcaaaaaaaaggaaaaatccccaggagattctttgccacagcaaagtctaggaggcacggcctgagccctgcctgatttcccacccacaaatgcctccttccccatcacagcactgaccagtgaccttgaccatgcattcagctcagtcctggtctctagtagaccatccaggctcaaggcgtgagagcctaaaggacctctcactacttatgtgatctcgcaagtcaggctgtgacctcrggacctggttctgatcactgcacttttcccacagattcattcccaccttaggcacgggttctggtaatggaactcagtaacaacatttatgctgcactcataatgactagaggatgggctttccatacaaaatcctgtttaattataataacccactttgcagatgagatgggttcaataactgtctcaaagtcacactgttggtaagcacagcagaaccagtctttaaatctgcatccacaggcctcagagcctcctctcttcattaccaggtgggatgcctctcctacccttgatccc

SEQ ID NO: 113665 - DNA, 601 bp, Human
ccctgcctgatttcccacccacaaatgcctccttccccatcacagcactgaccagtgaccttgaccatgcattcagctcagtcctggtctctagtagaccatccaggctcaaggcgtgagagcctaaaggacctctcactacttatgtgatctcgcaagtcaggctgtgacctcgggacctggttctgatcactgcacttttcccacagattcattcccaccttaggcacgggttctggtaatggaactcagtaacaacatttatgctgcactcataatgactagaggatgggctttccayacaaaatcctgtttaattataataacccactttgcagatgagatgggttcaataactgtctcaaagtcacactgttggtaagcacagcagaaccagtctttaaatctgcatccacaggcctcagagcctcctctcttcattaccaggtgggatgcctctcctacccttgatccctgtgaccaagtctcaggtagggcagggggtgggaggtgacatcccataggacagatgccctgtggttctctcttttctgggcccttctgtttttgtttcctaggactgttatagcaaggcactaca

SEQ ID NO: 113666 - DNA, 601 bp, Human
cctctgcctccatcttcacatggtcttcttcctgggtctctgtgtctccatgaagccttcttacaaggacaccgaccactggatttagggcccaccccaatccagtatgactcatcttaactaatgacatctgcaatgaccctgtttccaaataaggtcccattctgggggagcactccaacccgctacaccttctgaactccagggaccccagttctgcctctgaccaggtcccgccacttgctgatgacctgtcacacctctgccacctcgtgcttgcccagacattaaggacagattyggaagctgccaacttctgctctcctctgtcctctcggaccctgtgctagttcctcccagtattttctagctgctgaatgtatgttgttcatcttggatctctaggtgcaaatgccctgagggctggacccacacccctagctccactggcctagacacctgcctgttggccagctgggagaagacattctccacgaagcccccgacatgcccaccccgtgccccccttactatttagtgttgagattgattttttctctctctttttacaggaaatgggtatattgaaggtaaagagcta

SEQ ID NO: 113667 - DNA, 601 bp, Human
ttgctgatgacctgtcacacctctgccacctcgtgcttgcccagacattaaggacagattcggaagctgccaacttctgctctcctctgtcctctcggaccctgtgctagttcctcccagtattttctagctgctgaatgtatgttgttcatcttggatctctaggtgcaaatgccctgagggctggacccacacccctagctccactggcctagacacctgcctgttggccagctgggagaagacattctccacgaagcccccgacatgcccaccccgtgccccccttactatttagtgytgagattgattttttctctctctttttacaggaaatgggtatattgaaggtaaagagctagaaaactttttccaagagctggagaaggcaaggaaaggctctggcatggtaagcccagccctgtctccgattgtgtgggattttcctgacctatgcctttgagcatgctgtgtcccagttatgtatgccataagcaggcctcatatcgctggtcttgacacagctttttatttgtaaggataaaaaatagactgtcccctaagagtaccctatctcaatatccttgggtgtctgggattg

SEQ ID NO: 113668 - DNA, 601 bp, Human
gttggccagctgggagaagacattctccacgaagcccccgacatgcccaccccgtgccccccttactatttagtgttgagattgattttttctctctctttttacaggaaatgggtatattgaaggtaaagagctagaaaactttttccaagagctggagaaggcaaggaaaggctctggcatggtaagcccagccctgtctccgattgtgtgggattttcctgacctatgcctttgagcatgctgtgtcccagttatgtatgccataagcaggcctcatatcgctggtcttgacacagcwttttatttgtaaggataaaaaatagactgtcccctaagagtaccctatctcaatatccttgggtgtctgggattgaggggtattcatgagtggacaccaggggttgatgaaccctcctgcaaagctgcaaagctttgtctgcgtatgcgtatattaatatatatgtagtatttttttgtccctagggacagagtccatagcttccctcaggtgcttaggggtcatgattccagattggatgcccaggaggtttcaagtgccctgattctagaccagagtttctcagcctcagcgctgttg

SEQ ID NO: 113669 - DNA, 601 bp, Human
cccccgacatgcccaccccgtgccccccttactatttagtgttgagattgattttttctctctctttttacaggaaatgggtatattgaaggtaaagagctagaaaactttttccaagagctggagaaggcaaggaaaggctctggcatggtaagcccagccctgtctccgattgtgtgggattttcctgacctatgcctttgagcatgctgtgtcccagttatgtatgccataagcaggcctcatatcgctggtcttgacacagctttttatttgtaaggataaaaaatagactgtcccstaagagtaccctatctcaatatccttgggtgtctgggattgaggggtattcatgagtggacaccaggggttgatgaaccctcctgcaaagctgcaaagctttgtctgcgtatgcgtatattaatatatatgtagtatttttttgtccctagggacagagtccatagcttccctcaggtgcttaggggtcatgattccagattggatgcccaggaggtttcaagtgccctgattctagaccagagtttctcagcctcagcgctgttggcatttgaggctgaataatttgttgcaggggctg

SEQ ID NO: 113670 - DNA, 601 bp, Human
gggtatattgaaggtaaagagctagaaaactttttccaagagctggagaaggcaaggaaaggctctggcatggtaagcccagccctgtctccgattgtgtgggattttcctgacctatgcctttgagcatgctgtgtcccagttatgtatgccataagcaggcctcatatcgctggtcttgacacagctttttatttgtaaggataaaaaatagactgtcccctaagagtaccctatctcaatatccttgggtgtctgggattgaggggtattcatgagtggacaccaggggttgatgaaycctcctgcaaagctgcaaagctttgtctgcgtatgcgtatattaatatatatgtagtatttttttgtccctagggacagagtccatagcttccctcaggtgcttaggggtcatgattccagattggatgcccaggaggtttcaagtgccctgattctagaccagagtttctcagcctcagcgctgttggcatttgaggctgaataatttgttgcaggggctgccctgtgcgctgtaggagactagcagcatcccgggatctacccatgagatgccactatcatcctccttcaagctgtga

SEQ ID NO: 113671 - DNA, 601 bp, Human
tatccttgggtgtctgggattgaggggtattcatgagtggacaccaggggttgatgaaccctcctgcaaagctgcaaagctttgtctgcgtatgcgtatattaatatatatgtagtatttttttgtccctagggacagagtccatagcttccctcaggtgcttaggggtcatgattccagattggatgcccaggaggtttcaagtgccctgattctagaccagagtttctcagcctcagcgctgttggcatttgaggctgaataatttgttgcaggggctgccctgtgcgctgtaggagaytagcagcatcccgggatctacccatgagatgccactatcatcctccttcaagctgtgaccatcaaaaatgtctccaaacattgccaaatgtccccctggtgggagactgggggcagaatcgtcctcagaagagaaccactgttctagagcaacacgggctagaatccccagcaaggaactagaggaaaattgaggattgctctcagccagtatctgaaccagacggcactggctggcctcatttgtggtggtgtcacgaccttctgagcctgcccaaagtgactccagatcacatcccag

SEQ ID NO: 113672 - DNA, 601 bp, Human
tcccagccccttagtgacaggagtgttgctttccctggtgccaacgtggcactactgagtttgctaaagccttttgggggaggtatttgaaatactgcaaagctcaggtgattggaactagtctgctgtgattgccgtgtctggttctggagtacatggagtcagccccacaccctcccatcagctccctcgggtcctctggaggcgtctctactctcccctgctgcgtgtctgttggccaatccactgtttatttgcagctcttcagggagcatttgggagatgagtcacaaatccaccrgtgagctcctggttcaaagcttggcagagcgccccaatgaggaggtcaaagtgatgggcttaaagggttggaggcgattcatgggtttgtttatcaacagttgtcccatcaattcctaggataatgaagcctcgatcacagaaagcatgggcttcaggactgactctgggatcatgggctagtcggagaaatgtgtttttatgaagtgctttgcatctagaatccttctcttagtcattcccttcctcagatgtcatccgggtaattttcaagtctgtcaacaatcccaactgatgccat

SEQ ID NO: 113673 - DNA, 601 bp, Human
attgtggaattgccagttagtctttaaagaaaatgagcaatctaccttgctgtaatgaagtgcttagaacctattagggggcactggattaagttcagtttgattacaacctgcttcagtaaaatgttgaggccttaattctcacatctgagtgatgggaacaagtccaaacccttcctatagagttgtagcttaatccatctcaaaggcagcagggcatgtttgattacctggtatggagcatggccacgtgtcctttgaaatttatatgactgagccttgaagaagagatgacttaatktgaagggaacctggaaaggaaaacaacacagctctgatcaatcagagcatcggcacaacttggttctgcacccacttacccaggatgcaaatgatttccaagcttcctgctctgagatcatggttcacatgagatacagcagcaaaaatcagccccctttgtctttccacagatgtcaaagagtgacaactttggagaaaagatgaaggagttcatgcagaagtatgataaaaactcagatgggaaaatcgagatggcagaggtgagccctgcctcgctggtaaagagctgtgtgggagg

SEQ ID NO: 113674 - DNA, 601 bp, Human
taatgaagtgcttagaacctattagggggcactggattaagttcagtttgattacaacctgcttcagtaaaatgttgaggccttaattctcacatctgagtgatgggaacaagtccaaacccttcctatagagttgtagcttaatccatctcaaaggcagcagggcatgtttgattacctggtatggagcatggccacgtgtcctttgaaatttatatgactgagccttgaagaagagatgacttaatgtgaagggaacctggaaaggaaaacaacacagctctgatcaatcagagcatcrgcacaacttggttctgcacccacttacccaggatgcaaatgatttccaagcttcctgctctgagatcatggttcacatgagatacagcagcaaaaatcagccccctttgtctttccacagatgtcaaagagtgacaactttggagaaaagatgaaggagttcatgcagaagtatgataaaaactcagatgggaaaatcgagatggcagaggtgagccctgcctcgctggtaaagagctgtgtgggaggggccctgggtccctgtgcctctcccaggcatgagcatcctgctgaggattgg

SEQ ID NO: 113675 - DNA, 601 bp, Human; identical to SEQ ID NO: 113658

SEQ ID NO: 113676 - DNA, 601 bp, Human; identical to SEQ ID NO: 113659

SEQ ID NO: 113677 - DNA, 601 bp, Human; identical to SEQ ID NO: 113660

SEQ ID NO: 113678 - DNA, 601 bp, Human; identical to SEQ ID NO: 113661

SEQ ID NO: 113679 - DNA, 601 bp, Human; identical to SEQ ID NO: 113662

SEQ ID NO: 113680 - DNA, 601 bp, Human; identical to SEQ ID NO: 113663

SEQ ID NO: 113681 - DNA, 601 bp, Human; identical to SEQ ID NO: 113664

SEQ ID NO: 113682 - DNA, 601 bp, Human; identical to SEQ ID NO: 113665

SEQ ID NO: 113683 - DNA, 601 bp, Human; identical to SEQ ID NO: 113666

SEQ ID NO: 113684 - DNA, 601 bp, Human; identical to SEQ ID NO: 113667

SEQ ID NO: 113685 - DNA, 601 bp, Human; identical to SEQ ID NO: 113668

SEQ ID NO: 113686 - DNA, 601 bp, Human; identical to SEQ ID NO: 113669

SEQ ID NO: 113687 - DNA, 601 bp, Human; identical to SEQ ID NO: 113670

SEQ ID NO: 113688 - DNA, 601 bp, Human; identical to SEQ ID NO: 113671

SEQ ID NO: 113689 - DNA, 601 bp, Human; identical to SEQ ID NO: 113672

SEQ ID NO: 113690 - DNA, 601 bp, Human; identical to SEQ ID NO: 113673

SEQ ID NO: 113691 - DNA, 601 bp, Human; identical to SEQ ID NO: 113674

SEQ ID NO: 113692 - DNA, 601 bp, Human; identical to SEQ ID NO: 36497

SEQ ID NO: 113693 - DNA, 601 bp, Human
actttgccatcaatatctttctatctattttctattaaattaggcacagtcctattgtttctgtagaatgactacagattaggggaaaagcctgagtgttgggtgcctcatggctcaaatcctcagatctcagagaataaacacctcaccaagattcatgctcagtagcaatgagaaatgcttgaagaactctgggttaaatgcattataccaggtgcttctccctggtagcctcctccccggctggagaccaagcgacaaacctccactgtattccttgagctcccgtcaccatcacgcrtggcagactgagaaaggtgaaggccaactgcattcagcaggagatgtgtccgttcaccgccagtctcccaccaccgttcccagctggcctgcatcctcctagtgcccatcctggggagtctttcagcaccaagctaccttctgagacttaagtttcactgacaagctcccctactctgcccctttccctgctcctcagctcaaatctcatcactcaggtccatgtcatctaacattaaaccatgcaaatctattttactgggaagagggagggaggctgcaagttacaagtagagtgaac

SEQ ID NO: 113694 - DNA, 601 bp, Human
gagggagaggttgtagtgagctgagattgtgccactacactccagcctaggtgacagagcaagactccatgaaagagagagagaagaaagaaagaaaagaaagaagaaagaaagaaagaaagaaagaaagaaagaaagaaagaaagaaagaaagaaagaaagaagaaagagagagagaggaaggaaggaaaaggaaaggaaaggaaggaaggaaaaggaaaggaaaggaagaaaaaaggaagaaagaaagaagaaagaaagagagagagaaagaaagaaaaagaaagaaagagaaagaaaaaaagaaagaaagaaaagaaaagaaaggctggttggcttaggatacgtgcttaaaaagaaacatgactgaaaagcagaaggaacacagatcagatatataagttatcatgcaaggactttaaaataactatgttgaataatttttcaactttaagcagtcatgctcaactcatagccttagattctccattcataaaatgaggtttaaatggatactttgggggttagtgtagagattaactctttcaaactcagctcctaacttgactggtgccaagtactggccatccctcctttggaa

SEQ ID NO: 113695 - DNA, 601 bp, Human
gtagtgagctgagattgtgccactacactccagcctaggtgacagagcaagactccatgaaagagagagagaagaaagaaagaaaagaaagaagaaagaaagaaagaaagaaagaaagaaagaaagaaagaaagaaagaaagaaagaaagaagaaagagagagagaggaaggaaggaaaaggaaaggaaaggaaggaaggaaaaggaaaggaaaggaagaaaaaaggaagaaagaaagaagaaagaaagagagagagaaagaaagaaaaagaaagaaagagaaagaaagaaagaaagaaagaaaagaaaagaaaggctggttggcttaggatacgtgcttaaaaagaaacatgactgaaaagcagaaggaacacagatcagatatataagttatcatgcaaggactttaaaataactatgttgaataatttttcaactttaagcagtcatgctcaactcatagccttagattctccattcataaaatgaggtttaaatggatactttgggggttagtgtagagattaactctttcaaactcagctcctaacttgactggtgccaagtactggccatccctcctttggaattttgaaaggct

SEQ ID NO: 113696 - DNA, 601 bp, Human
ccctagctcttcccacttctggtttgtcctcactatttgtcttctccctttctccactttgaaatttcatttccatctcaacagaacaatcacacttttcccgtctattctcaaggttacaggagaactgagtggtggtccgtggagtgtttggcctttcagaaatggtctgagaactcacagtttgcatatgtctacatctttgaaaacagttctggtactcaaactgaggcatcagtagtaaaggttcaaaacatctgcccagggaggattgtttgagtccaggaattcgaggctgcartgaactatgatcacgccactgcactccagcctgggtgagggggagattctgtctcttaaatttaaaaaaacaaaaaacaaaaaaaacctgcccactgataggaaggactgccttgggagaatcctagatggactggaggcctgattgaagttgtatggacatgcaatgctttcatgaagggcataaaagcaagttctcaataaacaaggtacattcaacacagagagttatatcctttttcctccaaaagacagaaaagaattggggttgaaggacaaatccacagacataaagacaaca

SEQ ID NO: 113697 - DNA, 601 bp, Human
agaactcacagtttgcatatgtctacatctttgaaaacagttctggtactcaaactgaggcatcagtagtaaaggttcaaaacatctgcccagggaggattgtttgagtccaggaattcgaggctgcagtgaactatgatcacgccactgcactccagcctgggtgagggggagattctgtctcttaaatttaaaaaaacaaaaaacaaaaaaaacctgcccactgataggaaggactgccttgggagaatcctagatggactggaggcctgattgaagttgtatggacatgcaatgcttycatgaagggcataaaagcaagttctcaataaacaaggtacattcaacacagagagttatatcctttttcctccaaaagacagaaaagaattggggttgaaggacaaatccacagacataaagacaacaggagataggcaagtaccacctcagaaataccaataaaattttggaagttggaaaacagatgaacaatggaaaatgctgagcagtctaaacagaagctaagcccatagaggggaaagtctaagccagaagcaagcagattcacactgcagaacgtcacaatggcgcaggcatg

SEQ ID NO: 113698 - DNA, 601 bp, Human
agttgtatggacatgcaatgctttcatgaagggcataaaagcaagttctcaataaacaaggtacattcaacacagagagttatatcctttttcctccaaaagacagaaaagaattggggttgaaggacaaatccacagacataaagacaacaggagataggcaagtaccacctcagaaataccaataaaattttggaagttggaaaacagatgaacaatggaaaatgctgagcagtctaaacagaagctaagcccatagaggggaaagtctaagccagaagcaagcagattcacactgcaraacgtcacaatggcgcaggcatgagcaacaccaaaaagtcgtagccaggagtaaggtctcagaccaaaagcaagaggactgatctgtatgaaggacagtgagacctcccatagttccttctccctcactgtcctccaccccggcagaagacgagctttacacttagcaggaactgagtcaagagctcatagtagactcttgcatatcaggcccagctgagagtgggaatgaagcactgtacagaaagttgatgggctcagtaaaagtttacatattgaatttgggactgtctcccttctc

SEQ ID NO: 113699 - DNA, 601 bp, Human
gctgagcagtctaaacagaagctaagcccatagaggggaaagtctaagccagaagcaagcagattcacactgcagaacgtcacaatggcgcaggcatgagcaacaccaaaaagtcgtagccaggagtaaggtctcagaccaaaagcaagaggactgatctgtatgaaggacagtgagacctcccatagttccttctccctcactgtcctccaccccggcagaagacgagctttacacttagcaggaactgagtcaagagctcatagtagactcttgcatatcaggcccagctgagagtggraatgaagcactgtacagaaagttgatgggctcagtaaaagtttacatattgaatttgggactgtctcccttctcatgctgggttcgggaatgctgacatttaaacccaacccatatccctccatggtagacagaatgatggccctccaaagatgtccatgtcctaatccctggaacctgtgactaggttcctttacacagcaaaagagactttgcaggtgtgattaagttaaggctctggagatggagaggttatcctggattatccaggtaagcccatgcaatcacagggtctttataa

SEQ ID NO: 113700 - DNA, 601 bp, Human
ttatttatttatttatttatttatttatgtattttgaggcagagtttcactcttgttgcccaggctggagtgcaatggtgtgatctcggctcactgcaacctccgcctcccaggttcaagcaattctcctgcctcagcctcctgagtagctggaattacagacacccaccattgcgcccagctaatttttgtatttttagtagagacggggtttcatcatgttggtcacactggtctcaaactcctgacctcaagtgatccacccgcctctgcctcccaaagtgctgggattacaggcatragccaccacacccggccgtggtatttgattttaatcagaggaatacacacacacacacacacacacacacacacacacacgtacacacacatatataatgtatatatataatgacacacagataaatgtgtgtatatatgcacacacatacacaaatgcgtaaagatgtgtgcatgtgtgagtacacatattattttgtagccctttccactgagtgggcctagaagcaatgacatttagtaacaagagacacagcacccaaatcttgggtcttaaataccgttctccaataaaaggagc

SEQ ID NO: 113701 - DNA, 601 bp, Human
gaaagaacacaggcatcaggtgaaggagctcccaacggccaaatctagggcatttgagtaacaaaatagagtaatgaattgtaatccacagagtaaaagaaatatccatgagtcatattaatataaaataagtaattgactacataaagaggagagagggaacagctcttccttatggcagaattccagataataaatgcacaagaaatgattttttaattaccatttggccaacaccacaattaatcattgttgtaggcaagaaccatcaatggatgctaaaattcatgtatgaaagtawggcgagaaacaagactcctcacaagacacttactaattacaaaggggaaaaaaatggtaactttaccgtggagaaacctggcagacatcctaagtgatcaaaattaacatcaccagtaatgaaacgtagctcctgataggatgcacttaagcacaacatcacgtttgtgctatccttacaaacatgtataatactaacataagaggagatcacacaaacctaaattgagagacattctaccatttaacaggccagtattcttcaaaaacatcaaggccatgaacaaaaaggaatgaaccc

SEQ ID NO: 113702 - DNA, 601 bp, Human
tgtataatactaacataagaggagatcacacaaacctaaattgagagacattctaccatttaacaggccagtattcttcaaaaacatcaaggccatgaacaaaaaggaatgaacccagattgtaggagactgaggagaaatgacaactaaatgcaatgtaggatcctgcatgagatcctggagcagaaaagagacattttcaggaaaactggcaaaattctgataaggtttagagactacttaatagtattataccatgttaatttcctcattttggtgattatactatgttatgtaaaayggcaaaattaagggaactgtaaatgatataagagaattcattatactaattttacaacttttaagtctgaaatcattttaaaataatgttttaatcaagtagtaattattgctccactgatttttattaatcaaagatacatataactcttagagttttagcagtcaaaacgctcctatattgcattaccacactgagttgatgtgaattcagcctaaagcaacaaaatttgactttttaacctatgtaattgtattaaaacaggtgttttctattgaaataataaaaatagttcataga

SEQ ID NO: 113703 - DNA, 601 bp, Human
agagttttagcagtcaaaacgctcctatattgcattaccacactgagttgatgtgaattcagcctaaagcaacaaaatttgactttttaacctatgtaattgtattaaaacaggtgttttctattgaaataataaaaatagttcatagatttcattaccatctttgaagacttttaggaggatgaggttcccagatgggtacattgcatacatggagtctaatatagctttgattatttgtttcctcttttcttttctttaggttaaaccacagcttgaagaaaaaacaaatgagacttayggaaaattggaagctgtgcagtataaaactcaagttgttgctggaacaaattactacattaaggttagagttcagcacctactttagcgccaaaagatgtatttctcattttatgtaaaatattccctgatttccctaccacataattccttccttacggttgtcctaaattaagatgcccagcatgattccttccaagtggtggactctcaaatttggtagatgatgtgacaccattttttttcttgtgaattcagaaagttttattacattgattcttgatttctggaaattgtatag

SEQ ID NO: 113704 - DNA, 601 bp, Human
agtaacgaccaggtcccggggagacacatgtgaaagaggaccctgctgtatcctcagaaaacaatggcaccatttcctccattctcaatctgctttcttcatggctggaaaagaaagttttccagttaaaaatgattatgtgcaaagataggaaacattccatcaacattaacatatttaataatttatgattaattcaaatgcataaatttcacatattaccagctcacatgtttcttcaacagttcatcagataactatcttgaaaatttctgcttgaaaatttgttcccttgaccacscttttgccctctcttaatcagtctcctctctctctctcatcttttcttccttctgctatcaaacttttcctactggatctcagccaccgatcccagttcccttttacttcctggtagtctggctgttgatccctttgctctgaggcactctagatttaaggtcttgccagtgatgtgaccttctctatgtatttcaagtacctatcaagaggtaggtggtagaatggaaggaccacaagcttaggtgtcagagtgtcctgggtttgaacccttgttcaatttgttctatgggaagctcct

SEQ ID NO: 113705 - DNA, 601 bp, Human
gaaagttttccagttaaaaatgattatgtgcaaagataggaaacattccatcaacattaacatatttaataatttatgattaattcaaatgcataaatttcacatattaccagctcacatgtttcttcaacagttcatcagataactatcttgaaaatttctgcttgaaaatttgttcccttgaccacccttttgccctctcttaatcagtctcctctctctctctcatcttttcttccttctgctatcaaacttttcctactggatctcagccaccgatcccagttcccttttacttccyggtagtctggctgttgatccctttgctctgaggcactctagatttaaggtcttgccagtgatgtgaccttctctatgtatttcaagtacctatcaagaggtaggtggtagaatggaaggaccacaagcttaggtgtcagagtgtcctgggtttgaacccttgttcaatttgttctatgggaagctcctcctcctctctgagccttcattcccttatctgcacaatgagggtaataatctacttcgcagcgtgttgtgaggaataaataagctggaaatttattgagcacttataattcac

SEQ ID NO: 113706 - DNA, 601 bp, Human
tgatccacccaccttggcctcccaaagtgctgggattataggcgtgagccacagtgcccggctggccccttcactttagaagggagggtgtccgccccctgggctctgctcaatcctaccagtgggtgtttataaagtaggttctgatataggtatgggaaccctgcatcccaaattttctagggcaattctgattttcttctcccttatcagactgtatggcaaacaaagtgtcccaagttgagagtcagaaaacagtatcaccaaaaatataggctatcacttgttttcttgctccatrcatctttgaaaataaaatgctgtcctttgtgcccagattatactaaaaaaaataacaaaataaacctaggacctatgcctcttgccatgccattagtctacaattttttttttttttaagacaaactcttgctctatcacccaggctggagtacagtggcatgatctcggctcactgcaaccttctcctcctgggttcaagtgattctcctgcctcagcctctagagtagctgggattacaggcatgcaccaccatgcccggctaattttttgtatttttagtagagacgggatttcacc

SEQ ID NO: 113707 - DNA, 601 bp, Human
accagtgggtgtttataaagtaggttctgatataggtatgggaaccctgcatcccaaattttctagggcaattctgattttcttctcccttatcagactgtatggcaaacaaagtgtcccaagttgagagtcagaaaacagtatcaccaaaaatataggctatcacttgttttcttgctccatgcatctttgaaaataaaatgctgtcctttgtgcccagattatactaaaaaaaataacaaaataaacctaggacctatgcctcttgccatgccattagtctacaattttttttttttttaagacaaactcttgctctatcacccaggctggagtacagtggcatgatctcggctcactgcaaccttctcctcctgggttcaagtgattctcctgcctcagcctctagagtagctgggattacaggcatgcaccaccatgcccggctaattttttgtatttttagtagagacgggatttcaccatgctggccaggcttgtcttgaactcctgacctcgtgatccccctgcctcagcctcccaaagtgctaggattacaggtgggagccacggcacccagcctagtctgctctttttctcc

SEQ ID NO: 113708 - DNA, 601 bp, Human
tcaccaaaaatataggctatcacttgttttcttgctccatgcatctttgaaaataaaatgctgtcctttgtgcccagattatactaaaaaaaataacaaaataaacctaggacctatgcctcttgccatgccattagtctacaattttttttttttttaagacaaactcttgctctatcacccaggctggagtacagtggcatgatctcggctcactgcaaccttctcctcctgggttcaagtgattctcctgcctcagcctctagagtagctgggattacaggcatgcaccaccatgccyggctaattttttgtatttttagtagagacgggatttcaccatgctggccaggcttgtcttgaactcctgacctcgtgatccccctgcctcagcctcccaaagtgctaggattacaggtgggagccacggcacccagcctagtctgctctttttctcctaaaataaggtggtggatttatgaatacaaagagtctaagaatggtggactaggtctagcaatgctgttcctcagcagctttttggacagaagtctttgtagacctgtggctctctcacttgatgtagacccatttgaatgaa

SEQ ID NO: 113709 - DNA, 601 bp, Human
actcctacccggattccagccaaagccggttctgcatcgtgctccagatcttcctccggctctttggtaagggaacagggtaccgtacgtcccgggacggctatgcgggccgagacgttccccggggagcgggcaggcgcgcagaggccatgggtcgagtatgtgtctttgggaactacagtttcatccctcaaagggtcgtctttacgggttgggagggggaaggagatgatacttgtctgagttgacagcggagcagtccccctagcgaggattcagtgttgtacctgagtgaggtggsgagaaagtaaggatgtgtgagcatgcagctctttgcccgtttgccttgggaaatgagtactggcttaccgcgtcctatgcgacagccttcgaaaaacaactctgctatcccagtctcgtcgtgtgtgaccttggacttctgccaaggcgtgggcctcagtttccctttattaccaaatgccgagtacttgtatgttgtcacttctgctgcacccgagggtccacaggatcgtgaagtgtctgcagtaaatgacatccaagcgaaggagacagggttttgaatgtcagaccttgaaaccat

SEQ ID NO: 113710 - DNA, 601 bp, Human
ctctacctacaaaatggtgctacaactgtaccttcatttgatatcaaactaatttgagatttcaaccggttagaaaataaagcaactcattttggagatccaaataaaattctatgacaatatatggaatattgaagaacataaagctgtgttttaagggatgttaaatactaaacgaaactcaacccagagcagcataatgctgagttagcaaatttaaatccaaggcagaaaatgcaagcctaggagtttgttttaatagtattactaatatggtgataattcattgaggtgggaaaargctttaaacataacagaagacccagaagttccaaggaaaaatctgaaaaatttcagtacataaaaataaaaagcttttttatggcaaagcttaaaaaagaatccttaaatgacaaactgagataaaatacttctatcataagtgattcacgttccagtaagagttttaccctgccagggaagctgaggcaggagaatcgcttgaaccaaggagttgcaggttgcagtgagccgagatcgctccactgcactccagcctggggatagagtgagactctgtctaaaaaaaaaaacaaaacaa

SEQ ID NO: 113711 - DNA, 601 bp, Human
gtaagggtatgaatagactttacacataaaagagtgaaacactttgttatgtaacatgtatagtaagtttttattttttcttttgtttttatttgcctgtttttggtaatccaaattgaaaaggcctgaactctttcatgagttgagttcatatatagtttcaaagttcctgaattgatttggatacctgcctctttttggctaccttgaaaactctagtgaactctcttaatcactggagaattggactgagatctctgagttgtgatttcagtaaattctgttctcaaaattttttatraagcagcatttatatacagtcttgattacttgtgcaagtcacttccaaatcctaatgagaaactgtctctggacttttatattttcttagacctacagtttaaataccaagaaaggctttcatgtctaatgtaaaaatgcagtgaaactttgatattattctgcaaaggccatgagaaagatgattactttggagacttgttacttaggatattggtttttaaaatgagagcagattcttcccaaattccataggtaggaacgtgactataaaaggaaaatctatgaaccccatatacct

SEQ ID NO: 113712 - DNA, 601 bp, Human
tagtggcccattttcttggggaatcaggtggtttgtatttagaggtttatatgtcttctactttattgtgtccttttgttttccttttcacagatgacttgacattttggcacagaatacattttaaatccctggacagagtcatcacttaaatgaactagcccttgcttatatgtgcagtggattgtgaaatgcgtctactgtaataatatgcaatgtcttgattacctgctgaaataaggtggatagatggatttttattttatttaatatttatttatttatgtattttgagacaggktctcactgtcacccaggctggcatgcagtggtgcgatctcagctaactgcaatgcctcccgggttcaagcgattctcccacctcaaccccctgagtagctgggagtacaggcacgtgctaccaccctggcatatttttatatttttggtagagacagggtttcaccatgttgacatggtcttgaactcctggcctcaagtgatccacccgcctcagcctcccaaagtgctgggattaccattgtgagccaccacacccagccaagatggatttttaatttggagtttgtcactttttctg

SEQ ID NO: 113713 - DNA, 601 bp, Human
atgaaatgataaaagacatattcttttgagttttaaaacttgttaaaatgtatgtaccactacaaattcatcttgaaaataatttagtaatttggtgccttggacagctacagtgttacttgaaatactttggaaattagaaagtaaggaatgaaattttaaagaataatttagtatgtttggtctgttctcctgaactctgactttacaaaacctttattaccctttaagccttagttgtcttgaggcttaatgttcataactgaaaatattcatatttcctaattaaaggaagaatatmataactcttagtggggaaacattcttacaaatacttcattcaaatgactttttctttctttcttttaggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttgg

SEQ ID NO: 113714 - DNA, 601 bp, Human
tcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttayggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagat

SEQ ID NO: 113715 - DNA, 601 bp, Human
ttataaatttgcccaaatttatatcagttttgtctgttttagggactccatcacacacggacaaaaagcagttgaaacggaaatgtctctaacgattttgtctgcttcagtgactggcggggaaagtcagcacctggaaatctcaatattactgtctcaaacctggttgaacttctgagcttgctttgccatttttgaatgggcattgtaacacctacccaacccagtgggtgcaaggattcaaaatgagatactgctcataaaagtcctccacagtacctaggacattagagggagccaktgtcttccccagagatccacacagttcaggtcccactttgctcacatctactctcgtggccccttgtcaaagaggccttccctgactctccttgaacagcgccatcctccctgcccccctccatcctgctactctttagtctctttgcctgatttgtttctcttcaggcttgtctccagctgatatatatttttacaactgtgatgtatatttacaggtatatgtgatacataattacgtatggagctatggagcagaggcttcctcctttgttcactgccatatctgcagtgtctagaa

SEQ ID NO: 113716 - DNA, 601 bp, Human
tcccagccaaaaagaatccaatatttctcactgattttggtatgtggtgatgttagcaaaagtgaaagcatagctgaaagagagactatctaattttggtgatggcttctgaggagtttttgtccagccttctgaggagaagagtgaagaagaacaggactaaaaagaggaacccaaaatcttccgaacaatttggaaattcacacgggaacccagttttcgggattccaccacacagagacagaaaacagtcattataaatttgcccaaatttatatcagttttgtctgttttagggacyccatcacacacggacaaaaagcagttgaaacggaaatgtctctaacgattttgtctgcttcagtgactggcggggaaagtcagcacctggaaatctcaatattactgtctcaaacctggttgaacttctgagcttgctttgccatttttgaatgggcattgtaacacctacccaacccagtgggtgcaaggattcaaaatgagatactgctcataaaagtcctccacagtacctaggacattagagggagccagtgtcttccccagagatccacacagttcaggtcccactttgctcaca

SEQ ID NO: 113717 - DNA, 601 bp, Human
atggtgggtatttgcatagcaaagtgaggtaatgcagaaaggtccaggcacctcttcagcaattgtgtggaatgttgccagtccctgctttagggaatataactgaaagaaaggaagaaataaaaagacatacttgaagggagcatatttcaaagtgaagctatattagctaaagatcaaatgacaacccagacactcctagtgttgcaaggaaagcaaaatgagacgtagaaggaacatgggctatccatctccattgacttggattctagtcccagctcagccacttgctgtttcatckgtttcttcatctctaaataggtatgacacctaccccttgggatcactggaaaattcagttcaattaaatgatataaataaaaagtcccaaggacatagcaggtcttctgtaagagtttccatttttctttctccctcctcccactgccaactcttacctttcatttcactcaagggttatgtcagatatatagcactctggtcttgctatgggccagacagacagcaactcacttgtctgggcctcccaataatagggtctttccccaccgaactattcgttcccagccaaaaagaatcc

SEQ ID NO: 113718 - DNA, 601 bp, Human
ttgccaggctggtctcaaactcctgatctcaggtgatcctcccacctcagcctcccaaaatgctgggattacaagtgtgagccaccacgcctagcatgatgagacatcgtgagcattcagaaatatggaaaggcacctgcttgtcttatgtatatagccagatgcctatgggccaggagttggggacagagacagggatccctagtgagtgagaaagtccactggtcccctgagaagacctgaatataagtgccaaccatgggttaaacgatgtgctcagccccaggggatatgaaagtcrtagtaaggaatgtgagatctggaagggacttccatgatcattcattctcgtggccttatcttacaaatgaggaaactgagctgaggaaaagaaactgccccagttttacacatttttttctttctggcccaggcttttagggccattcttcttgtttaccgatttcttcagttttaggccacagtcagtaagttaagccaacactgtccccacccaccccaatccagccctaccactgagcccttttgctataagaaacagagtcccaggccgggcatcatggctcaagcctgtaatccc

SEQ ID NO: 113719 - DNA, 601 bp, Human
atttttagtagagacagggtttccaccatgtttgccaggctggtctcaaactcctgatctcaggtgatcctcccacctcagcctcccaaaatgctgggattacaagtgtgagccaccacgcctagcatgatgagacatcgtgagcattcagaaatatggaaaggcacctgcttgtcttatgtatatagccagatgcctatgggccaggagttggggacagagacagggatccctagtgagtgagaaagtccactggtcccctgagaagacctgaatataagtgccaaccatgggttaaacratgtgctcagccccaggggatatgaaagtcatagtaaggaatgtgagatctggaagggacttccatgatcattcattctcgtggccttatcttacaaatgaggaaactgagctgaggaaaagaaactgccccagttttacacatttttttctttctggcccaggcttttagggccattcttcttgtttaccgatttcttcagttttaggccacagtcagtaagttaagccaacactgtccccacccaccccaatccagccctaccactgagcccttttgctataagaaacagagtcccag

SEQ ID NO: 113720 - DNA, 601 bp, Human
gtcaccttaatacacatcctgattcctccccttttcacttgagtgacttaggatttaaagctctcaggactgcctacttccctacctaccttaaaggcaaccatgactaagtgcaccctgctaacatccttgcctagaggctcctggttgttggtatagaaagaacatgggcttttttcattcaataaaatccacagtagttgtgtgaccttaagcaacttactttacttctctgaaccccagtcttcacattggttattatgaagattaaatgagataatttatggcaagcacatactgyaattcaatgcctagacccacaccaaatatgaatcccattctcctttctccaagggggtggggaatttaccaacctctaaggcttttgatttcgtctttggacaatttgactgaggaagttttgctttgctttatgttgaagtctgtttccctctagcttctacatgcattacaaaacacatctcattcttcttatgtaacaagacttgcagatatctgaggatacttatatcctctctcagacagttctgcaggttcccatctgcccctgttccttattgatgtactgaaagtgagtacc

SEQ ID NO: 113721 - DNA, 601 bp, Human
aatgaagacaaatcactaaaatcagactcatggaccaatcattataacataacctatccccttcctttttcttgagaattttccaatgacatgcaagatttaggagcatatgagccttctctcacagcaggcaatttttagtcctattacttcttatttggtttacctaacacaataccacccccaagagaagtcagtcctgactaaggttctgggtacagtggtggtggaggagggcaaggtgctgttgcccacctctgtctagatagcctatattgaattactcttcatactatttccyttttttgcttcctctgtggtggctctatggaggggacaggtgctatgtcatttaatcccccaacaaccccacaagatatgtattattttccccattttgcagctgagacaactgagagattgagaggttcaggaagtctaggacagggcaggtcagcctgagattccaagggcctatgattctgcagtcatgacgaagaataagggagggagatgaggtcaactaagaagaaaaaagagggccatactttaaataggtagggaatataatcaatcttcattattcatgaattctcactta

SEQ ID NO: 113722 - DNA, 601 bp, Human
gaactttaaagaagtatgcagtaaatcagatgatgagagcatgaaccaagttagtaagagtgaggcagaaaaaggtttaagaggtttttaaaaatgagttcaatcttagcatattgagttgaaagttgcttatctgtagggagttagatgttctacattttagatatttgcaagtgatccttaggtaacagagaactaggtatgggctggattcagaagttatcattacacagtaattaatgctccagaagtgggtgagttccccaaagaaaagtttatagaatgagaaattaagaaggtccatatagaacaaaatcttgaaaacaccaatattcaaagcgtgtgtatagggtaagtggccagcatcctattactaaaaacctacaccaaataatatcccgttatacttgtgaagtattctatcactagagtctgaatttgaaatttctttattagtggctgtcacccatggatgtcacccatggaatgtggaaactcataagtatccctccagtaaaatcaaacaccatacatatcaaaaataatattcaggccaggtgtggtagctcatacctgtaatcccaacactttgaaaggccaa

SEQ ID NO: 113723 - DNA, 601 bp, Human
aaaatgagttcaatcttagcatattgagttgaaagttgcttatctgtagggagttagatgttctacattttagatatttgcaagtgatccttaggtaacagagaactaggtatgggctggattcagaagttatcattacacagtaattaatgctccagaagtgggtgagttccccaaagaaaagtttatagaatgagaaattaagaaggtccatatagaacaaaatcttgaaaacaccaatattcaaagcgtgtgtatagggtaagtggccagcatcctattactaaaaacctacaccaamtaatatcccgttatacttgtgaagtattctatcactagagtctgaatttgaaatttctttattagtggctgtcacccatggatgtcacccatggaatgtggaaactcataagtatccctccagtaaaatcaaacaccatacatatcaaaaataatattcaggccaggtgtggtagctcatacctgtaatcccaacactttgaaaggccaaagcaggaggatcacttgaggtcaggggtttgaaaccagcctgggcaacatagtgaaaccccatctctatcaaaaaatataaaatattagc

SEQ ID NO: 113724 - DNA, 601 bp, Human
ggatcacttgaggtcaggggtttgaaaccagcctgggcaacatagtgaaaccccatctctatcaaaaaatataaaatattagccacctgtggtgctaaacacctgcagtcccagctactcaagaggctggggtgggagatccacttgagcctgggagtccaaggctgcagtgaactaggattgcactactgcacaccagcctaagtgacaggtatcctgtctttaaaaataaataaataaataaataaatatcatccttttttattttttattttattttatttttgagacagagttttgytcccgttgcccatgctggaatgcaatggtgtggtctcagctcactgcaacctccgcctcctgggttcaagcaattctcctgcctcagcctcccaagtagttggcattacaggtctccaccaccatgccaagctaatttttgtatttttaatagagatggggtttcaccatgttggccaggctgagtctcgaacttctgacctcaggtgatccgcccacctcggcctcccaaagtgctgggattacaggcatgagccaccacaccaagacttattttttgttgttttttgagtctcatttt

SEQ ID NO: 113725 - DNA, 601 bp, Human
aactaatccttggagctctctgagcactggaatcatgctgatcattgctgtatgcacagtgccctacagggagtgaatgcttatattaataataagcagttgttgaattaatcagtctattagaacacaaaaccccaagtatctacaaggtactaagacaactgcagactcagtaatgagatgctaaataaacttcttaaataatcccaatataactacactgaaattagctgctacactcttgaattcttacatgaagccaaagagtagatatatcatttaggactttttgtttttcatrtagaagtaacaataaattcaattgaaacagggttaaattaaaggaatgtattgacttacataccagaaaggtgcagagataagtcttcaagagtggcccctcaggatcccatgtcagtttttcagtgaatctctcggtgtttctctctgtatgaggagtcctcctcaggcctgcttccttcaagaacacaagataactgccagcaggtaaaagcagccacgtgcttcctccttaaggtccaaaggagttcctgctcccacataaatctggagtatgacagttacaagataactcagtcca

SEQ ID NO: 113726 - DNA, 601 bp, Human
ttagccaagcttggtggtacatgcctataatcccagttactacagaggccgagcaggagaaatgcttgaacctggcaagcggaggttacagtgagccgagatccagcctgggtgacagggcaagactgtctcaaaaaaaaaaaaaaggcacaatgggtagtgtgtaagagattaaatggtatagatagacaagggtcagtacatgtgtccatagcttcctgaatatgttttattttaaattactttattgctcagaatatatgtaactacatctgtatctgtagtctaaatactccgggcygggcgcagtggctcacgcctataatcctagcacttggggaggccgaggcgggtggatcacctgtggtcaggagttcgagaccagcctggccaacatggccaaaccccatattgtatttttagtctctcctaaaaatacaaaaattagctgggcgtggtggcaggcgcttgtaatcccagctactcggaaggctgaggcaggagaatcacttttacctgggggcagaggttgcggtaagccgagatcatgccactgccctccagcctgggtgacagagcaagactccatctcaaaaataaa

SEQ ID NO: 113727 - DNA, 601 bp, Human
aggtagtcgggtgcagcttagttttatacattttagggaggcacgagacattaaccaaacacatttaagaaatacattggtttggtccagaaaggcagaacaacttgaggtggtgagggagacttcaggctatcggtaaatttatttgtttttgttttgttttgttttgttttgtttgagacgagtctccctgggacatccaggctggagtacaatggtatctcggctcactgcaacctcagcttcttgggttcaagcaattctcctgcctcagcctcccgaatagctgggactacaggcrtgtgccaccatgcctggctaatttttatattttcagtagagacggggtttcaccatattggccaggctgttcttgaactcctgacctcaagtgatccgcctgccttggcctcccaaagtgctgggattacaggcctgagtcactgcgcccggcttataggtatatttaaacattttctggttgataattggttgagtttgtctaaagacctagaattaacagaaaggaatgtctggcttaagataaaggatgatggagacccgagttcttatttgcagaggaagccttcaagtataggct

SEQ ID NO: 113728 - DNA, 601 bp, Human
gggacatccaggctggagtacaatggtatctcggctcactgcaacctcagcttcttgggttcaagcaattctcctgcctcagcctcccgaatagctgggactacaggcgtgtgccaccatgcctggctaatttttatattttcagtagagacggggtttcaccatattggccaggctgttcttgaactcctgacctcaagtgatccgcctgccttggcctcccaaagtgctgggattacaggcctgagtcactgcgcccggcttataggtatatttaaacattttctggttgataattggytgagtttgtctaaagacctagaattaacagaaaggaatgtctggcttaagataaaggatgatggagacccgagttcttatttgcagaggaagccttcaagtataggcttcagagagaagagaatgtaaaatgtttcttatcagacttaaagtctgtgctgatgttaatgatgaagaggtataatgaggcatgttcgaccaccacttcccatcaggacctgaaacagtctctgcagttaaattttaaaagagccgtgaatgaggaggaagtccattcagatagacggttggaagggggatc

SEQ ID NO: 113729 - DNA, 601 bp, Human
cacttgaaactgtctcctaactgatctgtgactcccatttcccacctgtgcttgcacacacaaaacctcacatcactcaccccttggattgccagatgtatcaaataaaattacaggacacccagttaaatttaaagttcaaatatacaacaactttttagtataagtgtatcccaaataggacagggatatttgtaatacttgaggtattgtcccatgcaatatttgggatgtacttacacttaaaaaaaaaaaatattggtgttgaccaggcacagtggctcatgcctgtaataccagyactttgggaggccaaggtgggtggatcacgaggtcgggagatcgagaccatcctggctaacacagtgaaacctcgtctctactaaaaaatacaaaaaattagccgggcctggtggcgggcgcctgtagtctcagctactcgggaggctgaggccagagaatggcatgaacctgggaggcggagcttgcagtgagctgagatggcgccactgcactccagcctgggcgacagagcaagactccatctcaaaaaaaaaaaaaaaaaaaattgttgtttatctggaattcacattttacttgg

SEQ ID NO: 113730 - DNA, 601 bp, Human
gtgaaacccttaacttttgggggcagctggctggctggagctgtggactggatatctttgatcatgatcatgggtactgtattctttcactcagtgtgccacataaatattatagttctctatttgtgccatgatatgaaaaatattaggaagtgctgaaatatgaatgatgaagcaaaatattaaaaactagggtcttagggattccagacatgtgatttcacttcttccttctagttctgtcttagcattggctttgggggtagatggagaagttcagtggtggggagggggtcagatytaactgagattggatctagtgtggacactacaggtcatgactctttggagtggtctcagaagctggctgggtcctgggccaaatcagatggcatgggagcttcttaggggaggcgggtgccagaggttaactcagctgtcttccagaccccttgctgggagtctgtgaacccgagaaccactcaggtggctttccccaaagtgtgttctgtgcaatgctcatcccatgagctgcttctcagaaaaaagtgatgccaggtaaacttgggaaagactgctgtatctcctaccccttggagat

SEQ ID NO: 113731 - DNA, 601 bp, Human
gacttgttcaaagttacacagcaagtgggttcagaactgagacaagaggccaaggccccagacggaccatttccttcttctggcactcccatgccaccccaccctctctgtttccggcccatctttccaaggcctgacaagtgccgcccccacaggttggacagagacttgaaccggctcccccaggacctgtaccacgcccgttgcctgtgcccgcactgcgtcagcctacagacaggctcccacatggacccccggggcaactcggagctgctctaccacaaccagactgtcttctacmggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtgaagtgctgtctggagcagcaggatcccgggacaggatggggggctttggggaaagcctgcacttctgcacattttgaaaagagcagctgc

SEQ ID NO: 113732 - DNA, 601 bp, Human
cggagctgctctaccacaaccagactgtcttctaccggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtgaagtgctgtctggagcagcaggatcccgggacaggatggggggctttggggaaarcctgcacttctgcacattttgaaaagagcagctgctgcttagggccgccggaagctggtgtcctgtcattttctctcaggaaaggttttcaaagttctgcccatttctggaggccaccactcctgtctcttcctcttttcccatcccctgctaccctggcccagcacaggcactttctagatatttcccccttgctggagaagaaagagcccctggttttatttgtttgtttactcatcactcagtgagcatctactttgggtgcattctagtgtagttactagtcttttgacatggatg

SEQ ID NO: 113733 - DNA, 601 bp, Human; identical to SEQ ID NO: 29203

SEQ ID NO: 113734 - DNA, 601 bp, Human; identical to SEQ ID NO: 29202

SEQ ID NO: 113735 - DNA, 601 bp, Human; identical to SEQ ID NO: 29201

SEQ ID NO: 113736 - DNA, 601 bp, Human; identical to SEQ ID NO: 29200

SEQ ID NO: 113737 - DNA, 601 bp, Human; identical to SEQ ID NO: 29199

SEQ ID NO: 113738 - DNA, 601 bp, Human; identical to SEQ ID NO: 29198

SEQ ID NO: 113739 - DNA, 601 bp, Human; identical to SEQ ID NO: 29197

SEQ ID NO: 113740 - DNA, 601 bp, Human; identical to SEQ ID NO: 29196

SEQ ID NO: 113741 - DNA, 601 bp, Human; identical to SEQ ID NO: 29195

SEQ ID NO: 113742 - DNA, 601 bp, Human; identical to SEQ ID NO: 29194

SEQ ID NO: 113743 - DNA, 601 bp, Human; identical to SEQ ID NO: 29193

SEQ ID NO: 113744 - DNA, 601 bp, Human; identical to SEQ ID NO: 29192

SEQ ID NO: 113745 - DNA, 601 bp, Human; identical to SEQ ID NO: 29191

SEQ ID NO: 113746 - DNA, 601 bp, Human; identical to SEQ ID NO: 29190

SEQ ID NO: 113747 - DNA, 601 bp, Human; identical to SEQ ID NO: 29189

SEQ ID NO: 113748 - DNA, 601 bp, Human; identical to SEQ ID NO: 29188

SEQ ID NO: 113749 - DNA, 601 bp, Human; identical to SEQ ID NO: 29187

SEQ ID NO: 113750 - DNA, 601 bp, Human; identical to SEQ ID NO: 29186

SEQ ID NO: 113751 - DNA, 601 bp, Human; identical to SEQ ID NO: 29185

SEQ ID NO: 113752 - DNA, 601 bp, Human; identical to SEQ ID NO: 29184

SEQ ID NO: 113753 - DNA, 601 bp, Human
cactccagtctgggtgacagagcaaaatacctgtctctttaaaaaaaaaaaaaaaaatcaggaagaatatgcaaactgctaatagtgcttactgtgagaagctggggaaaaggtgagtgtttttgcgatacactgtggtactgtttgaattttcacacaaagcatactttaactatatatatatatatatatgttgtcagagacattcctctctatctccttcttactcccagactgcactcacatcccagcctctgtccagccctccacccaccacctcctaccccagccccacttacaratgcaggcagcagccagcaggcggctggcagcataaggggcgaagcagctcgggaagagaggctgtaccatgtagttggcaaaggtgatggcaatgatggcctggctggtgggctcaatgatgagcagggaggtccagagtctgatgaaagcaaggaatcctccaaaggcctccaggatataggcatagctggccccagatttcttaatggtggtgcccagttccgcataacaaagggccccaaagacggagaagaggcccccgacagcccagatgaccagagagagaccaaaggaggca

SEQ ID NO: 113754 - DNA, 601 bp, Human
gacttttagacaagcagaagacgaaatgccctgcccgcgactaaaccagactccttttcacttactaccctttcagcgtgtgtgtggcctgatgtccaactctgggctctgaatccatcactaaactaagaaccgtacccaacaaaggacactgacacatggcacaggctggccgtgctgccaggcagagataggacgggttctatctacacagggagaacaagaaggctggagtggccttgctaacgcgccattatcacttgaaaaatatccatgagagcctatctccccaggccacgcygccgctctttcccttccttcgtagacatatttctctccatgaattaacaacataaattaaaagaaccgagcaggtgtgaccatgagaccaccggcctccgtgagtctttgagaaaacaagccaaagtccccttccaaatgacagtgacagccccctagccgggtggcccaccccgcagcctgtaataacacacctacaaaacgcagtttagcagactcaaaggaaagcctctaagatctcaatagatttggactataatccaaaaaccatccctccccagcgctattgctgacaggacat

SEQ ID NO: 113755 - DNA, 601 bp, Human
aatagaataatagataccagagaccaggaagggtgggtggggggcaagagaatgaagagagattggttatgcgtacaaacatacagttagatagaagaaataagttctggtgtttgatagcagcttagggtgactatactataatagcaacaataccgtgtacatttcaaagttaccagaagagaggacttgtaatgataccaacacgtaaaaatgataaacattcaagtctatggacaccccaaataccctgtcttggtcagtacacattctatgcatgaaacaaacactcacatgtatkccacaaatatgtaaattattatataccaataacagagaagaaactaattataattgacccataaagtcaagggtgagttgagtctatggatcctggttacaataaacgtcttcaagcctctgtcccctttgctaatgttttcataaccgagtaactcacttcagcctcacagcagacccatttcccagacaagaaaactgagacacagagaaaagtggcttgaggctgtaacttgatttgtgaaagaaggctaattttacccattttttccatcggccattccttattcctgcaaaacac

SEQ ID NO: 113756 - DNA, 601 bp, Human
tcttgcacacttacacccgagctttcttgacagctcatgctccagaaccttgttccgctttatccatgccaaggtcccaagaagaccatgaaggatcttctgcagctgtgattgcaaattcatatactacatatgaattgtgattttatagtggctcccatctccttttaaatataaccagtggtaaattattaagtagggagcatctatggcactattttctcattaaataggaacgtgtaagagagagggggattattaatacccaggtatagccatgaaatatgtcatgcagaactaygtcaacaaccagccctatgtatcccagagggaagcaagttgagaacggttgtactacaattgcatgataacaccatttgccacactatatcaggtggtttaatttggtagcccatccctacaaaacgtgaatccctggtttcaaaggcattaggaagtcataggtataggcagaagtcagatggtgccatttgcctcatacaaatactatctaatgcttctcatctcgctcaaggcagaagtaaaatccccacatcaatgtacaaagccctgcatcttctgcacctgtgcccctttccca

SEQ ID NO: 113757 - DNA, 601 bp, Human
aacacctctgcacctcccacccccaccccaccaattcatgacctgccctgaatctcactcctggcgtttgcctaatcctcaactaatcccactaagaactagttccctgcatctgtacaactcgagatcctattatacagctttaaatgcatgcaattaatagaagactttgagatataaaacccctttaagaatttaaggaataatctctgatggcggaactttagactttctggctaatgggggttgggggaggtattcaaagactacgaagacattctggcatcttcaaatcacgccrtgtagacagaacattagccagtcccaagcgggacttagacatgttagaggttagacagatgggagatgagggtcctctagccattgactccctttggagaaaaagcaaactacaggtacacaccctggcccagcccagctcccccacccagaggagaggttgccagagtgggctgacagcaggacagagggcaccaggtggctgcacaagccgctaataggttttctgagtagctggaatctgctccactgtttgcaaatcatcatcaccctccatcaatggctgcgcccctaggtgtgg

SEQ ID NO: 113758 - DNA, 601 bp, Human
tctcgaactcctgccctcaggtgatccgctcagctcagcctcccaaagtgctgggattacaggcatcagccaccacacccggcctgggaaggaatcttgagcccagtcactatcctaagtcagggagctcagggagctcagggagcgagcttccccttccctcctaaccactgcaccaacacctctgcacctcccacccccaccccaccaattcatgacctgccctgaatctcactcctggcgtttgcctaatcctcaactaatcccactaagaactagttccctgcatctgtacaactcragatcctattatacagctttaaatgcatgcaattaatagaagactttgagatataaaacccctttaagaatttaaggaataatctctgatggcggaactttagactttctggctaatgggggttgggggaggtattcaaagactacgaagacattctggcatcttcaaatcacgccgtgtagacagaacattagccagtcccaagcgggacttagacatgttagaggttagacagatgggagatgagggtcctctagccattgactccctttggagaaaaagcaaactacaggtacacac

SEQ ID NO: 113759 - DNA, 601 bp, Human
caccccacctgtccctcaacactggatcctacacctctcccaaacacacaagccacacttttcatgaggctttctctgttttgtgaaattctacagattcttcaaggcccattcaaagttctcttcctctgcaaagcttccctggcacactctcttgctttcctggccagagcgttcactcttccctgtttcagcctccatggtattgttcgaatgcagcatttcccacttcctgagaacaagagactgtgtgatttactgtttcctattccatactttctgttggcctgagtcaaaggtrcgttaaaggtaggaagatcttctttaaatttccagagttcttagaaggttaagagttattgatccagagaagaacctgtgatttcaaaaaagtttataatcaccgacttttcccaaaaggctggctctgatttcctgtgttgctcacagcaaccccagggcaaccacgatggtctttggtttccaggtgcggactggagatgcggggagggcacatatctgatggaggataaagtccagaaagcagcagagcacaggttggaggtcaggcactctggctgcggtgcccacaagctggacc

SEQ ID NO: 113760 - DNA, 601 bp, Human
agaaggctcctcaaaccagctcctctctatctcttcatcctcatctcctactctgtccaccccacctgtccctcaacactggatcctacacctctcccaaacacacaagccacacttttcatgaggctttctctgttttgtgaaattctacagattcttcaaggcccattcaaagttctcttcctctgcaaagcttccctggcacactctcttgctttcctggccagagcgttcactcttccctgtttcagcctccatggtattgttcgaatgcagcatttcccacttcctgagaacaagmgactgtgtgatttactgtttcctattccatactttctgttggcctgagtcaaaggtacgttaaaggtaggaagatcttctttaaatttccagagttcttagaaggttaagagttattgatccagagaagaacctgtgatttcaaaaaagtttataatcaccgacttttcccaaaaggctggctctgatttcctgtgttgctcacagcaaccccagggcaaccacgatggtctttggtttccaggtgcggactggagatgcggggagggcacatatctgatggaggataaagtccagaaag

SEQ ID NO: 113761 - DNA, 601 bp, Human
cctgtttctctgattgcgcccttaccaggacattggttgtgactgacttgccttttaggttttcttattaggacagaattcactgaccggagaacacaagtgaacaagaacacagaatggcagaggaccggaggagtcagatttctcattgtgaagtcggagtactgacgtgaacaccagacacctgtgaggtgcattaagtcagtttccaaacctgctatcctctggttgtgtctcaaaatcaagttaccagaactacatctcagaccacaagggcacctacacgaccagccagtcaatrtccccaataaacaactttatttcatcactcttcctagctgcaatctcagtttcctcatctgtaacatgggtaatttttatgtggccactgtaagcattaaatatgctgcgatatttaatcacgtagcatggtggcgggtacaaagtcgctactcaagaatgttcatgatcttccaatcccctcgatttaggacctcatcaaaccttactggtagaggggcaatattttcactccagtgacccctcttcatcagccctgccagatgggggctttctgaagccctaacactttcctactcag

SEQ ID NO: 113762 - DNA, 601 bp, Human
aaacaccagtgacctagaaatggctaccataatacaccaccctgccccccagtacccctggcagaggttgctaagttatcacagcactcttgcccataagccttaaagtggcttcagaatctctcaacacagcatcccagacagctgctatcaattggattggcgttgacaccaggcagtgagactcattttctattccaatgttgtttaatcagcaatttgtaacaaacacagtgctcttggctatggggcgtgcatgattcatcaggccatagcacagtctcgatgacagattcaagaygatgtcgcctcctgtttctctgattgcgcccttaccaggacattggttgtgactgacttgccttttaggttttcttattaggacagaattcactgaccggagaacacaagtgaacaagaacacagaatggcagaggaccggaggagtcagatttctcattgtgaagtcggagtactgacgtgaacaccagacacctgtgaggtgcattaagtcagtttccaaacctgctatcctctggttgtgtctcaaaatcaagttaccagaactacatctcagaccacaagggcacctacacgacca

SEQ ID NO: 113763 - DNA, 601 bp, Human
tttagtgccagagacgtcccaaagcacagagggatgcctgatgggggccatggccttaaggggaccagagggtgaggagctgggaagctggactggagggcaggccctggcctggcccagaggggtgggctgggcttggacaggggcagggaaacagtggtggaggggctggaggccagtggagacgagcagtcatgctttgtgggtgattatataaaaaatgtgggaaaagtccattctggctggtgatattaaatggcaattcacacccatttggtaatgaaaagcctcccctacctayggcttctgtgtagtagaaagagctgggcttagaattcacacagtcctaggtcagaccctgccacttactggctctctgacctatatttaatggtgacccaccccccaacccccagcccaacctgacaggggtagctgggagagataaggaactggaaaacgtgtggtatcatatgaccttctgagaggtaaaccagtgcaatcaacacagaggcatagccccagctagcttcaaacatccttgaaaaacaggatgtctcttaagtaaatagcagtcaaaacatggctcatctgattaagg

SEQ ID NO: 113764 - DNA, 601 bp, Human
caacaacaccttcaggctgccccagccactgctggctctgaagccatcccatttattcaaaggctagggacaagcccccagtggccacgttgcaaactaatggagtcgagagaagggctcagaacagttatcctaatcctggaatggctatttaagtaccactttgtgcctgagacattcggagcaatttgctaatcccagcccagcactcaccaccaggcccctttgtggtggtcggtgccacacactagtgtctctgtttctcagatgcaggcatgaggacactgaaaacaagtgaatwttcaaaactccgcaggaaaactatctcgatggagcctggaaattcaagcctcccgatttgccagttcatcctacagatgctttttaaccaaatctgagaaacacagtggttctaatgaaaggctgtttctatggcagattccataaagagaaaagaacaaaggcagtgatggaacaagttcccttcaacgaatcactcaacacagcaaggttgacatgttttcatggtttcccacacactgaagtcagagtgggtgtccagtggtcattcatttttccactccacatgtatttatttagt

SEQ ID NO: 113765 - DNA, 601 bp, Human
cacttccgggcctgggccttcccgcaggagttgccgaattgatcttgcggtctccaggcttccttcctttccagatcactcactgcaagggtcctcccgctcagagccgtccattgctcctcggtgctttccagaccctttaaacaccctggcggagccttgctcggcccttctgggtccacttggtagccgagggtccgagctgacctcatgctttccgcactgtcgggcagcgttgtcatcagcggtactctccgcctgggaaccctcccgcgtctcttctccctgtactctggagtgycccttacagccaacttaaaggcacctccctgcagatcgtcccttgattccctccgatgcagttttctctcctcctcccgagtttccaaagcattgtatcttgtagcaggttccttttggcgcggtttgtggtcgaggcacagcccatctccccttccaggctcttaaatgcttttcagagcagccaccacagactctgaaagaagaggaggagctcgcgtcttgccaggggctaggaattaggaacatctcagaggggggctccctgtaggagtcagggctggaggggcgtctacaggca

SEQ ID NO: 113766 - DNA, 601 bp, Human
tccagtcccaaccactgctgcccctgctcgctgcgcatccctgagggtctccatcacttccgggcctgggccttcccgcaggagttgccgaattgatcttgcggtctccaggcttccttcctttccagatcactcactgcaagggtcctcccgctcagagccgtccattgctcctcggtgctttccagaccctttaaacaccctggcggagccttgctcggcccttctgggtccacttggtagccgagggtccgagctgacctcatgctttccgcactgtcgggcagcgttgtcatcagcsgtactctccgcctgggaaccctcccgcgtctcttctccctgtactctggagtgccccttacagccaacttaaaggcacctccctgcagatcgtcccttgattccctccgatgcagttttctctcctcctcccgagtttccaaagcattgtatcttgtagcaggttccttttggcgcggtttgtggtcgaggcacagcccatctccccttccaggctcttaaatgcttttcagagcagccaccacagactctgaaagaagaggaggagctcgcgtcttgccaggggctaggaattaggaac

SEQ ID NO: 113767 - DNA, 601 bp, Human
aactaacaccatcaaaacaaagaactttaatgcaatagctctcagtatttagtgaattccttcttaaagcaaagcatccttttgggatagaattaatcaattccctaattttctggctttgtaaatgtgaacgttagtatattaagtattcaccccttcaataagatctgtaatacaattcaatgctaccacctaccgcaaggacatttttcaggtaattgatgtttgtcattaaattcactgacaaatatgaaaggcaaggagaaaactagaaacattttggacactttttatcatgcawgtataactaaatctattcagttaaagcttttttttgccttccacaaacgtttttatctataatatttttcatatgcacttgggagctaattactgaaagaaacctcatggtgaaggttttgcaaattaaacaaacatcctgcaatgcatctgggctttgaatcttgatgcatgcacagtttttgaggtggttttgtttttggttttctaagttcagaagaaagccctgtacatagtggaacaaattatgttccttcaacaaatcagcgtttcttgaaggaatgggcaaagcaggtgatac

SEQ ID NO: 113768 - DNA, 601 bp, Human
caagattccataatcgcatttgactctaaaactctttatttcccccacataacacacttagggaaaggatggttattttcactctgaccgagctttgaacacttcactatatttctctaccccactctctcacccccactctctctaccccattctccactcctagcctcctggtgcccaggaactaacaccatcaaaacaaagaactttaatgcaatagctctcagtatttagtgaattccttcttaaagcaaagcatccttttgggatagaattaatcaattccctaattttctggctytgtaaatgtgaacgttagtatattaagtattcaccccttcaataagatctgtaatacaattcaatgctaccacctaccgcaaggacatttttcaggtaattgatgtttgtcattaaattcactgacaaatatgaaaggcaaggagaaaactagaaacattttggacactttttatcatgcatgtataactaaatctattcagttaaagcttttttttgccttccacaaacgtttttatctataatatttttcatatgcacttgggagctaattactgaaagaaacctcatggtgaaggtt

SEQ ID NO: 113769 - DNA, 601 bp, Human
cctatagtcccagctacaggagaatcacttgagcccaggaggtcgcggctgcagtgggctatgattgcatcactgcactccagcctaggcagacttggtggcatcgcaagaccctatctcaaaaaaaaaaaaaaagctgtgagcattcttggagaaactgattaacagtgtttaagccaagattccataatcgcatttgactctaaaactctttatttcccccacataacacacttagggaaaggatggttattttcactctgaccgagctttgaacacttcactatatttctctaccccrctctctcacccccactctctctaccccattctccactcctagcctcctggtgcccaggaactaacaccatcaaaacaaagaactttaatgcaatagctctcagtatttagtgaattccttcttaaagcaaagcatccttttgggatagaattaatcaattccctaattttctggctttgtaaatgtgaacgttagtatattaagtattcaccccttcaataagatctgtaatacaattcaatgctaccacctaccgcaaggacatttttcaggtaattgatgtttgtcattaaattcact

SEQ ID NO: 113770 - DNA, 601 bp, Human
gtaattccagcactttgggaggccaaagtgggaggatcatttgaggccaggagtttgccaccagactgggtaacatagcaagactccatctctaaaaatattgtttttaatgagctgtgcatggtggcatgcacctatagtcccagctacaggagaatcacttgagcccaggaggtcgcggctgcagtgggctatgattgcatcactgcactccagcctaggcagacttggtggcatcgcaagaccctatctcaaaaaaaaaaaaaaagctgtgagcattcttggagaaactgattaacartgtttaagccaagattccataatcgcatttgactctaaaactctttatttcccccacataacacacttagggaaaggatggttattttcactctgaccgagctttgaacacttcactatatttctctaccccactctctcacccccactctctctaccccattctccactcctagcctcctggtgcccaggaactaacaccatcaaaacaaagaactttaatgcaatagctctcagtatttagtgaattccttcttaaagcaaagcatccttttgggatagaattaatcaattccctaat

SEQ ID NO: 113771 - DNA, 601 bp, Human
acagagtcacaaaccaaggaagcatattacagccctgagcagggccaggtatggtggctcacacctgtaattccagcactttgggaggccaaagtgggaggatcatttgaggccaggagtttgccaccagactgggtaacatagcaagactccatctctaaaaatattgtttttaatgagctgtgcatggtggcatgcacctatagtcccagctacaggagaatcacttgagcccaggaggtcgcggctgcagtgggctatgattgcatcactgcactccagcctaggcagacttggtggyatcgcaagaccctatctcaaaaaaaaaaaaaaagctgtgagcattcttggagaaactgattaacagtgtttaagccaagattccataatcgcatttgactctaaaactctttatttcccccacataacacacttagggaaaggatggttattttcactctgaccgagctttgaacacttcactatatttctctaccccactctctcacccccactctctctaccccattctccactcctagcctcctggtgcccaggaactaacaccatcaaaacaaagaactttaatgcaatagctctc

SEQ ID NO: 113772 - DNA, 601 bp, Human
ggtctctccaacaaaggaaaatctgaacgccatcctcttaatggagactgacactgcacttcccaaaatgtgttcccaggaacaccagccctgtgcaatgtcacccacaccaatccaaagggtgctctgggcaagtaaatgtggacaatgcaaaccttgtccttacagagtcacaaaccaaggaagcatattacagccctgagcagggccaggtatggtggctcacacctgtaattccagcactttgggaggccaaagtgggaggatcatttgaggccaggagtttgccaccagactgggyaacatagcaagactccatctctaaaaatattgtttttaatgagctgtgcatggtggcatgcacctatagtcccagctacaggagaatcacttgagcccaggaggtcgcggctgcagtgggctatgattgcatcactgcactccagcctaggcagacttggtggcatcgcaagaccctatctcaaaaaaaaaaaaaaagctgtgagcattcttggagaaactgattaacagtgtttaagccaagattccataatcgcatttgactctaaaactctttatttcccccacataacacacttag

SEQ ID NO: 113773 - DNA, 601 bp, Human
ctttctcatctcaagttgaaatctgctttcctgtgacttctaccccaccctttcctgggtccttccctggagcaccaaggagtgaatctctactcttgctggtagcaacctggtgacaattcgggactttttttcagccttttcagtattctcttttcctctgttcctccaaagtttctcccaggcatgcagaaagacccttttcctcattgaacccctgcctatgtccatccaatgatcaaggtctctccaacaaaggaaaatctgaacgccatcctcttaatggagactgacactgcayttcccaaaatgtgttcccaggaacaccagccctgtgcaatgtcacccacaccaatccaaagggtgctctgggcaagtaaatgtggacaatgcaaaccttgtccttacagagtcacaaaccaaggaagcatattacagccctgagcagggccaggtatggtggctcacacctgtaattccagcactttgggaggccaaagtgggaggatcatttgaggccaggagtttgccaccagactgggtaacatagcaagactccatctctaaaaatattgtttttaatgagctgtgcatggtggca

SEQ ID NO: 113774 - DNA, 601 bp, Human
gtccctcctcccaaattatccacaagactctgatcaaatacttccctctttggagaattctaatttttggaaagttctttctcatctcaagttgaaatctgctttcctgtgacttctaccccaccctttcctgggtccttccctggagcaccaaggagtgaatctctactcttgctggtagcaacctggtgacaattcgggactttttttcagccttttcagtattctcttttcctctgttcctccaaagtttctcccaggcatgcagaaagacccttttcctcattgaacccctgcctaygtccatccaatgatcaaggtctctccaacaaaggaaaatctgaacgccatcctcttaatggagactgacactgcacttcccaaaatgtgttcccaggaacaccagccctgtgcaatgtcacccacaccaatccaaagggtgctctgggcaagtaaatgtggacaatgcaaaccttgtccttacagagtcacaaaccaaggaagcatattacagccctgagcagggccaggtatggtggctcacacctgtaattccagcactttgggaggccaaagtgggaggatcatttgaggccaggag

SEQ ID NO: 113775 - DNA, 601 bp, Human
ataagtcagttcttagcaaagtagtagtgcacctaattaagtgaatgcagcgcatggggtttctgtgaaccaagtcctatttcctctgagagttgtctaactggtaatccagtcattgaaggagatcgtttcgaaagtctcccaagtcctactcccggtccatgcaactgtccctcctcccaaattatccacaagactctgatcaaatacttccctctttggagaattctaatttttggaaagttctttctcatctcaagttgaaatctgctttcctgtgacttctaccccaccctttccygggtccttccctggagcaccaaggagtgaatctctactcttgctggtagcaacctggtgacaattcgggactttttttcagccttttcagtattctcttttcctctgttcctccaaagtttctcccaggcatgcagaaagacccttttcctcattgaacccctgcctatgtccatccaatgatcaaggtctctccaacaaaggaaaatctgaacgccatcctcttaatggagactgacactgcacttcccaaaatgtgttcccaggaacaccagccctgtgcaatgtcacccacaccaat

SEQ ID NO: 113776 - DNA, 601 bp, Human
caagtatttcattaacttgatcattagatgctggctgatcagaaagtcccaagatttctaactactgtaatctaaatggtataggcgtttctaaaatatccacactgaaaaaaagctcctttgctcatcccaaatccatttcatctgattgaatgattttctcatttccacagagagctgttaaaccagccaagcaaactatcaaagctccgcaggcccaggaggaggaagaaattagacgacatttggataagtcagttcttagcaaagtagtagtgcacctaattaagtgaatgcagcrcatggggtttctgtgaaccaagtcctatttcctctgagagttgtctaactggtaatccagtcattgaaggagatcgtttcgaaagtctcccaagtcctactcccggtccatgcaactgtccctcctcccaaattatccacaagactctgatcaaatacttccctctttggagaattctaatttttggaaagttctttctcatctcaagttgaaatctgctttcctgtgacttctaccccaccctttcctgggtccttccctggagcaccaaggagtgaatctctactcttgctggtagca

SEQ ID NO: 113777 - DNA, 601 bp, Human
gagcccaccgtgttgggggaggctttgcctggcatttcttgggtgggtatttcaaacagggagagtaaagctgctctcctgcaggtcccttaatgtcaccctctgcgtctccttttacctatttgccactaagcagcaagccactgaaccattccactccccagtttcctccccaaaataagatcttatttcccagagggagcagcgtacggactgagtgagccctgcatccagcaggtcttcccctaaacattgtagagccctccgtgcccccaggtaattcctgacacccagaaaggayggggccgcctgttgagaactgtctcagggggtctcagattctcgctgaattgaattctaagcattttatttgaatcaaaatatatcacattgcatacattaatgtttacttcatcttatgcatttggagttagagcctctctaatcacctatgcgaaactaagtaagcaaggtgtaaatctggatccgaaattagatgaaaaaattccatcctgttcagcttatcaaatttcaagtatttcattaacttgatcattagatgctggctgatcagaaagtcccaagatttctaactactgta

SEQ ID NO: 113778 - DNA, 601 bp, Human
cataggagtttgttgagttaacctgagtgactcaccagagagccttcagcttattctcctcttctctggggggtgagacgtcctcctctgcccacccagcgggtgcagaggggaggggacgcttctccctcagtagattcttccttcctaaatgggccaatgtgtctcagacactgagggtcagggtgttcctggagtctgaggcctcggcagcgctggccgccaagggaacatgtgttccatgggccacccggagggaacatgtgtacacatgtgtgcatgcctgtgtgtgcacgtgtgyctgtgtgtgcatgcgtgcatgtgtatgcatgtgcacgagtgtgtgcatgtatgagtttgtatttgtgtatatatgttctcgtgtgtgtgtatgtatctgtgcatgcatgcatagatgtgtgtgtgcacatatcaaggcaacttcagacaaagaaaccaagagtgggtcccagggggttagtttctggggctggggacagggttgggggagaggatgacaaggaggatgcagctgggggtggggagagaatatactacaaaaagaaatcaagagtggttctggcatttaatttctaatctc

SEQ ID NO: 113779 - DNA, 601 bp, Human
attttacaagtgttcacccacttaaccctcacagcaactttataagtcaggtgttctacttatccttattttacaagtggaaaacagggcacagagaggttaaaaaacttgcccaaggtcacatagcagagaagtggcggagttaggatttgaactcagcaaccggagccaagtcggccaccgcaagcattctgcttttgtgcctcaaagacgcctgtgcagcaacaagaagctcagaaattctgaggaagtaatggttaagagagacatgggatctggctgggaaagccatgagacagarcctagggaggttcttggttctccaccgacagcttttgctacagagcacggtagccccttgttcaggccactaactctaattagtattttgcatttgccaagtgcctaccctgtgctgaggccaatggaaggatgctgaagtcagtgacagctgacatagtcctcccagggcctccctaggaactggcctgggatgcaactggccaatcagaccagacagttggcctgggttcacttcttttagaattttttttagagatggggtcttgctatgttgcccagtctgggttcaagcaatccg

SEQ ID NO: 113780 - DNA, 601 bp, Human
tctagtttgatgcccatgggacaagcagttagaggcactggtggaggaacaaaagaaaaaaagaaaagacaggaatcaatagcattttaggaggtgctgggcactgctctaagcattttacaagtgttcacccacttaaccctcacagcaactttataagtcaggtgttctacttatccttattttacaagtggaaaacagggcacagagaggttaaaaaacttgcccaaggtcacatagcagagaagtggcggagttaggatttgaactcagcaaccggagccaagtcggccaccgcaascattctgcttttgtgcctcaaagacgcctgtgcagcaacaagaagctcagaaattctgaggaagtaatggttaagagagacatgggatctggctgggaaagccatgagacagagcctagggaggttcttggttctccaccgacagcttttgctacagagcacggtagccccttgttcaggccactaactctaattagtattttgcatttgccaagtgcctaccctgtgctgaggccaatggaaggatgctgaagtcagtgacagctgacatagtcctcccagggcctccctaggaactgg

SEQ ID NO: 113781 - DNA, 601 bp, Human
ctgtgctcagcctctagtttgatgcccatgggacaagcagttagaggcactggtggaggaacaaaagaaaaaaagaaaagacaggaatcaatagcattttaggaggtgctgggcactgctctaagcattttacaagtgttcacccacttaaccctcacagcaactttataagtcaggtgttctacttatccttattttacaagtggaaaacagggcacagagaggttaaaaaacttgcccaaggtcacatagcagagaagtggcggagttaggatttgaactcagcaaccggagccaagtyggccaccgcaagcattctgcttttgtgcctcaaagacgcctgtgcagcaacaagaagctcagaaattctgaggaagtaatggttaagagagacatgggatctggctgggaaagccatgagacagagcctagggaggttcttggttctccaccgacagcttttgctacagagcacggtagccccttgttcaggccactaactctaattagtattttgcatttgccaagtgcctaccctgtgctgaggccaatggaaggatgctgaagtcagtgacagctgacatagtcctcccagggcctc

SEQ ID NO: 113782 - DNA, 601 bp, Human
gggctcccaaactgctgggattacaggcatgagccactgtgctcagcctctagtttgatgcccatgggacaagcagttagaggcactggtggaggaacaaaagaaaaaaagaaaagacaggaatcaatagcattttaggaggtgctgggcactgctctaagcattttacaagtgttcacccacttaaccctcacagcaactttataagtcaggtgttctacttatccttattttacaagtggaaaacagggcacagagaggttaaaaaacttgcccaaggtcacatagcagagaagtggcrgagttaggatttgaactcagcaaccggagccaagtcggccaccgcaagcattctgcttttgtgcctcaaagacgcctgtgcagcaacaagaagctcagaaattctgaggaagtaatggttaagagagacatgggatctggctgggaaagccatgagacagagcctagggaggttcttggttctccaccgacagcttttgctacagagcacggtagccccttgttcaggccactaactctaattagtattttgcatttgccaagtgcctaccctgtgctgaggccaatggaaggatgctga

SEQ ID NO: 113783 - DNA, 601 bp, Human
aggaggtgacacttggggagctggatgcaggcagggataaggcagcagcacctggacatgcccaggctgtgacaggtaagctccatgcagtgggagaccactctagtgccccaacccatccctctcctatccctgagacatgccccttgcttggtctggaatgcccttctctacacctacagatgctagacaacttttttttccctttctctcactctgttgcccaggctggagtccagtggcacaatcatagctcactgcagcctcgaactcctgggctcaagagggccttccacctcakcctcccaagcagctgggactacaggtgagcaccaccacacctagctaatgtttttcattttttttttattgaaatgaggatctcactatgttgcctaggatggtctcaaactcctggcctcaagtgatcttcttgccttgggctcccaaactgctgggattacaggcatgagccactgtgctcagcctctagtttgatgcccatgggacaagcagttagaggcactggtggaggaacaaaagaaaaaaagaaaagacaggaatcaatagcattttaggaggtgctgggcactgctctaag

SEQ ID NO: 113784 - DNA, 601 bp, Human
agagctgacattcctatgggagggaggagagagagatagaggagcagtaagatctatttatcccacagggaagtggtgagtgctaagaggaaaatcaaacgtggagtggggatggagagggctgtggggtgcagtacccgatggtgttcagtcccggaggcctttatgaggaggtgacacttggggagctggatgcaggcagggataaggcagcagcacctggacatgcccaggctgtgacaggtaagctccatgcagtgggagaccactctagtgccccaacccatccctctcctatccytgagacatgccccttgcttggtctggaatgcccttctctacacctacagatgctagacaacttttttttccctttctctcactctgttgcccaggctggagtccagtggcacaatcatagctcactgcagcctcgaactcctgggctcaagagggccttccacctcagcctcccaagcagctgggactacaggtgagcaccaccacacctagctaatgtttttcattttttttttattgaaatgaggatctcactatgttgcctaggatggtctcaaactcctggcctcaagtgatcttc

SEQ ID NO: 113785 - DNA, 601 bp, Human
tgggaagactgcaaactaacagaggtgaaagatagagctgtatgaaaaataggacaataaaagggtcaaatactcagtaagataatagctcaagagatgccccaagacagtgtgcaattaaataccaaacgagaggttgcaacaagaaccaccaggagttcaagggagtggctgagatcagagagggctacagcactgggggcatctttgatggagcagtgagaattgaacagaatcttcaaagactgccaggttttaggaagttgtggggatccatttcaataccaccaatgctttttcraaggccgctgtgttccagaatcttcttgattataaaagataatcagagaacacaggcttcctgacctcctggagagaacgtgtggatccagaaccaaacgcttgaaaattaaaacatgtatgttagacaacaacataaatacgtctattgtaggaagctgtgtgaatgttatgtaaaggaatgattcgttgctaacgatcgtatagcctttacagcattaaatgtctcccgttgtgaggttggagggagtttccatccctcacaaagattttatacaaagaggaaaataaagtgatgatt

SEQ ID NO: 113786 - DNA, 601 bp, Human
tcctactcttgggaagactgcaaactaacagaggtgaaagatagagctgtatgaaaaataggacaataaaagggtcaaatactcagtaagataatagctcaagagatgccccaagacagtgtgcaattaaataccaaacgagaggttgcaacaagaaccaccaggagttcaagggagtggctgagatcagagagggctacagcactgggggcatctttgatggagcagtgagaattgaacagaatcttcaaagactgccaggttttaggaagttgtggggatccatttcaataccaccaawgctttttcaaaggccgctgtgttccagaatcttcttgattataaaagataatcagagaacacaggcttcctgacctcctggagagaacgtgtggatccagaaccaaacgcttgaaaattaaaacatgtatgttagacaacaacataaatacgtctattgtaggaagctgtgtgaatgttatgtaaaggaatgattcgttgctaacgatcgtatagcctttacagcattaaatgtctcccgttgtgaggttggagggagtttccatccctcacaaagattttatacaaagaggaaaataaa

SEQ ID NO: 113787 - DNA, 601 bp, Human
ctgtaatcccagcactttgggaggctgaggcaggtggatcacctgaggtcaggagttcgagaccagcctggccaacatggtgaaaccccatctctactaaaaatacaaaaattagccaggcgtggtggcgtgcacctataatcccacctacccaggaggctgaggcaagaaaatcactggaacccaggaggcagaggctgtagtgagctgagatcacggcactgcactccagcctgggccctgggcaacacagcaagactccgtctcaaaaaaacaaaacaaaacaacaataaataaaaacaaacaaacaaacaaacaaacaatgttatggttgtgttggcaactttctttccagctctgcagttccatgaattcgtgaagtgaagacctcatttctactctaacatcagtgctgaagtccactttcataatctccttttcaaagtgacctgtctcagcactcgtgaccttgaactcctgaataaagggatgtcaagcattagagaaagaatgaaaaatgcacagtgaatctagtatcaaacaaaaacagccagcgcatcatttctggaatgactgagttttagccttcggagagagacat

SEQ ID NO: 113788 - DNA, 601 bp, Human
tcttatctgcacaatattgaagggtgtctagggggccccctcttaaagccttggcttcatgtctttttaaagaaatatggctgggtgcagtggctcacacctgtaatcccagcactttgggaggctgaggcaggtggatcacctgaggtcaggagttcgagaccagcctggccaacatggtgaaaccccatctctactaaaaatacaaaaattagccaggcgtggtggcgtgcacctataatcccacctacccaggaggctgaggcaagaaaatcactggaacccaggaggcagaggctgyagtgagctgagatcacggcactgcactccagcctgggccctgggcaacacagcaagactccgtctcaaaaaaacaaaacaaaacaacaataaataaaaacaaacaaacaaacaaacaaacaatgttatggttgtgttggcaactttctttccagctctgcagttccatgaattcgtgaagtgaagacctcatttctactctaacatcagtgctgaagtccactttcataatctccttttcaaagtgacctgtctcagcactcgtgaccttgaactcctgaataaagggatgtcaagcatt

SEQ ID NO: 113789 - DNA, 601 bp, Human
ctagcccatgatgattcaccgcagagacaatgagatacagaagtgagagcaggaagggggaactgatttgaagataataataataaagctacagttagcagggcatggtggcttatgcctgtaatcccagcactttgggaggttgaggcaagaatatcacttgaggccaggaatttgagaccagcctgggcaacatagcaagatctctgtttctccatacacacaaaaaattaaaattagccatacatggtggtgcgcacctgtagtcccagctacccgggaggctgaggtgggagaatcrcttgaggccagaagttcaaggctgcagtgagctatgatcctgccatggcactctagcctgggcaaaagagtgagaccttatttctaataataacaataataatagctacaatgtgtgagccaggtattgttcaaagcatgttagatgttaacacatttaaccctcaaaaccaccctacgagttaacagctattattattcccatttgacagaagcagctaaggcacaaaaacattaagtcatttgtccaaagtcctccaggagtaacatgatgcctgatgcctggggtggtgcatgaaac

SEQ ID NO: 113790 - DNA, 601 bp, Human
accttcctctgcagcctgctggtatgcgaggaggaggagcacatactggagaaaatgcaaaatcaaaatcattgggaaggtgctaatagggaaaatagggactcttcttttttttttcaagttgccaaacaggcttaagtactggcagtgaaccccatggctccagagtttctgaaggatgcccaggcgttggacagccctgcatggcacgctcttcctcagcaatgaagaaagattcccacccttccttagaaatgcaactttgcctgatatgagctgccatctggagcaggcggggccraccagggggtaccctgagactcctcctttatttgaacaatttgccccaagggacagagccaggatgggtggcccattgccagccagagagacctgcccaagattccagaggggcttgtgaccctgaaatttggggtctgtgcccctggagtttgtccagcctctggagcaaggcttcccttacatggagaaggtagccttgaaccatccattgggaactaggcctggaaggccccgtccacaccctctagcccatgatgattcaccgcagagacaatgagatacagaagtgagagcagga

SEQ ID NO: 113791 - DNA, 601 bp, Human
ccgcagagcatgccacatttccccactgcgcaaggaatgggctgcatttagaattgacacttcagaacatattgtggactggggagccgagactagagtggaattacacacattttggaaaatgtggatgagcggcactgccagaatgggcccatttactaaactacctccagtgtttccaaacattagggaaaccttcctctgcagcctgctggtatgcgaggaggaggagcacatactggagaaaatgcaaaatcaaaatcattgggaaggtgctaatagggaaaatagggactcttcttttttttttcaagttgccaaacaggcttaagtactggcagtgaaccccatggctccagagtttctgaaggatgcccaggcgttggacagccctgcatggcacgctcttcctcagcaatgaagaaagattcccacccttccttagaaatgcaactttgcctgatatgagctgccatctggagcaggcggggccgaccagggggtaccctgagactcctcctttatttgaacaatttgccccaagggacagagccaggatgggtggcccattgccagccagagagacctgcccaagattcca

SEQ ID NO: 113792 - DNA, 601 bp, Human
gaccccctgggcagggaagtaggagacgaggtctcttctcatctccgctcaactcagaatccccaagcctagcacagaagcaccactcaatacatgtttcctgagcagaacatgatgcagttttgtgccccatgtcaaccaggtaggagctcccaccagtcatgctgaaaacaacagacatgagtttaagcacaatgctggccacacaacagaggctccataaacgttagctggattggaatccagtcaactcagatttctaaatgaatcagatgttcggggctagttgactaaattgtcmatgtccccacgtgctattatagcccctgtagaaacagcctggggaccactgtcctcttctgggcagggaagtttcaggtgcttcccatcccagggccagggccgtgctgcagaaaaaagcctccacaccccaacctgccctgcccatcctttccccacaatctccattagtcctaaattgccagtccaagcccaagagagcaattgtttcctcagtcccaaggcagcgaagcagacagctcttcaatagttcacatctttctgctgagggtgggaagatattggggtgtcttgtgggtgc

SEQ ID NO: 113793 - DNA, 601 bp, Human
tctctttttggataagaaatagaaccagaattcctaaagaacaaaatgccttgagattaagcaaatgcttctgctgaatagttctgggaccacccaggaccccctgggcagggaagtaggagacgaggtctcttctcatctccgctcaactcagaatccccaagcctagcacagaagcaccactcaatacatgtttcctgagcagaacatgatgcagttttgtgccccatgtcaaccaggtaggagctcccaccagtcatgctgaaaacaacagacatgagtttaagcacaatgctggccrcacaacagaggctccataaacgttagctggattggaatccagtcaactcagatttctaaatgaatcagatgttcggggctagttgactaaattgtcaatgtccccacgtgctattatagcccctgtagaaacagcctggggaccactgtcctcttctgggcagggaagtttcaggtgcttcccatcccagggccagggccgtgctgcagaaaaaagcctccacaccccaacctgccctgcccatcctttccccacaatctccattagtcctaaattgccagtccaagcccaagagagcaa

SEQ ID NO: 113794 - DNA, 601 bp, Human
agaatgttttatgtacaataacaaatttcagcttcagtatctgtgtctctttttggataagaaatagaaccagaattcctaaagaacaaaatgccttgagattaagcaaatgcttctgctgaatagttctgggaccacccaggaccccctgggcagggaagtaggagacgaggtctcttctcatctccgctcaactcagaatccccaagcctagcacagaagcaccactcaatacatgtttcctgagcagaacatgatgcagttttgtgccccatgtcaaccaggtaggagctcccaccastcatgctgaaaacaacagacatgagtttaagcacaatgctggccacacaacagaggctccataaacgttagctggattggaatccagtcaactcagatttctaaatgaatcagatgttcggggctagttgactaaattgtcaatgtccccacgtgctattatagcccctgtagaaacagcctggggaccactgtcctcttctgggcagggaagtttcaggtgcttcccatcccagggccagggccgtgctgcagaaaaaagcctccacaccccaacctgccctgcccatcctttccccac

SEQ ID NO: 113795 - DNA, 601 bp, Human
ccagctccccagaaacccagtcccggtgctggagaaggatggggagtggacccaagtggcaagcctgcgggggacaggattattttcccaatagtgagaaataaacaggcatccaaacgccactgtttcccatcaaataaccagatgaagcgaacagaatgttttatgtacaataacaaatttcagcttcagtatctgtgtctctttttggataagaaatagaaccagaattcctaaagaacaaaatgccttgagattaagcaaatgcttctgctgaatagttctgggaccacccaggacyccctgggcagggaagtaggagacgaggtctcttctcatctccgctcaactcagaatccccaagcctagcacagaagcaccactcaatacatgtttcctgagcagaacatgatgcagttttgtgccccatgtcaaccaggtaggagctcccaccagtcatgctgaaaacaacagacatgagtttaagcacaatgctggccacacaacagaggctccataaacgttagctggattggaatccagtcaactcagatttctaaatgaatcagatgttcggggctagttgactaaattgtcaatg

SEQ ID NO: 113796 - DNA, 601 bp, Human
ttgatatatccggcatctcccccttcttcctactttcaaatcacatgttctggaacccccgctccctcctgcatgcactgcagagcccacagccgagaatctacaacaggaagatccaaggaaagtctaagttccccacggccacggtgcccagctccccagaaacccagtcccggtgctggagaaggatggggagtggacccaagtggcaagcctgcgggggacaggattattttcccaatagtgagaaataaacaggcatccaaacgccactgtttcccatcaaataaccagatgaagygaacagaatgttttatgtacaataacaaatttcagcttcagtatctgtgtctctttttggataagaaatagaaccagaattcctaaagaacaaaatgccttgagattaagcaaatgcttctgctgaatagttctgggaccacccaggaccccctgggcagggaagtaggagacgaggtctcttctcatctccgctcaactcagaatccccaagcctagcacagaagcaccactcaatacatgtttcctgagcagaacatgatgcagttttgtgccccatgtcaaccaggtaggagctccc

SEQ ID NO: 113797 - DNA, 601 bp, Human
ttttgatatatccggcatctcccccttcttcctactttcaaatcacatgttctggaacccccgctccctcctgcatgcactgcagagcccacagccgagaatctacaacaggaagatccaaggaaagtctaagttccccacggccacggtgcccagctccccagaaacccagtcccggtgctggagaaggatggggagtggacccaagtggcaagcctgcgggggacaggattattttcccaatagtgagaaataaacaggcatccaaacgccactgtttcccatcaaataaccagatgamgcgaacagaatgttttatgtacaataacaaatttcagcttcagtatctgtgtctctttttggataagaaatagaaccagaattcctaaagaacaaaatgccttgagattaagcaaatgcttctgctgaatagttctgggaccacccaggaccccctgggcagggaagtaggagacgaggtctcttctcatctccgctcaactcagaatccccaagcctagcacagaagcaccactcaatacatgtttcctgagcagaacatgatgcagttttgtgccccatgtcaaccaggtaggagctc

SEQ ID NO: 113798 - DNA, 601 bp, Human
gagaggaatggagtcttggttgtttttctatttaactttgtgtagggagtgcccagtggtcaattaaggtgtcctgggcacccggcctggctggagtaagggatggcaagtgcgggggtctatttagggaggtgatcagagcccggatcaggccccacagagttggcaccaatctccatcatgttctttttaagagggttggcagccctggagtctatttttaaacccatgagaaaggtgctgtgtggattccaaaaagggccaacattaaacccgagatccctggaggagggagggaagkggggaggcacagctgaacctaggattttctcttcacacacacaggggttccccttattcctgggatcagatattgactgtccttccaaagggatctcttgggttacaggcccactctttggcatggctttggtggaattcgactcctaacgagctcgtgagttggaaagggttttgcacaccgggtctatttttcagaattgagatttttttaaatccctctacccccagtgtgaaaactccatgtgcttttgatatatccggcatctcccccttcttcctactttcaaatcacatgttc

SEQ ID NO: 113799 - DNA, 601 bp, Human
cccgttgggctctcctcctgaccctccttccatctgttccatcctcacccacccaaggagccgcccctgctcctagagactctgggcaccactgataagggtgggtaccaggaactccaccctttaccgagaaaggcaggctggtttatcgccactcagacccagccagcgaccaccctggggagtgtgtcagccaccaggagcatcgctgttggggaaatgttattaactaggaaggaactttacagaatgttccacacaaatgtcacattgaattcaatcagaaatccagcctgacccmccctaaacctggtcattccttcttaaccttaatggcagtgacagaagaaagggagagaggaatggagtcttggttgtttttctatttaactttgtgtagggagtgcccagtggtcaattaaggtgtcctgggcacccggcctggctggagtaagggatggcaagtgcgggggtctatttagggaggtgatcagagcccggatcaggccccacagagttggcaccaatctccatcatgttctttttaagagggttggcagccctggagtctatttttaaacccatgagaaaggtgctgtgt

SEQ ID NO: 113800 - DNA, 601 bp, Human
cttacaatgcacccttttcaatgcccatattctctgcagcaaagaaacaatgtgtggactcagttgtgcccccacgctccctgtccgcagctgcccttgcagtgtcctgctgctggctgtggccagctgacccgttgggctctcctcctgaccctccttccatctgttccatcctcacccacccaaggagccgcccctgctcctagagactctgggcaccactgataagggtgggtaccaggaactccaccctttaccgagaaaggcaggctggtttatcgccactcagacccagccagcraccaccctggggagtgtgtcagccaccaggagcatcgctgttggggaaatgttattaactaggaaggaactttacagaatgttccacacaaatgtcacattgaattcaatcagaaatccagcctgaccccccctaaacctggtcattccttcttaaccttaatggcagtgacagaagaaagggagagaggaatggagtcttggttgtttttctatttaactttgtgtagggagtgcccagtggtcaattaaggtgtcctgggcacccggcctggctggagtaagggatggcaagtgcggg

SEQ ID NO: 113801 - DNA, 601 bp, Human
caagaaatctcaaagctctaccctgcacccagacctcttgggcttacaatgcacccttttcaatgcccatattctctgcagcaaagaaacaatgtgtggactcagttgtgcccccacgctccctgtccgcagctgcccttgcagtgtcctgctgctggctgtggccagctgacccgttgggctctcctcctgaccctccttccatctgttccatcctcacccacccaaggagccgcccctgctcctagagactctgggcaccactgataagggtgggtaccaggaactccaccctttaccragaaaggcaggctggtttatcgccactcagacccagccagcgaccaccctggggagtgtgtcagccaccaggagcatcgctgttggggaaatgttattaactaggaaggaactttacagaatgttccacacaaatgtcacattgaattcaatcagaaatccagcctgaccccccctaaacctggtcattccttcttaaccttaatggcagtgacagaagaaagggagagaggaatggagtcttggttgtttttctatttaactttgtgtagggagtgcccagtggtcaattaaggtgtcc

SEQ ID NO: 113802 - DNA, 601 bp, Human
aaatggtggccagtcagagacatgaagtggctcctctctacagggacatcagagctgagatcagggcagccccaggattcgagagaagggcatcctggcagctcaggccctgtggcaatgaccgtcgcgcttaaccctcttatgcaatcaactcaaacccagaactcaatagcaacaacactatttgctttctggacagcctcttaagaggctctaaatcagtaggtctcccacaattgagctgtgcagcttttgataaaggaaatgacttttctgagcattgatttcttcatcagtaaartgaaaatagcttcacccatctctccaatattgggagaataatgtaaaatgctgaccaccacttctggcacatttggtaagtgctctatcaatgacagctgatgctcttttttcctcctcccctccatttcttctcgactaaagcttttgtcaaaggttaatgtctcccccagaggtgtgggttgtcactgatcttgcttcaacactggaaaatcaaggcctcatcactgcttacccagggtcaaacacccatggtcaagatcaggatcccaagaaatctcaaagctctaccctgcaccca

SEQ ID NO: 113803 - DNA, 601 bp, Human
ggactctgggacacttgatgggctgctgctgctgtcaattcctgcagggatttcacgagctggaagaacacaagcctgcagcaaagaatcccatgcgagtgggattctcaggcgactctgcctccccaggatgatttgggagaacaggtccgggctgcttcaaatggtggccagtcagagacatgaagtggctcctctctacagggacatcagagctgagatcagggcagccccaggattcgagagaagggcatcctggcagctcaggccctgtggcaatgaccgtcgcgcttaaccctcytatgcaatcaactcaaacccagaactcaatagcaacaacactatttgctttctggacagcctcttaagaggctctaaatcagtaggtctcccacaattgagctgtgcagcttttgataaaggaaatgacttttctgagcattgatttcttcatcagtaaagtgaaaatagcttcacccatctctccaatattgggagaataatgtaaaatgctgaccaccacttctggcacatttggtaagtgctctatcaatgacagctgatgctcttttttcctcctcccctccatttcttctcgact

SEQ ID NO: 113804 - DNA, 601 bp, Human
agatcaaaacaaaccaccagaaaggaattgatgggctgaagaaaaggctaaagactctcggcagacacaggccactgttctagcctgtagcttcatggagtcttcaggcttttcccgtcttgctaaatattttacctactgtctccttgcaggtctctctgcagacaagcataatgaaaagctggaggcctcgcctgtggggttctgtcctctgggccacatgcagctatgccaagcagggatgatgtgggagagaagaaagggaagaaatagactatgcagcacttaaacccccagctcrctcctggcttgatgcagtgggctgttctcagtatagacagggactctgggacacttgatgggctgctgctgctgtcaattcctgcagggatttcacgagctggaagaacacaagcctgcagcaaagaatcccatgcgagtgggattctcaggcgactctgcctccccaggatgatttgggagaacaggtccgggctgcttcaaatggtggccagtcagagacatgaagtggctcctctctacagggacatcagagctgagatcagggcagccccaggattcgagagaagggcatcctggc

SEQ ID NO: 113805 - DNA, 601 bp, Human
agagatacgtgacttaatagaactctttattcagaaagggtttaatctttgcaggagatccttcaggatggcagaaaaaaaaaacctcaacatttgatctggcatatagaccactgggtaagctgtacgacttggaagggtctctttgggccctagggattcagaaagctaaactattgttcttttccccataactgactgtcccctcaaccttccatcacaaccacacccttagaccacaaataatcatcctgcttctccatctgcattttgttcatacttcaaggctgcacgttttaaygtaggcatttagtgtgctaagaacttgctagtgagatcaaaacaaaccaccagaaaggaattgatgggctgaagaaaaggctaaagactctcggcagacacaggccactgttctagcctgtagcttcatggagtcttcaggcttttcccgtcttgctaaatattttacctactgtctccttgcaggtctctctgcagacaagcataatgaaaagctggaggcctcgcctgtggggttctgtcctctgggccacatgcagctatgccaagcagggatgatgtgggagagaagaaagggaag

SEQ ID NO: 113806 - DNA, 601 bp, Human
tgaaacataaattccagcactgcagcctggaatgccacattggagctaattatatggtgcccagtcccaggtgtggtggcctgccaccaggactgaattctaaatgtctcccaggcagagacagcttggttctcatgttccaaattcccagtccctctcccttgctttccccacctactcctctatgtgactggcacagtgccgggcagtgctaaacacagtgattactgactggtgttagaagaatgatgtccccaacacttccatgagtcataaagaaactgtaagtcttggggttcarttgctatggaaaagatttagattccacagaaagaactttccagctataagagatacgtgacttaatagaactctttattcagaaagggtttaatctttgcaggagatccttcaggatggcagaaaaaaaaaacctcaacatttgatctggcatatagaccactgggtaagctgtacgacttggaagggtctctttgggccctagggattcagaaagctaaactattgttcttttccccataactgactgtcccctcaaccttccatcacaaccacacccttagaccacaaataatcatcc

SEQ ID NO: 113807 - DNA, 601 bp, Human
tgggcataatcacctccaaaagtttcctcatgcctcttggtattccctgcctcctgccggccagtccacatccttgtcaagacttggtatgatctgtcttaattcagacatcctaatagatgcaccacatggctaattaaaaaaaattttttgtagagaaggggtctgttgcatttccccaataactgataatattaaacacctttttcaggtgcttatctgccatctatatatcttcttttttttttttttctttttttttttttttttttgaggaagagtttagctcttgttgcccagsctggagtgcaatggcatgatcttggctcactgcaacccccgcctcccaggttcaagcgattctcctgcctcagactcctgagtagctgggattacaggcatgcgccaacatgcccagctaattttgtatttttttagtagagatgggatttctccatgttggtcaggctggtcttgaactcctgacctcaggtgctctgcccgcctcggcctcccatgttgttgggattacgggcgtgagccactgcgcccagcttatatatcttctttggtgatacatctgttcaaatcttttgtccat

SEQ ID NO: 113808 - DNA, 601 bp, Human
atttgctaagttttggcatatgtatatccctgaaaccatggccacataagataatgggcataatcacctccaaaagtttcctcatgcctcttggtattccctgcctcctgccggccagtccacatccttgtcaagacttggtatgatctgtcttaattcagacatcctaatagatgcaccacatggctaattaaaaaaaattttttgtagagaaggggtctgttgcatttccccaataactgataatattaaacacctttttcaggtgcttatctgccatctatatatcttcttttttttctttttctttttttttttttttttttgaggaagagtttagctcttgttgcccaggctggagtgcaatggcatgatcttggctcactgcaacccccgcctcccaggttcaagcgattctcctgcctcagactcctgagtagctgggattacaggcatgcgccaacatgcccagctaattttgtatttttttagtagagatgggatttctccatgttggtcaggctggtcttgaactcctgacctcaggtgctctgcccgcctcggcctcccatgttgttgggattacgggcgtgagccactg

SEQ ID NO: 113809 - DNA, 601 bp, Human
aatgtacaatttgctaagttttggcatatgtatatccctgaaaccatggccacataagataatgggcataatcacctccaaaagtttcctcatgcctcttggtattccctgcctcctgccggccagtccacatccttgtcaagacttggtatgatctgtcttaattcagacatcctaatagatgcaccacatggctaattaaaaaaaattttttgtagagaaggggtctgttgcatttccccaataactgataatattaaacacctttttcaggtgcttatctgccatctatatatcttcttttttttttttttctttttttttttttttttttgaggaagagtttagctcttgttgcccaggctggagtgcaatggcatgatcttggctcactgcaacccccgcctcccaggttcaagcgattctcctgcctcagactcctgagtagctgggattacaggcatgcgccaacatgcccagctaattttgtatttttttagtagagatgggatttctccatgttggtcaggctggtcttgaactcctgacctcaggtgctctgcccgcctcggcctcccatgttgttgggattacgggcgtg

SEQ ID NO: 113810 - DNA, 601 bp, Human
tcaagtcacagtcaagacacaataccaaatgctcttttcctctcccgctgtcccctgacattgtacagtacagctgcgcgttggtgaggaactagcacgctgagcgcctattagctgatggacatactgcattatctcatttaatcctcacagccacccataaggtaggcaacactactacagttggataaatgaagaaactgagcccagggaggtaatgggtggagaccaaggtcaccactagtaaatggtgggtccaactggttctaagccaaattgatccaaagccctgccactggcmgcaccagcaagattcctaacaatagtgtactcagcgccaggaagagataatgtgggggatgatcttgaaggatcataatcccagcattttgggaggctgaggcggggggattgcttgaggccaggagttcaagaccagcttgggcaacatagtgagaccccctgtctccacaaaaaaaaaaaaaaaattaattagccaggcaaggtggcacatgcctgtagtcctggctactcaggaggctgtgacaggaggatcacctgagcccaggagttggaggctgcagtgagctatgattgcaac

SEQ ID NO: 113811 - DNA, 601 bp, Human
gaagggcagccccagcgcgcgcacccgcacccgccggggaaagttggcgccgggcagccgggcgcggagccacaacccgcaggacggacgcagagccccggccccggccccggccccgatccccgcgccccggccccggccgggcaaccgcgacagctcgtgcactcaccgcagggtctggcccggacctgccctgtcgcgctgccatcgtccggcgcccgcgctgaaatccgagcccggctcccgctccccctcccggttatctgctgggcggcgcggggagcgccagcaagttacgcgrcatctggctaaaaatacaggcgccctccactcgccccggcccggccctggccctgcgctctcccgcccgccagcctgccgctaatgggatctcttcattttctctccatgattatgtcagatgggaaagttaatgcgaagcgctctccggagagcaggcacctgctgccaagccctgcgaagggggtgcgcgcgggggcgcgggcgggggtgcagccccagctgcaggtgccggccggcgggctcggggcgggcgtcctgcccctgcggaggggaggcacacacgtccagtggaggtgag

SEQ ID NO: 113812 - DNA, 601 bp, Human
ccccagccagcatagcctggtagccctgcctttactcccttgacgatggagaaacagaggtgaacactgggccctagtgagtgtgtgttttattatgtttctttccttttgccttccagaaaggtgtgctgttacagctttacaaactgtctccaggctccccagtctgactaccattggcaaaaataaaatgaataagttaaaggtgtcactgaggaaacaagacgcctgagcggaagtgctgggctccctcttaatctctcaacccgaactcgggacattgggaaaacccctggggttycctgtgctgtctgcacccgaccctggaggctgggcagggtgggctgggacgtcactggggaagacctggctgagatgcactgctcgaccacttgatgctgtgctcatctaaggccccaaacctccatttccccattgctaaaatggggatcttgccagggggctgcgagaatcgaaggggacagcggcagagagctccaggcttgccagggcgcccaacaggtctgccttcctctgccccattcatttcctgctacctgggggcctccgggcgcctcacgtttctgagttttaggggcca

SEQ ID NO: 113813 - DNA, 601 bp, Human
atatagcaatagatggggtgcgagggggctccagtatcctgagagggaggggccggaagcacgctgcagaatgtcaacatgctgtcacccatgagcaggggacattgggaaacaccagcaggcagacccaggtgagagaaccccagggcctcctcacaccttctctgggggttggggtggcctaagttttccctaggacaaatcatgactgacctcaagatttttagtacaaaattcctatctagaaaggcgaatggaaactgagctaatatcaattgctgtaaacagtcataaggcaatrccactttcccaaggggtcttgttggagcaaaatgcagcttctttaacgcagccactgtcagagctctcaggaagagatttcaggtcctttcctgggggacctgcagcccagccagaagacaggcagcagccctgatgtggagctgtctgcttgtgcttgggggatctgagagccgcactggggtatgaggaaagacagctgtccccagccagcatagcctggtagccctgcctttactcccttgacgatggagaaacagaggtgaacactgggccctagtgagtgtgtgttttattatgt

SEQ ID NO: 113814 - DNA, 601 bp, Human
aatgtattaccagcattatatcttttaattcttataacaacctgtgggtaggtataattattatccccattttagaggtgatgaaactgaggttttgagaggttaataacttgcccaagttctgcagataaatacttggggtgattcaatccaggggtaccccactgaagtctatgcctttccactgcccttgaccccaagggcgttcttggccatttcaagcctgagggtgttcaggcagccctgacaggctggcggctgggcaggcctatatgcctcggccgttaaagagctaatccayggcagaggaaaaatgctaggaggtcccactcaggctctgtccctgagcactctattcagaccaagacaggtctctagaagggaaccatctagttccagcccttcttgtcactgaggataaaattgaggcccagggaagtaaagtgaccggctaaggtcacctagatagttagcagtgaagtgcaattgctaaagctttttctttctttcttctttctttttttcttttttttttttttttttttttttttttttttggtcttctccaggcatagagtagtcaggactctgcaggatcctc

SEQ ID NO: 113815 - DNA, 601 bp, Human
aaagcactgaatccaggaagaaaagaagaatatttatgacaaactggcagggcgtggtggttcctgtaatctcagcactttgggaggccaaggcagatggatcacttgaggccaggaattagagaccagcctggtcaacatggtgaaaccacatctctattaaaaatagaaaaagtagccgggcatggtggtgcatgcctgtaatcccagttacttgggagggtgaggcagaagaatcacttggacctgggaggcagtttgcagtgagctgagattgcggcactgcactccagcctgggcracagagagagactctgtctcaaaaaaaaaaaaaaaatttatgacagacaagcacataaatagagggtaagggaagctccatatggactagattgaggaaagctaaaccatttctgttgttgccataatagaatactaaaattataataccaaccattgggacaaatgtattaccagcattatatcttttaattcttataacaacctgtgggtaggtataattattatccccattttagaggtgatgaaactgaggttttgagaggttaataacttgcccaagttctgcagataaatactt

SEQ ID NO: 113816 - DNA, 601 bp, Human
agacagaaaaggagaagacacacatgcacacacacacacacacacatgcatgcacatatatgtgtatgcacacatgcacacacagatgcatgcgcacacacacagattcacacacacacacagatgtgtgcacacaaatctacacatacacacccatacacagacgtgtgtgcacacacatgcacaccaagagatgcatatacacacacgcacacacatgcacagatacacacacatgcacacatacacatgcacatacagagacctgtgtgcacacacacacacacatgttcacacacaygtatacacacacacagaggtgaaactatgtgaagacagagccagagactggagtgactttagccatgcacaaggaagcaaggaacctctgggaggtggaggctcatagaagaaggccctgaagccctggagggagtgtgtccctgtggaggccttaatttagatctccagcctccagacagcgagagaacacatttccgtagtgtcaagccactaagtgtgtggcgatttgttacagcaaccatgggaaactcatgcacacactagtgatgaccacccttgaacacccttgaacacagaa

SEQ ID NO: 113817 - DNA, 601 bp, Human
taaattcaatgacaagtgtccttagaaaagacagaaaaggagaagacacacatgcacacacacacacacacacatgcatgcacatatatgtgtatgcacacatgcacacacagatgcatgcgcacacacacagattcacacacacacacagatgtgtgcacacaaatctacacatacacacccatacacagacgtgtgtgcacacacatgcacaccaagagatgcatatacacacacgcacacacatgcacagatacacacacatgcacacatacacatgcacatacagagacctgtgtgcacacacacacacacatgttcacacacatgtatacacacacacagaggtgaaactatgtgaagacagagccagagactggagtgactttagccatgcacaaggaagcaaggaacctctgggaggtggaggctcatagaagaaggccctgaagccctggagggagtgtgtccctgtggaggccttaatttagatctccagcctccagacagcgagagaacacatttccgtagtgtcaagccactaagtgtgtggcgatttgttacagcaaccatgggaaactcatgcacacactagtgatga

SEQ ID NO: 113818 - DNA, 601 bp, Human
ttgagacgagatcatcctagattacctaggctggccctaaattcaatgacaagtgtccttagaaaagacagaaaaggagaagacacacatgcacacacacacacacacacatgcatgcacatatatgtgtatgcacacatgcacacacagatgcatgcgcacacacacagattcacacacacacacagatgtgtgcacacaaatctacacatacacacccatacacagacgtgtgtgcacacacatgcacaccaagagatgcatatacacacacgcacacacatgcacagatacacacacmtgcacacatacacatgcacatacagagacctgtgtgcacacacacacacacatgttcacacacatgtatacacacacacagaggtgaaactatgtgaagacagagccagagactggagtgactttagccatgcacaaggaagcaaggaacctctgggaggtggaggctcatagaagaaggccctgaagccctggagggagtgtgtccctgtggaggccttaatttagatctccagcctccagacagcgagagaacacatttccgtagtgtcaagccactaagtgtgtggcgatttgttac

SEQ ID NO: 113819 - DNA, 601 bp, Human
aaaaagtctttgtagatgtaattaagtcatggatcttgagacgagatcatcctagattacctaggctggccctaaattcaatgacaagtgtccttagaaaagacagaaaaggagaagacacacatgcacacacacacacacacacatgcatgcacatatatgtgtatgcacacatgcacacacagatgcatgcgcacacacacagattcacacacacacacagatgtgtgcacacaaatctacacatacacacccatacacagacgtgtgtgcacacacatgcacaccaagagatgcatayacacacacgcacacacatgcacagatacacacacatgcacacatacacatgcacatacagagacctgtgtgcacacacacacacacatgttcacacacatgtatacacacacacagaggtgaaactatgtgaagacagagccagagactggagtgactttagccatgcacaaggaagcaaggaacctctgggaggtggaggctcatagaagaaggccctgaagccctggagggagtgtgtccctgtggaggccttaatttagatctccagcctccagacagcgagagaacacatttccgt

SEQ ID NO: 113820 - DNA, 601 bp, Human
aagacatgcctttgctcttccttcatcttctgccatgattgtaaggcctccccagccacgttggactgtgagtccattaaacctctttcctttataaattacccagtctcgggtacatctttattagcagtgtgagaacagactaatacactcacaaagacaaatgtaatgattaaagcccagtcctcaggcattggagtccgtggcctagactcagagccactccactgggtctagctgagtgccctcaggtacttagacaccgttggcttctatttccttatttgtaagctggggagartaaagcctttcttgtccccttttcatgatgcttaaaagaaataaacagtgtttggcacatagttgcatacaaggctgagttgaaagggtgagagtggtcatatgacaagccacacatgggagaagcgtgtgacgccattcccacagaagacccacagtggcttcctctccacccaggcactttgtctccttcctctacatgccctcctaaaaaaaacatgctgcagtgggctgaatggtgccccccaaaagatatgtccacactcttatccctggaacctgtgaaggtgaccttatttga

SEQ ID NO: 113821 - DNA, 601 bp, Human
ccccccaacagatttcttaaatgagagtgaagctcttctgttccttagctgctgctacgtcacccaccccatgcatctcagaccttgcccccaggaacatctgtttcctttaaagatgagtgacagccagagagggtgagagctgaggacaataaaataaagtttactaattgatatggtttggctgtgtcaccacccaaatctcatcttgaattgtagctcccataattcccacgtgccctgggagggatctggtgggaggtacttgaatcatgggggctggtttttcccatgctgttcycatgaaagtgaataagtctcatgagatctgatagttttaaaaagaagagacccccctgcacatactctcttgcctgctgccatgtaagacatgcctttgctcttccttcatcttctgccatgattgtaaggcctccccagccacgttggactgtgagtccattaaacctctttcctttataaattacccagtctcgggtacatctttattagcagtgtgagaacagactaatacactcacaaagacaaatgtaatgattaaagcccagtcctcaggcattggagtccgtggcctagactc

SEQ ID NO: 113822 - DNA, 601 bp, Human
agtcaagcccatttattcaaccaactgtggatggaaaatttgcaggaaaaaaattaaaaataacaatactaaaataaaaagtaatactaacagaaggctgggcgtggtggctcaaacctgtaatcccagcactttgggaggccaaagcaggtggatcacgaggtcaagagacagagacaatcctggccaccatggtgaaaccccatctctactaaaaatacaaaaattagctgggcttggtgacgtgcacctgtagtcccagctactcaggaggctgaggcaggagaatcgcttgaacccrggaggtggaggttgcagtgagccgagatcgcaccactccactccagcctggtgacaaagcaagactccgtctcaaaaacaaacaaacaaacaaacaaacaaacaaaaaaacccagtaatacagaaaagcaatgctgtacaacaattatttacaaagcacttacattaggtattataagtaatctagagatgatttaaagtatatatgacgatgtgggtaggttatatgcaaacactatatcactttacatgaggaacttgaggatctgtggattttggtatctacagggggttctggaac

SEQ ID NO: 113823 - DNA, 601 bp, Human
tgtgctgtcaagtaaacagcacatagcacttactatgtgctaagagccattattagcactttacatatacagtcaagcccatttattcaaccaactgtggatggaaaatttgcaggaaaaaaattaaaaataacaatactaaaataaaaagtaatactaacagaaggctgggcgtggtggctcaaacctgtaatcccagcactttgggaggccaaagcaggtggatcacgaggtcaagagacagagacaatcctggccaccatggtgaaaccccatctctactaaaaatacaaaaattagmtgggcttggtgacgtgcacctgtagtcccagctactcaggaggctgaggcaggagaatcgcttgaacccgggaggtggaggttgcagtgagccgagatcgcaccactccactccagcctggtgacaaagcaagactccgtctcaaaaacaaacaaacaaacaaacaaacaaacaaaaaaacccagtaatacagaaaagcaatgctgtacaacaattatttacaaagcacttacattaggtattataagtaatctagagatgatttaaagtatatatgacgatgtgggtaggttatatgca

SEQ ID NO: 113824 - DNA, 601 bp, Human
aagcaaacgttcttggcttggactcaggaagaatcagcctttgagggggagcccattcctatggcaagcgcacagcacagcctggtgtctccctgctctgaggtttcaggggctccacagtcttgctgaagagtttgcaatatcacagaggtccctggccccaagaatcatgaatgcaggcaccaaaggaaccaagcgtgggctctttggagctgttttgtgtttttgtttctatttgtctgtttttcctttttagagatggggtctcactatgttccccaggatggtctcgaactcctgrgctcaagcaatcctcctgccccggcctctgaaagtgctgggattacaggcataagccaccatacccagccctgtgtttttgttaagtaaacaaacagctatgtgctgtcaagtaaacagcacatagcacttactatgtgctaagagccattattagcactttacatatacagtcaagcccatttattcaaccaactgtggatggaaaatttgcaggaaaaaaattaaaaataacaatactaaaataaaaagtaatactaacagaaggctgggcgtggtggctcaaacctgtaatcccagc

SEQ ID NO: 113825 - DNA, 601 bp, Human
ggcaaatatctacaaacaaacaaaacctgtcaccaatccacaagcccaagccacacacctgttcccttcctggagggtcattgcctctctatttagttagttcctggatctttggctccaagcccgagtctctgccctccaacccaacccaaacacattttgtttcctcgccagccccttctgaagctaaggcttggctgtgtcactcaggagccctggagagccagcctctgcaccagccccaccatcctcaacccgagcccactcgcctttgtcagcacctaacacaagcggggcctcrttcctcgactttcttctcaggctagccgagaacccacacagactgctggtggacaaaggagactgaacatccccactgacacagcatctttcaaaggctcttcctcctgccccaattcaaaggccacatattctaagacaacagcgggaatcaattgcaacttctaagcgaggagaccgcaggggatctgtgcgggcctcgcccacactgttcaggcatcagcccttctctgtggggccctgggccacggcaggagtggaaacagcaaggttagggccttccacaggcagaagccctggg

SEQ ID NO: 113826 - DNA, 601 bp, Human
acatacctcactttccctctgaagtgcactgccagggtctttgcttcttatcacacacctacttctgtttcccatcacataccatactgctccattctttctgatcttttagctgtgaatttctgccactgcaagaccaactgaatccaaatggggtcttagccctaggaatggaggcaggtagtattttgcattttatttatttatttatttattttatttatttatttaagacagagtttcactctgttgcccaggctggagtgtagtggcacgacgatctcggctcactgcaacctcygcctcctgggttctagcgattcttctgcctcagcttcccaaatagctgggactataggcacgcaccaccatgcccggctaattttagtatttttagtagagacagggcttcaccatattggccaggctagtctcgaacttctgacctcgtgatctgcctgcctcggcctcctaaagtgctgggattacaggtgtgagccaccgcgcccggtctattttattttatttctgagatggagtctcgctctgtcacccaggctggagtgcaatggcatgatctcggctcactgcaacctccgcc

SEQ ID NO: 113827 - DNA, 601 bp, Human
ctgtcttctgaacaactctcacaccaagactctcaccctgcctccaggctttgctgcatccacctcttggcatcaaaaaatgggctgagtttcaacctgctatgcaaaggccagcctggcagatgctttgttagaaccaccacaatgtcctctgggctgtggatatgtggatgttggcatttctgggtggagggatgagaaaaggggcggggggcctggtccttcatccagtttgcaaattccagtcaggtccacatacctcactttccctctgaagtgcactgccagggtctttgcttcytatcacacacctacttctgtttcccatcacataccatactgctccattctttctgatcttttagctgtgaatttctgccactgcaagaccaactgaatccaaatggggtcttagccctaggaatggaggcaggtagtattttgcattttatttatttatttatttattttatttatttatttaagacagagtttcactctgttgcccaggctggagtgtagtggcacgacgatctcggctcactgcaacctctgcctcctgggttctagcgattcttctgcctcagcttcccaaatagct

SEQ ID NO: 113828 - DNA, 601 bp, Human
agagtgacaaggcagttacacccaaggcctctccaacgggagaccaatcaggacacagctattccctggtggcatcaaaatcttccaatttcacacagaaaatgagccctggctcaagtctaacacacgttcagttgtccccatttcagctgaatggattcctttgagagctagaatcttaacccttggaaggcctctgaaggtgtgattcacctccgctgagaactgcactgcggagaaacacatctgcaattctccagccacagtaagaacaaagaaagcctccaggtgtgcatctctrcaagcccaagaatgcatcccaggtggagagagcgagcaacccaccctgcctatggggggctggggcaacacagctgcagcctgtgcagctgcttctggaggtgcagtgctaagaaggtcccagaccctgtcttctgaacaactctcacaccaagactctcaccctgcctccaggctttgctgcatccacctcttggcatcaaaaaatgggctgagtttcaacctgctatgcaaaggccagcctggcagatgctttgttagaaccaccacaatgtcctctgggctgtggatatgtggatgt

SEQ ID NO: 113829 - DNA, 601 bp, Human
tcccttctgacgctcatttcataacttgtggcagtgtcctctttaagagagaggccaggcttagccaggactgcagtcttgagtctgaggcaggagcctcccctcagcctgaagcagggctgacagccacttgtcactggcgctgagccaatcggaaatggtgtcaataaagtgcaaataatacctcggtgcttgctgctctctgagcccaaaacgaaccgaagaggtgctctgaggagagaaggcagagtgacaaggcagttacacccaaggcctctccaacgggagaccaatcaggacrcagctattccctggtggcatcaaaatcttccaatttcacacagaaaatgagccctggctcaagtctaacacacgttcagttgtccccatttcagctgaatggattcctttgagagctagaatcttaacccttggaaggcctctgaaggtgtgattcacctccgctgagaactgcactgcggagaaacacatctgcaattctccagccacagtaagaacaaagaaagcctccaggtgtgcatctctacaagcccaagaatgcatcccaggtggagagagcgagcaacccaccctgcctatg

SEQ ID NO: 113830 - DNA, 601 bp, Human
cattcgtgggtttcatgcaggcatgggttcagccactgcagtccctcccccaccaccaggactctccctgcaacagcaaaaccaaactgccctgtgcaaccagaatgaggttcagggaaccctgaccagctcctttccaggcgcagccacctgcagctacctgttctgctcagccacagaccataaaacagggaccaacagggccacatctggcagctgtgggaattaaccagcagcaaggggctttgcacttggtgtgtcctgtctttcgttcccttctgacgctcatttcataacttgyggcagtgtcctctttaagagagaggccaggcttagccaggactgcagtcttgagtctgaggcaggagcctcccctcagcctgaagcagggctgacagccacttgtcactggcgctgagccaatcggaaatggtgtcaataaagtgcaaataatacctcggtgcttgctgctctctgagcccaaaacgaaccgaagaggtgctctgaggagagaaggcagagtgacaaggcagttacacccaaggcctctccaacgggagaccaatcaggacacagctattccctggtggcatcaaaatct

SEQ ID NO: 113831 - DNA, 601 bp, Human
tctagtagcattaagaggctggccctgtgcacattacgcagatgcaggatcgtcccgctgggtgcattcgtgggtttcatgcaggcatgggttcagccactgcagtccctcccccaccaccaggactctccctgcaacagcaaaaccaaactgccctgtgcaaccagaatgaggttcagggaaccctgaccagctcctttccaggcgcagccacctgcagctacctgttctgctcagccacagaccataaaacagggaccaacagggccacatctggcagctgtgggaattaaccagcagyaaggggctttgcacttggtgtgtcctgtctttcgttcccttctgacgctcatttcataacttgtggcagtgtcctctttaagagagaggccaggcttagccaggactgcagtcttgagtctgaggcaggagcctcccctcagcctgaagcagggctgacagccacttgtcactggcgctgagccaatcggaaatggtgtcaataaagtgcaaataatacctcggtgcttgctgctctctgagcccaaaacgaaccgaagaggtgctctgaggagagaaggcagagtgacaaggcagttac

SEQ ID NO: 113832 - DNA, 601 bp, Human
gttcctctttccacgctacttagagtaattacttcctattatggcaaacagtacgcattctttccacaaaaacatactatttgaaagtgtgttacttatgtaaggataagtatttgccctgttactgccaccacagtccatcagctcagaagattcaagccgaaagcaaattctcttgccatgaccccgggacaagagcttgcttttatgcgtgttttaaagagcagaaagctctagtagcattaagaggctggccctgtgcacattacgcagatgcaggatcgtcccgctgggtgcattygtgggtttcatgcaggcatgggttcagccactgcagtccctcccccaccaccaggactctccctgcaacagcaaaaccaaactgccctgtgcaaccagaatgaggttcagggaaccctgaccagctcctttccaggcgcagccacctgcagctacctgttctgctcagccacagaccataaaacagggaccaacagggccacatctggcagctgtgggaattaaccagcagcaaggggctttgcacttggtgtgtcctgtctttcgttcccttctgacgctcatttcataacttgtggca

SEQ ID NO: 113833 - DNA, 601 bp, Human
ctcccttgcttcaccttatttgcctctgctcctccctcacctcagctgtctcttcctcatggtagccttctctgacctctgactctagggcagtcctctcatatactctctgccttccattcatggttcctaacatagtttttggtatgcatatctgtttgtgtcattatttgattaatagctctcactgccaatagactacagttcagaacggataaggaacgtgactttaaaatgaaattattctatcccttcagcccagctctccatatacacgtggagatgcacaggaagtacattrgacacaggcatctaaagtgcaaacaataaattttaaaattggcattcacataagggggttcctgtatgcacacatgtgtgtgttcttacatataaatttcttcttttctgtagacatggtaatgataatgatgatagaacattagtagacacagtctatacaacaaggaactgccctgaatattcagacatctcttatataagccaagagttcctctttccacgctacttagagtaattacttcctattatggcaaacagtacgcattctttccacaaaaacatactatttgaaagtgtg

SEQ ID NO: 113834 - DNA, 601 bp, Human
actaattttttatttttagtagagatggagtttcaccatgttggtcaggctggtctcaaactcatgacctcaggtgatccacccgcctcggcctcccaaagtgctgggattacaggcatgagctactgcgcctggcctcatcttggacttcttcttcttttttttttttgagaaggagtttctcccttgttgcccaggctggagtgcaatggtgcgatctcagctcaccacatcctccacctcccaggttcaagtgattctcttgcctcagcctcctgagtagctgggattacaggcatgygccacaacgcttggctaattttgtattttcagtagagacagggtttctccatgttagtcaggctcgtctcgaactcctgacctcaggtgatctgcccgcctcggcttcccaaagtgctgggattacaggcgtgagccaccacgcccagcctcatcttggacttcttaagcccaactccccaaatccaaagtcatacagcataagatgatattcagaagtaacttttagacctcagtttcctgagctataaaatggaaattgaatgccgtgagctccactaagccctaagattctatagct

SEQ ID NO: 113835 - DNA, 601 bp, Human
ctcactgcaaccttcgcctcccgggttcaagtgattctcctgcctcagactaccaagtagctaggactgtaggcacccaccaccatgcccgactaattttttatttttagtagagatggagtttcaccatgttggtcaggctggtctcaaactcatgacctcaggtgatccacccgcctcggcctcccaaagtgctgggattacaggcatgagctactgcgcctggcctcatcttggacttcttcttcttttttttttttgagaaggagtttctcccttgttgcccaggctggagtgcaayggtgcgatctcagctcaccacatcctccacctcccaggttcaagtgattctcttgcctcagcctcctgagtagctgggattacaggcatgcgccacaacgcttggctaattttgtattttcagtagagacagggtttctccatgttagtcaggctcgtctcgaactcctgacctcaggtgatctgcccgcctcggcttcccaaagtgctgggattacaggcgtgagccaccacgcccagcctcatcttggacttcttaagcccaactccccaaatccaaagtcatacagcataagatgat

SEQ ID NO: 113836 - DNA, 601 bp, Human
ttcattaccttaagaaaaaggaatgcacaacgattttagagctctgcaaggaaatgaatcaacctcagctcaccttctttctattttgattgtacagaactcgcagcagccctgtgctctgagaaatcctgcatctcagcagcaaatcaactgcagaggctgatgggccctggggaaggtggaggaggaagtgtgagctcgagttaatgagagaatgggactctgaaatgcagttcagcatctaagaatatctcctatggactagaaagagcatctatgcccgagatcttggtattctttaaaaaaaaaaaaaaaagacccagacctttagaagaagggcagtggggtcaggagaaaggaaccctgggcttctaaactgtccttatctatgacctcccaggcttcaatttatgctgctttgcaatgacaaaactgctctgagcttccagtttcgtctgaattccataattccaagaataagacaacgtaacagcttgcagaaaagagttaagctatgtgttttgcatgtacagaaaaagtaatatgccaagattcatataaactgttaacagtggtttcgcagaacgtaagggagttaaaa

SEQ ID NO: 113837 - DNA, 601 bp, Human
tcagcccacagggaaacccgctgatgggggagacctcttctggagggcaggcctctcgttctgcggggccataccacctgcagcctctttctaacccggatagtttatggctccccagagactgcttggtgggaaaggtctgctaaaaatatatgatcttggaatctaaggaatcagaagccaggcagagctgaagcaactgccgtaaccctagtggaaaatcacacctgatctcctttgcaaatctgtctcttgcctagggacaggaaagacagaataagagaagaaactgagaggacascacaaactcagagagaggtggcgcagatggaaagggaggcaaccggctctgagcattttctctgtttgctttgttgcaatctaactttagccctcctgcctgggtagcgcttaggattcacagtttgctggatactcatgaggaggaaaaacactctaatccttttcattaccttaagaaaaaggaatgcacaacgattttagagctctgcaaggaaatgaatcaacctcagctcaccttctttctattttgattgtacagaactcgcagcagccctgtgctctgagaaatcctgcatct

SEQ ID NO: 113838 - DNA, 601 bp, Human
ctggctaatttgttttttaatgtttaatttttaaattattgatttgttctgtaggacaaggtctcactatgttgctcaggctggtcttgaactcctgggctcaagccatcctcccgcctcagccttctgagtggctgggcatctgtcctatttgtaaaggaactgtgaggcacgacctttactggagttctgatattattccaggatggaaaccccagagtgcaatcaaacacactaagagaacagccctcagcccacagggaaacccgctgatgggggagacctcttctggagggcaggsctctcgttctgcggggccataccacctgcagcctctttctaacccggatagtttatggctccccagagactgcttggtgggaaaggtctgctaaaaatatatgatcttggaatctaaggaatcagaagccaggcagagctgaagcaactgccgtaaccctagtggaaaatcacacctgatctcctttgcaaatctgtctcttgcctagggacaggaaagacagaataagagaagaaactgagaggacagcacaaactcagagagaggtggcgcagatggaaagggaggcaaccggctctg

SEQ ID NO: 113839 - DNA, 601 bp, Human
taattctggggtctaagtaggggacaggtggcccgctggggcttctacacattttgggaatcacagccagtatgaagttataattacatctatctgttctggtttttcctttctttcttttagagatggggtcttgctatgttgcccaggctggagtactatggctattcacaggggagatcacagctcaccacaaacctcgaactcctgggctcaggcgatcctcctgagtagctgggactacaggtgcagggccatgcctggctaatttgttttttaatgtttaatttttaaattattkatttgttctgtaggacaaggtctcactatgttgctcaggctggtcttgaactcctgggctcaagccatcctcccgcctcagccttctgagtggctgggcatctgtcctatttgtaaaggaactgtgaggcacgacctttactggagttctgatattattccaggatggaaaccccagagtgcaatcaaacacactaagagaacagccctcagcccacagggaaacccgctgatgggggagacctcttctggagggcaggcctctcgttctgcggggccataccacctgcagcctctttct

SEQ ID NO: 113840 - DNA, 601 bp, Human
gctgagggcctattccagatggaaggaggctgatgagacatgacaactaaatgcaaaatatcttcctggagagatttctgaaccagagaaagagagacagaaaaaggtggaggggaacagagacagcgtgagaaaacagacagagacagagagacagagagaggaaaggatggaggggagcaggaaagggagcggagggagaaagaagaaggggcggggagatgtgaaggaaggaggcacagagagagggagaaattgtcagaggagggacagttagcaaaatcctaatggagtctgtggwttggatggttgtgttgcatcagtgttgatttccagattggcaggcacgtgggatggatacgtgggaaagtgtccttacttttggatggtgtacactggactgtctggggatgtgccgaatcaggtcacatgtcctacattatagacagatgaacagggacaggaagtgtagaagaacgggcgtagataatgcagacacgggagatgcgggaattctctgtacgttcttgtaacttttctatagattcggaactactaaacaattttttaatgggaggtaaggaggagtggtggtgaggtg

SEQ ID NO: 113841 - DNA, 601 bp, Human
tggtattcctgtccagcatggccatatggccatgaggcagcatcagacagacagctgaggctcaaactacagcatggaaaacagtcaaacacatgagaaatgggcacgctgagggcctattccagatggaaggaggctgatgagacatgacaactaaatgcaaaatatcttcctggagagatttctgaaccagagaaagagagacagaaaaaggtggaggggaacagagacagcgtgagaaaacagacagagacagagagacagagagaggaaaggatggaggggagcaggaaagggagcrgagggagaaagaagaaggggcggggagatgtgaaggaaggaggcacagagagagggagaaattgtcagaggagggacagttagcaaaatcctaatggagtctgtggattggatggttgtgttgcatcagtgttgatttccagattggcaggcacgtgggatggatacgtgggaaagtgtccttacttttggatggtgtacactggactgtctggggatgtgccgaatcaggtcacatgtcctacattatagacagatgaacagggacaggaagtgtagaagaacgggcgtagataatgca

SEQ ID NO: 113842 - DNA, 601 bp, Human
ttgcccaggctggagtgcagtggtgcaatctcggctcactgcaagctccgcctcccgggttcacaccattctcctgcctcagcctcccaagtagctgggactacaggcccgccaccacgcccagctaatttttttatatttttagtagagacggggtttcacagtgttcaccaggatggtctcgatctcctgacctcgtgatctgcccacctcggcctcccaaagtgctgggattacaggcgtgagcctccgcgcccgatgggagcatgatttctatggtattcctgtccagcatggccayatggccatgaggcagcatcagacagacagctgaggctcaaactacagcatggaaaacagtcaaacacatgagaaatgggcacgctgagggcctattccagatggaaggaggctgatgagacatgacaactaaatgcaaaatatcttcctggagagatttctgaaccagagaaagagagacagaaaaaggtggaggggaacagagacagcgtgagaaaacagacagagacagagagacagagagaggaaaggatggaggggagcaggaaagggagcggagggagaaagaagaaggggcggg

SEQ ID NO: 113843 - DNA, 601 bp, Human
ataggcccgatagcagtggcagagacaccaaggagtctgaggaccccagagtgaataaaatgaaagatgagaaaagaaatgcctagatgcttttacctttacccatgcaggcagcaaagatccaggcagaagatcttgcctgtgataaggaggaagttgtctacatagtggactcctctatttaatatcctaggttagtgggatatatttcatatcccactttcctattcaatttggattctctgttgagttattataaacaagcaagtgctatactcgatgtcacagaagcttaattccscaaatagcaaccaacttgtacatgtgtgacctctagctttgctctattattggtccttgtttgtggagtgagaccacaacagaatatattacatttgcaggtctgcagccctgcagcagagtaggagagaagagcctaaactggggttacagagaggaaaagaaggactggagtgactgccatacttactccaaatcctgaaactgatgagaatgaaagaaagagcagggaagaaagcaaggcaaagaccatggagccacaggaggcagagcagatgatgggaagggaaggagcgacggc

SEQ ID NO: 113844 - DNA, 601 bp, Human
tggcttgtatggtgaacacctctctttcctgacctctgccaaagctgaagcgatttacgtggcccgcttcttagagggctttgcctctgtttgaaattctgtttactcagctgccttactacctcaggcaggcatgagatgggttcaggaaaaaatgatcactttgtaaattatcgagctttttgtcattgtcggggtaggagccatgctctctgcagccttctgcatcctacatactccctgtactgagcccttaaggccagctgtccccatatgatctctttccacatggtcctaacayaggagataaccttttaaggctctttttggcaaaaatcttcatgccaagcacacacacctagagctgtgcacctgcctttgctctttttcaggtggaatgtcaactgacaggattgttctgaaaagcgatctgtgtgatgggcggggaaggagacctcagctaggctatgtttcttttaacatttttaagaagaagaagaaaaaagtcacattcagcctgattaattcaatgtggagtattttcttgcaccaactgtgagaaattccattggcaaaatacacaattccagacatttgttct

SEQ ID NO: 113845 - DNA, 601 bp, Human
gatggagtttcactctcattgcccaggctggagtgcagtggcatgatcttggctcactgcaacctccacctcccaagttcaagcaattcacctgcctcaacctcccaagtagctgggattacaggcgtctgccaccacgcctggctaattttttgcatttttagtagacggggtttcaccatgttggccaggctggtctcgaactcctgaacttaggtagtctacccgtctcggcctcccaaagtgctgggattacaggcgtgagccaccacgcccaattgcctgcttgttattggtgtaraatcccgggcccaaaacaatctacagcccctcccctaggagtcccaaggtggctgctcctatcttccctacagcagcaagtcattggcaggaatgtttcctacccctcccctggctgaggcagtttgtttctattcctcccctaggtctacggtctaaggattggtgtatctctgtatgcgtgcactctatatacacattcatgtaatcaccacccctcaatgtctacttcaaattaaggttcctgagttggtgcagtgagtgctggataagccagctcaggcctctggggctgacacac

SEQ ID NO: 113846 - DNA, 601 bp, Human
gtttagcaatccttcccccttctctgtggcagcaaaacctgtctcacttgcactggtcttgggtgagtttcttgctcctcccccagcagtagtcgacccctgcttgttttttttgtgtttgtttttgattttttttttttttttagatggagtttcactctcattgcccaggctggagtgcagtggcatgatcttggctcactgcaacctccacctcccaagttcaagcaattcacctgcctcaacctcccaagtagctgggattacaggcgtctgccaccacgcctggctaattttttgyatttttagtagacggggtttcaccatgttggccaggctggtctcgaactcctgaacttaggtagtctacccgtctcggcctcccaaagtgctgggattacaggcgtgagccaccacgcccaattgcctgcttgttattggtgtagaatcccgggcccaaaacaatctacagcccctcccctaggagtcccaaggtggctgctcctatcttccctacagcagcaagtcattggcaggaatgtttcctacccctcccctggctgaggcagtttgtttctattcctcccctaggtctacggtc

SEQ ID NO: 113847 - DNA, 601 bp, Human
ttaaatgaggtaattctccatgctcctactcttctcccagcagtggcctgctcttccttattacaacatgttaggctggcaggaatgggcatgttctcttttgtcgtgctccagcttcagtattaggcaggctctgtacatctggccctctaaggtgggatttcttttccatgtttagcaatccttcccccttctctgtggcagcaaaacctgtctcacttgcactggtcttgggtgagtttcttgctcctcccccagcagtagtcgacccctgcttgttttttttgtgtttgtttttgattttttttttttttttagatggagtttcactctcattgcccaggctggagtgcagtggcatgatcttggctcactgcaacctccacctcccaagttcaagcaattcacctgcctcaacctcccaagtagctgggattacaggcgtctgccaccacgcctggctaattttttgcatttttagtagacggggtttcaccatgttggccaggctggtctcgaactcctgaacttaggtagtctacccgtctcggcctcccaaagtgctgggattacaggcgtgagccaccacgcccaattgcct

SEQ ID NO: 113848 - DNA, 601 bp, Human
aactttttcttatagttttcatctctctgctgaaaatttccatctactcatgaatgttatctacttttcccactagatactttaacatattaatcatagttattttaaagtccatctaatacttccaacatccaacattgtggtcatctctaggtctgattctgtttattgctttgtctctcgacaatagttcattgtttttttctttctttttttttttttttttggtgtgtgataatttttagttgagtgccagacatcaagcatagaagagcagtagagactgaggtaaatagtattyacggctggaaatcaacatgcctcttcttctgtgaagttgtcagcatggaggtgagaaggctgagtcaatctcaggggttgacctgagtttgagttttgttgttactttcagtgcaccacagccttcacattcttacaaaggtagactgcggttatcttgaactttgagttggagctggggtgccaggggctttttgtgtgagtgttcttgacctccctcaacttccagccatcctgcatgcctgggccttaaatgaggtaattctccatgctcctactcttctcccagcagtggcctgct

SEQ ID NO: 113849 - DNA, 601 bp, Human
aacagggtgtagaagataagcaaaaaggaagcagaataatataagagtaaatgatttcactaaattagaagctggggagaaaagcaataactacttgtggccattttttaaccatatggctttccctggaggaaaacaccagttcgctagagtctttttcctacagatactgccttctggagctccaattacatgtgttttagaccagttgatgttgttccatagctcttggctactctgttttggtttgttttttccccctcttttctctcttttctttcaatttgaattatttctattkacttatcctcaagttctttaattctctcctcagttatgtccagtctactgatgaacctgttgaataaattcttcatttctgagaaagtgtcttttgttttcagcatttcattgaactttttcttatagttttcatctctctgctgaaaatttccatctactcatgaatgttatctacttttcccactagatactttaacatattaatcatagttattttaaagtccatctaatacttccaacatccaacattgtggtcatctctaggtctgattctgtttattgctttgtctctcgacaa

SEQ ID NO: 113850 - DNA, 601 bp, Human
gaacacctgaaaacgaacctcctgcacacacacacaaaggagcttgtacagctgtcttattaaatgcataactagtttatgcaggagaccacttctgatatccaaaagagcattttgtggataaataccatatttaatacttcctttttctttaagcagatttttcattgctcaaatgagaaggaggaggaggactgcaaattatgtgagctatttgttcttagctgtaagtatggacagagatgaactgtaatttaccacctcttcaaaactgagaatcatgttttactttagctaaatcaagtttaagttagcttggttgctaaaagtaaaaggcagcttgctgagacttgctttgaatcttttcggcgactccatctcaccttcacagccacttttcttgaagccaaatggcagacaggctgttaaaggggattggaggtgtggataaatcacatatttcttccctcaaataacagggtgtagaagataagcaaaaaggaagcagaataatataagagtaaatgatttcactaaattagaagctggggagaaaagcaataactacttgtggccattttttaaccatatggctttccct

SEQ ID NO: 113851 - DNA, 601 bp, Human
tcctgtcctcctcctcctggcctcccgttttgattaattctgttctattgcgttcctttccaggggaggcctcagagccacttcaggctccagttcatgaaacagatcctcaccacctagacggagggcttggtttctgcaggtctgatgtgcggggtccctgactcacgtccccaaatatctccgcagccccaccctgcgttcctcgaattccagctctcccattgtgtcagggcatcattttcaggaggttcttgttcaaacacaagtattctacctgggagtgggagtgcattagccyattcacagattaggcaaattgctttgccataactagcagaggaaagtcacccaaagtcatgataggagaatggaaggggtccaacgcttcttttatgtggggaccttggatgcagcaaatataacagatgccttggatgttagagaaatgagaaggggggctgcaaagggaacattacctacctcctatttaggtcagggcagccctgcacccttgcctatcagcacagccagccttgccagggtgtgtgtgtaggggagagggggtggttcaccaaatatttcctcatgcaaacgcctg

SEQ ID NO: 113852 - DNA, 601 bp, Human
cgtacagaaaatgattttagtcagtgagcaaactccacctcctgcttttttattttgttcctgtcctcctccttccccgccagcaattttcccctcctgtcctcctcctcctggcctcccgttttgattaattctgttctattgcgttcctttccaggggaggcctcagagccacttcaggctccagttcatgaaacagatcctcaccacctagacggagggcttggtttctgcaggtctgatgtgcggggtccctgactcacgtccccaaatatctccgcagccccaccctgcgttcctsgaattccagctctcccattgtgtcagggcatcattttcaggaggttcttgttcaaacacaagtattctacctgggagtgggagtgcattagcccattcacagattaggcaaattgctttgccataactagcagaggaaagtcacccaaagtcatgataggagaatggaaggggtccaacgcttcttttatgtggggaccttggatgcagcaaatataacagatgccttggatgttagagaaatgagaaggggggctgcaaagggaacattacctacctcctatttaggtcagggcagccc

SEQ ID NO: 113853 - DNA, 601 bp, Human
ctgaggtgggagaatcacctgagcccaggagtttgaggctacagtgagctgagatcctgctactgggtgacagggccagaccctgtctcaaaaataaaaataaaatgtaaaacataaaatagcccctttgccatcccaccatttcaaaggtgaccaaagaaggctgcctgacagttaagctttaggaaaagcaaaaaacaaacaaacaaacaaacaaaacacattttccttgcccaacccttagcccacaagagcagagccaattaaaatttaaccaattaaagttccagctgcatctggygaagctgccactgtgctttatggaaggcagccaagttcaagttttattcatcactctcatgcttcctgctcttctgatccttgccctgaaaggtcttgaaactttccggcaaaagctgacatcaaggagtgctactcggagccacaaataagtctgacaatatgaaggagcaaaatatcaattccaacggatgagtcgatcttggctccgtacagaaaatgattttagtcagtgagcaaactccacctcctgcttttttattttgttcctgtcctcctccttccccgccagcaattttcc

SEQ ID NO: 113854 - DNA, 601 bp, Human
gggattcagagaactaaaaagtgattggaaggataagagaaattcagatgcatgcctgagttctctcatgaaggactggtttctaaggaaggactcacaaacttgaattttcaatgcaaagctcccccactccctgtgagacataccttggttgtcgtttctagaatgatttctttgtgcagaagttcaaccaccattttcacatggccttccttagaagccagatgcaagccattcaacccattctgtaaagagcagagaggcgggaagggcatggttagtcaaatggtgctttctgcaygtcccagtgggggcccaggccccttcccagccctgaggtgttcacagcactggagaaaaggagtggagtgtgtctagaggttggaaggggcacagggcagggccacccagcctccccttcacgcctcaggtcacaacagagcagagatggaaaggaagggcaagaactagcccgccactcccagatgtgaattaggcagtaagctctcacaacacccatggtgaccttgaaattcatgtcgaggccaggctttaggcagcccacttaattaaaatgatgtagcttcaacccctggttaat

SEQ ID NO: 113855 - DNA, 601 bp, Human; identical to SEQ ID NO: 17663

SEQ ID NO: 113856 - DNA, 601 bp, Human; identical to SEQ ID NO: 17664

SEQ ID NO: 113857 - DNA, 601 bp, Human; identical to SEQ ID NO: 17665

SEQ ID NO: 113858 - DNA, 601 bp, Human; identical to SEQ ID NO: 17666

SEQ ID NO: 113859 - DNA, 601 bp, Human; identical to SEQ ID NO: 17667

SEQ ID NO: 113860 - DNA, 601 bp, Human; identical to SEQ ID NO: 17668

SEQ ID NO: 113861 - DNA, 601 bp, Human; identical to SEQ ID NO: 17669

SEQ ID NO: 113862 - DNA, 601 bp, Human; identical to SEQ ID NO: 17670

SEQ ID NO: 113863 - DNA, 601 bp, Human; identical to SEQ ID NO: 17671

SEQ ID NO: 113864 - DNA, 601 bp, Human; identical to SEQ ID NO: 17672

SEQ ID NO: 113865 - DNA, 601 bp, Human; identical to SEQ ID NO: 17673

SEQ ID NO: 113866 - DNA, 601 bp, Human; identical to SEQ ID NO: 17674

SEQ ID NO: 113867 - DNA, 601 bp, Human; identical to SEQ ID NO: 17675

SEQ ID NO: 113868 - DNA, 601 bp, Human; identical to SEQ ID NO: 17676

SEQ ID NO: 113869 - DNA, 601 bp, Human; identical to SEQ ID NO: 17677

SEQ ID NO: 113870 - DNA, 601 bp, Human; identical to SEQ ID NO: 17678

SEQ ID NO: 113871 - DNA, 601 bp, Human; identical to SEQ ID NO: 17679

SEQ ID NO: 113872 - DNA, 601 bp, Human; identical to SEQ ID NO: 17680

SEQ ID NO: 113873 - DNA, 601 bp, Human; identical to SEQ ID NO: 17681

SEQ ID NO: 113874 - DNA, 601 bp, Human; identical to SEQ ID NO: 17682

SEQ ID NO: 113875 - DNA, 601 bp, Human; identical to SEQ ID NO: 17683

SEQ ID NO: 113876 - DNA, 601 bp, Human; identical to SEQ ID NO: 17684

SEQ ID NO: 113877 - DNA, 601 bp, Human; identical to SEQ ID NO: 17685

SEQ ID NO: 113878 - DNA, 601 bp, Human; identical to SEQ ID NO: 17686

SEQ ID NO: 113879 - DNA, 601 bp, Human; identical to SEQ ID NO: 17687

SEQ ID NO: 113880 - DNA, 601 bp, Human; identical to SEQ ID NO: 17688

SEQ ID NO: 113881 - DNA, 601 bp, Human; identical to SEQ ID NO: 17689

SEQ ID NO: 113882 - DNA, 601 bp, Human; identical to SEQ ID NO: 17690

SEQ ID NO: 113883 - DNA, 601 bp, Human; identical to SEQ ID NO: 17691

SEQ ID NO: 113884 - DNA, 601 bp, Human; identical to SEQ ID NO: 17692

SEQ ID NO: 113885 - DNA, 601 bp, Human; identical to SEQ ID NO: 17693

SEQ ID NO: 113886 - DNA, 601 bp, Human; identical to SEQ ID NO: 17694

SEQ ID NO: 113887 - DNA, 601 bp, Human
caggtcactgccctggttctgtgctgacccagaggtaataatcgtcctgctagcttaacgtcagcagcaaatgggcaacaggggtcatcagacagcctcaccctagacaaggccacacttcactagccacagttgtgaagaattgagggaaataaaacaagttttatttccaagtagacattagtttgtgtctgatttatcaggtcaaatggaactcacacgggtgtgagatgatcatttctcctctcataagggaagtctgttttattttcagaaacatgctattttattttggatctayaggccatgctttcttcatgtttattcccagggcctgggccgtcctctcctatgtgggagaagcacgctggccttttggcctgagcccctctgctctggccaattaaggcactggtggtgagcagagctatgaagggagagacagcctcaggcttctaattcctggacaccacccacttatgtcgtgctcacagagctgcctatcactacccagagtcccagggcctcagaaggaggctcagacatgcagagggaccaggaaaagcacagaggagccaaggtccgactgtgggcatcagtg

SEQ ID NO: 113888 - DNA, 601 bp, Human
tgattgcttttaagatttttctcttcaccactggttttgaccagtctgctaataatgtgccctgatagagttgctcacgtgtttcctgtgcatgcagttcatcaaacttgttggatctatgtcttcatgatttttatcaaatttggcaagtttctgtccatatttctttttttttctttttctttttttttgcgttgagaactctgtcacccagactggaatgcagtaatgtaatctcggtccactgcaacctccacctcctgggttcaagcgattctcctgcctcagcctctcaagtagmtgggactacagtcatgcaccagcatgcctggctaacttttgtaatttttttagtggagacagggtttcactatgttggccaggctggtctcgaacttctgacctcaagtgatccgcccacctgggcctccaaaagtgctggggttacagacataagccactgtgcccagccccaaatttcttacaatactttttcttccttcttttctgttgggaactgtaatttcacatattaggtcacttgaaattgccccatagctcactttgtgtttctccaaaacagaaagaaaagaaaaatgtt

SEQ ID NO: 113889 - DNA, 601 bp, Human
tcccgttgcccaggctggagtgcaatggtgcaatcttggttcactgcaacctctgcctcctgggctcaagcgattctcctgcctcagccttctgagtagctaaaagtacaggcacgcaccaccatacacggctaatttttgtattttttgtagagatggagtttcaccctgttgcccaggctggtctcgaactcctgatctcaagtgatccacccacctcgacctcccaaagtgccaggattacaagcgtgaaccactgcacccggccttggcttgtgttgtttctaataagaaatctgakgtgaatcttattttggttcccttgtacataacacatttttttccctctgattgcttttaagatttttctcttcaccactggttttgaccagtctgctaataatgtgccctgatagagttgctcacgtgtttcctgtgcatgcagttcatcaaacttgttggatctatgtcttcatgatttttatcaaatttggcaagtttctgtccatatttctttttttttctttttctttttttttgcgttgagaactctgtcacccagactggaatgcagtaatgtaatctcggtccactgcaacct

SEQ ID NO: 113890 - DNA, 601 bp, Human
ggtttttttcttatgttttcttctagaagttttatagttgtagatattacatttaatctatgacccatttagagttgatttttgtatacaaggtaataatccaagttcatttcagtttagattttttgcataaatgttcataaatgatattggtttgcagttttcttgttaattgtctttcttcccaatatcagggtaatgctggcctcataaacttaattgagaagtattttctcattttcaattttctaaacaagttgtttcttccttaaatgtttggtagaattcaccagtgaagccrtctgggcatggacttttctttgtaggaatgttccaaaccatacatttaatgtctttcatttatatggggctatatctatttcttcctaagtgagctttgatagtttgtgtctttcaaggaatttgttgatttcacctgttttccaatttactggcacaaaattgtcataatatccctttattgtccttttactacctatagaatctgtagatattctataggtagtatatattccttattcctgatattggtaatctgcaggtcttctcttttttcataatcagtctggctagaggttta

SEQ ID NO: 113891 - DNA, 601 bp, Human
aaatctttgccttaaccaagatctttaaggtttttttcttatgttttcttctagaagttttatagttgtagatattacatttaatctatgacccatttagagttgatttttgtatacaaggtaataatccaagttcatttcagtttagattttttgcataaatgttcataaatgatattggtttgcagttttcttgttaattgtctttcttcccaatatcagggtaatgctggcctcataaacttaattgagaagtattttctcattttcaattttctaaacaagttgtttcttccttaartgtttggtagaattcaccagtgaagccgtctgggcatggacttttctttgtaggaatgttccaaaccatacatttaatgtctttcatttatatggggctatatctatttcttcctaagtgagctttgatagtttgtgtctttcaaggaatttgttgatttcacctgttttccaatttactggcacaaaattgtcataatatccctttattgtccttttactacctatagaatctgtagatattctataggtagtatatattccttattcctgatattggtaatctgcaggtcttctcttt

SEQ ID NO: 113892 - DNA, 601 bp, Human
atatggccagcctttttaattttaaccattcttttaggtatgtggtggtacctccttatagttttaatttgtatttccctaatcactaatgatgttgagcatattttcatgtgcttatttgccatgtgtatatattctgggtgaaaagtctgttcgaatctattgctcaatctaaaaactgagttgttttcttattattaagttttgagagttctttgtatattccaatactatagcagatgattatttgccaatattttctcccagtctgtagctcgtcttttcattttcttaacagtgyattttgaagagcagaagttttgattttgatgaagcccaacttgtcaatttgttcttttatggattgtgcttttggtgttgtatctgagaaatctttgccttaaccaagatctttaaggtttttttcttatgttttcttctagaagttttatagttgtagatattacatttaatctatgacccatttagagttgatttttgtatacaaggtaataatccaagttcatttcagtttagattttttgcataaatgttcataaatgatattggtttgcagttttcttgttaattgtctttcttc

SEQ ID NO: 113893 - DNA, 601 bp, Human
aaggacatttgtcaccccagaaaggtctcctcaagcttctttgtaatctctccctgccctttccccctctgccaaccccaaaccattcccaggtgaccccgatctgctttttgccactacacatcagtttgcatttcccaggattttacataaacggattcatacagtatgcactctctctttttttaaagcctggcttctttcactcaacgtagtcaatttgggtttcatccatgctgatgcatgtatcaataatttatttctgttgctaagccatagccctttggaaggatatatcacrgtttgtaaatttatttacctgccaatggacatttgggctgcttccagtttgtggctattacaagtaaagatgctagtctgtatggacataatgctttcttttctcttgggtaaatagctaggaatggaatgacttgattgtacagtaggtatatgtttaactttgtcagaaatgatcaagtggttgtaccattttgcattcccaccagtggtgtatgagagttccagttcccccatatcctcaccaacacttgatatggccagcctttttaattttaaccattcttttaggtatgtggtg

SEQ ID NO: 113894 - DNA, 601 bp, Human
tcactgagcccggccactgagcgtatttttagtgcaaaacatatctaacatgtttttaattgccacaacaaccacatgaggaaaataatataattcctactttatagattaggaaactacaggtttagcaacttgcggaaggccatacagctagtaagtttggtcttttccatagactttgccattaatctctattaaaaatagctttgttgaggtatgtttgacattcaataaatgtgtatctttaaaagggggtaaattgatacgttgtgacacatgtgtacccccatgaagccatcamctcaaagaagaaaaaggacatttgtcaccccagaaaggtctcctcaagcttctttgtaatctctccctgccctttccccctctgccaaccccaaaccattcccaggtgaccccgatctgctttttgccactacacatcagtttgcatttcccaggattttacataaacggattcatacagtatgcactctctctttttttaaagcctggcttctttcactcaacgtagtcaatttgggtttcatccatgctgatgcatgtatcaataatttatttctgttgctaagccatagccctttgg

SEQ ID NO: 113895 - DNA, 601 bp, Human
ctggccaaactaggaagaacaaggaggaaggagtgggaagagtaggtgaaatgggtgggtcacatcttaccatgaactgaactccaagtcactgtacatgaaactgtgacttgaggaattatatagctgaccagggccatggccttcaaacccttcatagaaaaccctccacatatacaaaagcaggacattttggggtcaactgatgattatttttcttattactcttgcgagcattttatattatttacatcagttactgagcattttgttgttttttaaagcagagtcttgctctgtygcccaggctggagtgcagtaatgcaatctcagttcactgtaacctctgccttctaggttcaagtgattctcctgccttagcctctccactgggagtagctgggattacaggtatgcgccatgacgcctggccaatttttgtatttttagtagagatggggtttcaccctgttggccaggctggtctcgaactgctgacctcaagtgattcgcttgcctcagcctcccaaagtgctgggattacagggttgagtcactgagcccggccactgagcgtatttttagtgcaaaacatatctaa

SEQ ID NO: 113896 - DNA, 601 bp, Human
aaggcggttctcagaaatgcaaacccatgaggacagggctgatgcctgccttcctcgccccaccctttcctacaacaggattgggcctccactagccccatgaccactgaagagctctccaggtgtgtgagaggacccagcagctggaacagaaagacctcaggcacattcagtggaactgcaattgctaacatgtacctgtgtgttcaacgtgcccggagccatgctgtgtactccgcatgcattctcttaatctcccagggaagttttcttccctgcaagcctacttggttccaggtcscaaatgagcggggaggatgagcccgtgaaggtggggtggttgggagaagggctgcacagcggcagagactgagggaaaccccttttagctctggccaaactaggaagaacaaggaggaaggagtgggaagagtaggtgaaatgggtgggtcacatcttaccatgaactgaactccaagtcactgtacatgaaactgtgacttgaggaattatatagctgaccagggccatggccttcaaacccttcatagaaaaccctccacatatacaaaagcaggacattttggggtcaactgatgat

SEQ ID NO: 113897 - DNA, 601 bp, Human
tgtgggtgggagaagagactagaagacaagattctccaatgggcttggcctgtctaggaaatcaggaagcaagtacgtgcttacagcagctggaaagcccacagagctgaagggggaccctgggaatgggcagggctgccccttgcagtctctagggaccttcctgccatcgagagatgtccagacacccccagcctagagttcaaacctagttcaaatgctccattctgccattcagcccctacccccactcctactcacatgcaactgcccccgggctgtgctttgattcaagccaggygggctcctttcttgccccctcagcctccgctcggggcctcagcctccgctcggggcctcagctcctgatcacctgctcccctgcttttacatcactagctccatttattctcatccactcactgttcaaccaaaataagagaggtccgattacatgccaggcactgtgctatgggaatggggatgacaaaccccaaacacacatgcacacacacacactcacacactctctctcacccacacactcacagatgggacagcttcttgtctcatggcattttcccagcttcagctcctgttg

SEQ ID NO: 113898 - DNA, 601 bp, Human
agccctgagctgcttgtcccagctgcaggtcagcaccgacctggtgggatgggagccagctcgctcaggccctgagtgcatgacccgtgcattgacaggaaaaagaggactctgatgccccttcagagcaggtgcctctgtgggtgggagaagagactagaagacaagattctccaatgggcttggcctgtctaggaaatcaggaagcaagtacgtgcttacagcagctggaaagcccacagagctgaagggggaccctgggaatgggcagggctgccccttgcagtctctagggaccttyctgccatcgagagatgtccagacacccccagcctagagttcaaacctagttcaaatgctccattctgccattcagcccctacccccactcctactcacatgcaactgcccccgggctgtgctttgattcaagccaggcgggctcctttcttgccccctcagcctccgctcggggcctcagcctccgctcggggcctcagctcctgatcacctgctcccctgcttttacatcactagctccatttattctcatccactcactgttcaaccaaaataagagaggtccgattacatgccaggc

SEQ ID NO: 113899 - DNA, 601 bp, Human
ggctgcccttgaggggcctatcagggtacactaaacacccatagacctcactgtggtggtcaaatgggaaacaaccttctggtgtggccaggcatcactttcctcaagttgcctattggttccagaaactctgcacgatctaaagtgctacaggggagggctcttagggctcaaaaggggcaaggtcagaaggcaccaagaggcaccaggtctgcccgccccaaaaccctgtgtccaagagccctgagctgcttgtcccagctgcaggtcagcaccgacctggtgggatgggagccagctygctcaggccctgagtgcatgacccgtgcattgacaggaaaaagaggactctgatgccccttcagagcaggtgcctctgtgggtgggagaagagactagaagacaagattctccaatgggcttggcctgtctaggaaatcaggaagcaagtacgtgcttacagcagctggaaagcccacagagctgaagggggaccctgggaatgggcagggctgccccttgcagtctctagggaccttcctgccatcgagagatgtccagacacccccagcctagagttcaaacctagttcaaatgctcc

SEQ ID NO: 113900 - DNA, 601 bp, Human
ggcgaagaggagattggactttcttatccagttcagagcactagataaagaagcctttatccaaaggacttgtgctccaatctgtctctgatcccatgaaagctccacttctccatggctgggcagaagtagacgttgctcctctactcaaaacttcactttagcttagctcttaggttctcagggatgtaccttaaagggaaggaaaggccacccagaaccaggggtagtaaccaggctgcccttgaggggcctatcagggtacactaaacacccatagacctcactgtggtggtcaaaygggaaacaaccttctggtgtggccaggcatcactttcctcaagttgcctattggttccagaaactctgcacgatctaaagtgctacaggggagggctcttagggctcaaaaggggcaaggtcagaaggcaccaagaggcaccaggtctgcccgccccaaaaccctgtgtccaagagccctgagctgcttgtcccagctgcaggtcagcaccgacctggtgggatgggagccagctcgctcaggccctgagtgcatgacccgtgcattgacaggaaaaagaggactctgatgccccttcag

SEQ ID NO: 113901 - DNA, 601 bp, Human; identical to SEQ ID NO: 39390

SEQ ID NO: 113902 - DNA, 601 bp, Human; identical to SEQ ID NO: 39391

SEQ ID NO: 113903 - DNA, 601 bp, Human; identical to SEQ ID NO: 39392

SEQ ID NO: 113904 - DNA, 601 bp, Human; identical to SEQ ID NO: 39393

SEQ ID NO: 113905 - DNA, 601 bp, Human; identical to SEQ ID NO: 39394

SEQ ID NO: 113906 - DNA, 601 bp, Human; identical to SEQ ID NO: 39395

SEQ ID NO: 113907 - DNA, 601 bp, Human; identical to SEQ ID NO: 39396

SEQ ID NO: 113908 - DNA, 601 bp, Human; identical to SEQ ID NO: 39397

SEQ ID NO: 113909 - DNA, 601 bp, Human; identical to SEQ ID NO: 39398

SEQ ID NO: 113910 - DNA, 601 bp, Human; identical to SEQ ID NO: 39399

SEQ ID NO: 113911 - DNA, 601 bp, Human; identical to SEQ ID NO: 39400

SEQ ID NO: 113912 - DNA, 601 bp, Human; identical to SEQ ID NO: 39401

SEQ ID NO: 113913 - DNA, 601 bp, Human; identical to SEQ ID NO: 39402

SEQ ID NO: 113914 - DNA, 601 bp, Human; identical to SEQ ID NO: 39403

SEQ ID NO: 113915 - DNA, 601 bp, Human; identical to SEQ ID NO: 39404

SEQ ID NO: 113916 - DNA, 601 bp, Human; identical to SEQ ID NO: 39405

SEQ ID NO: 113917 - DNA, 601 bp, Human; identical to SEQ ID NO: 39406

SEQ ID NO: 113918 - DNA, 601 bp, Human; identical to SEQ ID NO: 39407

SEQ ID NO: 113919 - DNA, 601 bp, Human; identical to SEQ ID NO: 39408

SEQ ID NO: 113920 - DNA, 601 bp, Human; identical to SEQ ID NO: 39409

SEQ ID NO: 113921 - DNA, 601 bp, Human; identical to SEQ ID NO: 39410

SEQ ID NO: 113922 - DNA, 601 bp, Human; identical to SEQ ID NO: 113754

SEQ ID NO: 113923 - DNA, 601 bp, Human; identical to SEQ ID NO: 113755

SEQ ID NO: 113924 - DNA, 601 bp, Human; identical to SEQ ID NO: 113756

SEQ ID NO: 113925 - DNA, 601 bp, Human; identical to SEQ ID NO: 113757

SEQ ID NO: 113926 - DNA, 601 bp, Human; identical to SEQ ID NO: 113758

SEQ ID NO: 113927 - DNA, 601 bp, Human; identical to SEQ ID NO: 113759

SEQ ID NO: 113928 - DNA, 601 bp, Human; identical to SEQ ID NO: 113760

SEQ ID NO: 113929 - DNA, 601 bp, Human; identical to SEQ ID NO: 113761

SEQ ID NO: 113930 - DNA, 601 bp, Human; identical to SEQ ID NO: 113762

SEQ ID NO: 113931 - DNA, 601 bp, Human; identical to SEQ ID NO: 113763

SEQ ID NO: 113932 - DNA, 601 bp, Human; identical to SEQ ID NO: 113764

SEQ ID NO: 113933 - DNA, 601 bp, Human; identical to SEQ ID NO: 113765

SEQ ID NO: 113934 - DNA, 601 bp, Human; identical to SEQ ID NO: 113766

SEQ ID NO: 113935 - DNA, 601 bp, Human; identical to SEQ ID NO: 113767

SEQ ID NO: 113936 - DNA, 601 bp, Human; identical to SEQ ID NO: 113768

SEQ ID NO: 113937 - DNA, 601 bp, Human; identical to SEQ ID NO: 113769

SEQ ID NO: 113938 - DNA, 601 bp, Human; identical to SEQ ID NO: 113770

SEQ ID NO: 113939 - DNA, 601 bp, Human; identical to SEQ ID NO: 113771

SEQ ID NO: 113940 - DNA, 601 bp, Human; identical to SEQ ID NO: 113772

SEQ ID NO: 113941 - DNA, 601 bp, Human; identical to SEQ ID NO: 113773

SEQ ID NO: 113942 - DNA, 601 bp, Human; identical to SEQ ID NO: 113774

SEQ ID NO: 113943 - DNA, 601 bp, Human; identical to SEQ ID NO: 113775

SEQ ID NO: 113944 - DNA, 601 bp, Human; identical to SEQ ID NO: 113776

SEQ ID NO: 113945 - DNA, 601 bp, Human; identical to SEQ ID NO: 113777

SEQ ID NO: 113946 - DNA, 601 bp, Human; identical to SEQ ID NO: 113778

SEQ ID NO: 113947 - DNA, 601 bp, Human; identical to SEQ ID NO: 113779

SEQ ID NO: 113948 - DNA, 601 bp, Human; identical to SEQ ID NO: 113780

SEQ ID NO: 113949 - DNA, 601 bp, Human; identical to SEQ ID NO: 113781

SEQ ID NO: 113950 - DNA, 601 bp, Human; identical to SEQ ID NO: 113782

SEQ ID NO: 113951 - DNA, 601 bp, Human; identical to SEQ ID NO: 113783

SEQ ID NO: 113952 - DNA, 601 bp, Human; identical to SEQ ID NO: 113784

SEQ ID NO: 113953 - DNA, 601 bp, Human; identical to SEQ ID NO: 113785

SEQ ID NO: 113954 - DNA, 601 bp, Human; identical to SEQ ID NO: 113786

SEQ ID NO: 113955 - DNA, 601 bp, Human; identical to SEQ ID NO: 113787

SEQ ID NO: 113956 - DNA, 601 bp, Human; identical to SEQ ID NO: 113788

SEQ ID NO: 113957 - DNA, 601 bp, Human; identical to SEQ ID NO: 113789

SEQ ID NO: 113958 - DNA, 601 bp, Human; identical to SEQ ID NO: 113790

SEQ ID NO: 113959 - DNA, 601 bp, Human; identical to SEQ ID NO: 113791

SEQ ID NO: 113960 - DNA, 601 bp, Human; identical to SEQ ID NO: 113792

SEQ ID NO: 113961 - DNA, 601 bp, Human; identical to SEQ ID NO: 113793

SEQ ID NO: 113962 - DNA, 601 bp, Human; identical to SEQ ID NO: 113794

SEQ ID NO: 113963 - DNA, 601 bp, Human; identical to SEQ ID NO: 113795

SEQ ID NO: 113964 - DNA, 601 bp, Human; identical to SEQ ID NO: 113796

SEQ ID NO: 113965 - DNA, 601 bp, Human; identical to SEQ ID NO: 113797

SEQ ID NO: 113966 - DNA, 601 bp, Human; identical to SEQ ID NO: 113798

SEQ ID NO: 113967 - DNA, 601 bp, Human; identical to SEQ ID NO: 113799

SEQ ID NO: 113968 - DNA, 601 bp, Human; identical to SEQ ID NO: 113800

SEQ ID NO: 113969 - DNA, 601 bp, Human; identical to SEQ ID NO: 113801

SEQ ID NO: 113970 - DNA, 601 bp, Human; identical to SEQ ID NO: 113802

SEQ ID NO: 113971 - DNA, 601 bp, Human; identical to SEQ ID NO: 113803

SEQ ID NO: 113972 - DNA, 601 bp, Human; identical to SEQ ID NO: 113804

SEQ ID NO: 113973 - DNA, 601 bp, Human; identical to SEQ ID NO: 113805

SEQ ID NO: 113974 - DNA, 601 bp, Human; identical to SEQ ID NO: 113806

SEQ ID NO: 113975 - DNA, 601 bp, Human; identical to SEQ ID NO: 113807

SEQ ID NO: 113976 - DNA, 601 bp, Human; identical to SEQ ID NO: 113808

SEQ ID NO: 113977 - DNA, 601 bp, Human; identical to SEQ ID NO: 113809

SEQ ID NO: 113978 - DNA, 601 bp, Human; identical to SEQ ID NO: 113810

SEQ ID NO: 113979 - DNA, 601 bp, Human; identical to SEQ ID NO: 113811

SEQ ID NO: 113980 - DNA, 601 bp, Human; identical to SEQ ID NO: 113812

SEQ ID NO: 113981 - DNA, 601 bp, Human; identical to SEQ ID NO: 113813

SEQ ID NO: 113982 - DNA, 601 bp, Human; identical to SEQ ID NO: 113814

SEQ ID NO: 113983 - DNA, 601 bp, Human; identical to SEQ ID NO: 113815

SEQ ID NO: 113984 - DNA, 601 bp, Human; identical to SEQ ID NO: 113816

SEQ ID NO: 113985 - DNA, 601 bp, Human; identical to SEQ ID NO: 113817

SEQ ID NO: 113986 - DNA, 601 bp, Human; identical to SEQ ID NO: 113818

SEQ ID NO: 113987 - DNA, 601 bp, Human; identical to SEQ ID NO: 113819

SEQ ID NO: 113988 - DNA, 601 bp, Human; identical to SEQ ID NO: 113820

SEQ ID NO: 113989 - DNA, 601 bp, Human; identical to SEQ ID NO: 113821

SEQ ID NO: 113990 - DNA, 601 bp, Human; identical to SEQ ID NO: 113822

SEQ ID NO: 113991 - DNA, 601 bp, Human; identical to SEQ ID NO: 113823

SEQ ID NO: 113992 - DNA, 601 bp, Human; identical to SEQ ID NO: 113824

SEQ ID NO: 113993 - DNA, 601 bp, Human; identical to SEQ ID NO: 113825

SEQ ID NO: 113994 - DNA, 601 bp, Human; identical to SEQ ID NO: 113826

SEQ ID NO: 113995 - DNA, 601 bp, Human; identical to SEQ ID NO: 113827

SEQ ID NO: 113996 - DNA, 601 bp, Human; identical to SEQ ID NO: 113828

SEQ ID NO: 113997 - DNA, 601 bp, Human; identical to SEQ ID NO: 113829

SEQ ID NO: 113998 - DNA, 601 bp, Human; identical to SEQ ID NO: 113830

SEQ ID NO: 113999 - DNA, 601 bp, Human; identical to SEQ ID NO: 113831

SEQ ID NO: 114000 - DNA, 601 bp, Human; identical to SEQ ID NO: 113832

SEQ ID NO: 114001 - DNA, 601 bp, Human; identical to SEQ ID NO: 113833

SEQ ID NO: 114002 - DNA, 601 bp, Human; identical to SEQ ID NO: 113834

SEQ ID NO: 114003 - DNA, 601 bp, Human; identical to SEQ ID NO: 113835

SEQ ID NO: 114004 - DNA, 601 bp, Human; identical to SEQ ID NO: 113836

SEQ ID NO: 114005 - DNA, 601 bp, Human; identical to SEQ ID NO: 113837

SEQ ID NO: 114006 - DNA, 601 bp, Human; identical to SEQ ID NO: 113838

SEQ ID NO: 114007 - DNA, 601 bp, Human; identical to SEQ ID NO: 113839

SEQ ID NO: 114008 - DNA, 601 bp, Human; identical to SEQ ID NO: 113840

SEQ ID NO: 114009 - DNA, 601 bp, Human; identical to SEQ ID NO: 113841

SEQ ID NO: 114010 - DNA, 601 bp, Human; identical to SEQ ID NO: 113842

SEQ ID NO: 114011 - DNA, 601 bp, Human; identical to SEQ ID NO: 113843

SEQ ID NO: 114012 - DNA, 601 bp, Human; identical to SEQ ID NO: 113844

SEQ ID NO: 114013 - DNA, 601 bp, Human; identical to SEQ ID NO: 113845

SEQ ID NO: 114014 - DNA, 601 bp, Human; identical to SEQ ID NO: 113846

SEQ ID NO: 114015 - DNA, 601 bp, Human; identical to SEQ ID NO: 113847

SEQ ID NO: 114016 - DNA, 601 bp, Human; identical to SEQ ID NO: 113848

SEQ ID NO: 114017 - DNA, 601 bp, Human; identical to SEQ ID NO: 113849

SEQ ID NO: 114018 - DNA, 601 bp, Human; identical to SEQ ID NO: 113850

SEQ ID NO: 114019 - DNA, 601 bp, Human; identical to SEQ ID NO: 113851

SEQ ID NO: 114020 - DNA, 601 bp, Human; identical to SEQ ID NO: 113852

SEQ ID NO: 114021 - DNA, 601 bp, Human; identical to SEQ ID NO: 113853

SEQ ID NO: 114022 - DNA, 601 bp, Human; identical to SEQ ID NO: 113854

SEQ ID NO: 114023 - DNA, 601 bp, Human; identical to SEQ ID NO: 17663

SEQ ID NO: 114024 - DNA, 601 bp, Human; identical to SEQ ID NO: 17664

SEQ ID NO: 114025 - DNA, 601 bp, Human; identical to SEQ ID NO: 17665

SEQ ID NO: 114026 - DNA, 601 bp, Human; identical to SEQ ID NO: 17666

SEQ ID NO: 114027 - DNA, 601 bp, Human; identical to SEQ ID NO: 17667

SEQ ID NO: 114028 - DNA, 601 bp, Human; identical to SEQ ID NO: 17668

SEQ ID NO: 114029 - DNA, 601 bp, Human; identical to SEQ ID NO: 17669

SEQ ID NO: 114030 - DNA, 601 bp, Human; identical to SEQ ID NO: 17670

SEQ ID NO: 114031 - DNA, 601 bp, Human; identical to SEQ ID NO: 17671

SEQ ID NO: 114032 - DNA, 601 bp, Human; identical to SEQ ID NO: 17672

SEQ ID NO: 114033 - DNA, 601 bp, Human; identical to SEQ ID NO: 17673

SEQ ID NO: 114034 - DNA, 601 bp, Human; identical to SEQ ID NO: 17674

SEQ ID NO: 114035 - DNA, 601 bp, Human; identical to SEQ ID NO: 17675

SEQ ID NO: 114036 - DNA, 601 bp, Human; identical to SEQ ID NO: 17676

SEQ ID NO: 114037 - DNA, 601 bp, Human; identical to SEQ ID NO: 17677

SEQ ID NO: 114038 - DNA, 601 bp, Human; identical to SEQ ID NO: 17678

SEQ ID NO: 114039 - DNA, 601 bp, Human; identical to SEQ ID NO: 17679

SEQ ID NO: 114040 - DNA, 601 bp, Human; identical to SEQ ID NO: 17680

SEQ ID NO: 114041 - DNA, 601 bp, Human; identical to SEQ ID NO: 17681

SEQ ID NO: 114042 - DNA, 601 bp, Human; identical to SEQ ID NO: 17682

SEQ ID NO: 114043 - DNA, 601 bp, Human; identical to SEQ ID NO: 17683

SEQ ID NO: 114044 - DNA, 601 bp, Human; identical to SEQ ID NO: 17684

SEQ ID NO: 114045 - DNA, 601 bp, Human; identical to SEQ ID NO: 17685

SEQ ID NO: 114046 - DNA, 601 bp, Human; identical to SEQ ID NO: 17686

SEQ ID NO: 114047 - DNA, 601 bp, Human; identical to SEQ ID NO: 17687

SEQ ID NO: 114048 - DNA, 601 bp, Human; identical to SEQ ID NO: 17688

SEQ ID NO: 114049 - DNA, 601 bp, Human; identical to SEQ ID NO: 17689

SEQ ID NO: 114050 - DNA, 601 bp, Human; identical to SEQ ID NO: 17690

SEQ ID NO: 114051 - DNA, 601 bp, Human; identical to SEQ ID NO: 17691

SEQ ID NO: 114052 - DNA, 601 bp, Human; identical to SEQ ID NO: 17692

SEQ ID NO: 114053 - DNA, 601 bp, Human; identical to SEQ ID NO: 17693

SEQ ID NO: 114054 - DNA, 601 bp, Human; identical to SEQ ID NO: 17694

SEQ ID NO: 114055 - DNA, 601 bp, Human; identical to SEQ ID NO: 113887

SEQ ID NO: 114056 - DNA, 601 bp, Human; identical to SEQ ID NO: 113888

SEQ ID NO: 114057 - DNA, 601 bp, Human; identical to SEQ ID NO: 113889

SEQ ID NO: 114058 - DNA, 601 bp, Human; identical to SEQ ID NO: 113890

SEQ ID NO: 114059 - DNA, 601 bp, Human; identical to SEQ ID NO: 113891

SEQ ID NO: 114060 - DNA, 601 bp, Human; identical to SEQ ID NO: 113892

SEQ ID NO: 114061 - DNA, 601 bp, Human; identical to SEQ ID NO: 113893

SEQ ID NO: 114062 - DNA, 601 bp, Human; identical to SEQ ID NO: 113894

SEQ ID NO: 114063 - DNA, 601 bp, Human; identical to SEQ ID NO: 113895

SEQ ID NO: 114064 - DNA, 601 bp, Human; identical to SEQ ID NO: 113896

SEQ ID NO: 114065 - DNA, 601 bp, Human; identical to SEQ ID NO: 113897

SEQ ID NO: 114066 - DNA, 601 bp, Human; identical to SEQ ID NO: 113898

SEQ ID NO: 114067 - DNA, 601 bp, Human; identical to SEQ ID NO: 113899

SEQ ID NO: 114068 - DNA, 601 bp, Human; identical to SEQ ID NO: 113900

SEQ ID NO: 114069 - DNA, 601 bp, Human; identical to SEQ ID NO: 39390

SEQ ID NO: 114070 - DNA, 601 bp, Human; identical to SEQ ID NO: 39391

SEQ ID NO: 114071 - DNA, 601 bp, Human; identical to SEQ ID NO: 39392

SEQ ID NO: 114072 - DNA, 601 bp, Human; identical to SEQ ID NO: 39393

SEQ ID NO: 114073 - DNA, 601 bp, Human; identical to SEQ ID NO: 39394

SEQ ID NO: 114074 - DNA, 601 bp, Human; identical to SEQ ID NO: 39395

SEQ ID NO: 114075 - DNA, 601 bp, Human; identical to SEQ ID NO: 39396

SEQ ID NO: 114076 - DNA, 601 bp, Human; identical to SEQ ID NO: 39397

SEQ ID NO: 114077 - DNA, 601 bp, Human; identical to SEQ ID NO: 39398

SEQ ID NO: 114078 - DNA, 601 bp, Human; identical to SEQ ID NO: 39399

SEQ ID NO: 114079 - DNA, 601 bp, Human; identical to SEQ ID NO: 39400

SEQ ID NO: 114080 - DNA, 601 bp, Human; identical to SEQ ID NO: 39401

SEQ ID NO: 114081 - DNA, 601 bp, Human; identical to SEQ ID NO: 39402

SEQ ID NO: 114082 - DNA, 601 bp, Human; identical to SEQ ID NO: 39403

SEQ ID NO: 114083 - DNA, 601 bp, Human; identical to SEQ ID NO: 39404

SEQ ID NO: 114084 - DNA, 601 bp, Human; identical to SEQ ID NO: 39405

SEQ ID NO: 114085 - DNA, 601 bp, Human; identical to SEQ ID NO: 39406

SEQ ID NO: 114086 - DNA, 601 bp, Human; identical to SEQ ID NO: 39407

SEQ ID NO: 114087 - DNA, 601 bp, Human; identical to SEQ ID NO: 39408

SEQ ID NO: 114088 - DNA, 601 bp, Human; identical to SEQ ID NO: 39409

SEQ ID NO: 114089 - DNA, 601 bp, Human; identical to SEQ ID NO: 39410

SEQ ID NO: 114090 - DNA, 601 bp, Human; identical to SEQ ID NO: 113754

SEQ ID NO: 114091 - DNA, 601 bp, Human; identical to SEQ ID NO: 113755

SEQ ID NO: 114092 - DNA, 601 bp, Human; identical to SEQ ID NO: 113756

SEQ ID NO: 114093 - DNA, 601 bp, Human; identical to SEQ ID NO: 113757

SEQ ID NO: 114094 - DNA, 601 bp, Human; identical to SEQ ID NO: 113758

SEQ ID NO: 114095 - DNA, 601 bp, Human; identical to SEQ ID NO: 113759

SEQ ID NO: 114096 - DNA, 601 bp, Human; identical to SEQ ID NO: 113760

SEQ ID NO: 114097 - DNA, 601 bp, Human; identical to SEQ ID NO: 113761

SEQ ID NO: 114098 - DNA, 601 bp, Human; identical to SEQ ID NO: 113762

SEQ ID NO: 114099 - DNA, 601 bp, Human; identical to SEQ ID NO: 113763

SEQ ID NO: 114100 - DNA, 601 bp, Human; identical to SEQ ID NO: 113764

SEQ ID NO: 114101 - DNA, 601 bp, Human; identical to SEQ ID NO: 113765

SEQ ID NO: 114102 - DNA, 601 bp, Human; identical to SEQ ID NO: 113766

SEQ ID NO: 114103 - DNA, 601 bp, Human; identical to SEQ ID NO: 113767

SEQ ID NO: 114104 - DNA, 601 bp, Human; identical to SEQ ID NO: 113768

SEQ ID NO: 114105 - DNA, 601 bp, Human; identical to SEQ ID NO: 113769

SEQ ID NO: 114106 - DNA, 601 bp, Human; identical to SEQ ID NO: 113770

SEQ ID NO: 114107 - DNA, 601 bp, Human; identical to SEQ ID NO: 113771

SEQ ID NO: 114108 - DNA, 601 bp, Human; identical to SEQ ID NO: 113772

SEQ ID NO: 114109 - DNA, 601 bp, Human; identical to SEQ ID NO: 113773

SEQ ID NO: 114110 - DNA, 601 bp, Human; identical to SEQ ID NO: 113774

SEQ ID NO: 114111 - DNA, 601 bp, Human; identical to SEQ ID NO: 113775

SEQ ID NO: 114112 - DNA, 601 bp, Human; identical to SEQ ID NO: 113776

SEQ ID NO: 114113 - DNA, 601 bp, Human; identical to SEQ ID NO: 113777

SEQ ID NO: 114114 - DNA, 601 bp, Human; identical to SEQ ID NO: 113778

SEQ ID NO: 114115 - DNA, 601 bp, Human; identical to SEQ ID NO: 113779

SEQ ID NO: 114116 - DNA, 601 bp, Human; identical to SEQ ID NO: 113780

SEQ ID NO: 114117 - DNA, 601 bp, Human; identical to SEQ ID NO: 113781

SEQ ID NO: 114118 - DNA, 601 bp, Human; identical to SEQ ID NO: 113782

SEQ ID NO: 114119 - DNA, 601 bp, Human; identical to SEQ ID NO: 113783

SEQ ID NO: 114120 - DNA, 601 bp, Human; identical to SEQ ID NO: 113784

SEQ ID NO: 114121 - DNA, 601 bp, Human; identical to SEQ ID NO: 113785

SEQ ID NO: 114122 - DNA, 601 bp, Human; identical to SEQ ID NO: 113786

SEQ ID NO: 114123 - DNA, 601 bp, Human; identical to SEQ ID NO: 113787

SEQ ID NO: 114124 - DNA, 601 bp, Human; identical to SEQ ID NO: 113788

SEQ ID NO: 114125 - DNA, 601 bp, Human; identical to SEQ ID NO: 113789

SEQ ID NO: 114126 - DNA, 601 bp, Human; identical to SEQ ID NO: 113790

SEQ ID NO: 114127 - DNA, 601 bp, Human; identical to SEQ ID NO: 113791

SEQ ID NO: 114128 - DNA, 601 bp, Human; identical to SEQ ID NO: 113792

SEQ ID NO: 114129 - DNA, 601 bp, Human; identical to SEQ ID NO: 113793

SEQ ID NO: 114130 - DNA, 601 bp, Human; identical to SEQ ID NO: 113794

SEQ ID NO: 114131 - DNA, 601 bp, Human; identical to SEQ ID NO: 113795

SEQ ID NO: 114132 - DNA, 601 bp, Human; identical to SEQ ID NO: 113796

SEQ ID NO: 114133 - DNA, 601 bp, Human; identical to SEQ ID NO: 113797

SEQ ID NO: 114134 - DNA, 601 bp, Human; identical to SEQ ID NO: 113798

SEQ ID NO: 114135 - DNA, 601 bp, Human; identical to SEQ ID NO: 113799

SEQ ID NO: 114136 - DNA, 601 bp, Human; identical to SEQ ID NO: 113800

SEQ ID NO: 114137 - DNA, 601 bp, Human; identical to SEQ ID NO: 113801

SEQ ID NO: 114138 - DNA, 601 bp, Human; identical to SEQ ID NO: 113802

SEQ ID NO: 114139 - DNA, 601 bp, Human; identical to SEQ ID NO: 113803

SEQ ID NO: 114140 - DNA, 601 bp, Human; identical to SEQ ID NO: 113804

SEQ ID NO: 114141 - DNA, 601 bp, Human; identical to SEQ ID NO: 113805

SEQ ID NO: 114142 - DNA, 601 bp, Human; identical to SEQ ID NO: 113806

SEQ ID NO: 114143 - DNA, 601 bp, Human; identical to SEQ ID NO: 113807

SEQ ID NO: 114144 - DNA, 601 bp, Human; identical to SEQ ID NO: 113808

SEQ ID NO: 114145 - DNA, 601 bp, Human; identical to SEQ ID NO: 113809

SEQ ID NO: 114146 - DNA, 601 bp, Human; identical to SEQ ID NO: 113810

SEQ ID NO: 114147 - DNA, 601 bp, Human; identical to SEQ ID NO: 113811

SEQ ID NO: 114148 - DNA, 601 bp, Human; identical to SEQ ID NO: 113812

SEQ ID NO: 114149 - DNA, 601 bp, Human; identical to SEQ ID NO: 113813

SEQ ID NO: 114150 - DNA, 601 bp, Human; identical to SEQ ID NO: 113814

SEQ ID NO: 114151 - DNA, 601 bp, Human; identical to SEQ ID NO: 113815

SEQ ID NO: 114152 - DNA, 601 bp, Human; identical to SEQ ID NO: 113816

SEQ ID NO: 114153 - DNA, 601 bp, Human; identical to SEQ ID NO: 113817

SEQ ID NO: 114154 - DNA, 601 bp, Human; identical to SEQ ID NO: 113818

SEQ ID NO: 114155 - DNA, 601 bp, Human; identical to SEQ ID NO: 113819

SEQ ID NO: 114156 - DNA, 601 bp, Human; identical to SEQ ID NO: 113820

SEQ ID NO: 114157 - DNA, 601 bp, Human; identical to SEQ ID NO: 113821

SEQ ID NO: 114158 - DNA, 601 bp, Human; identical to SEQ ID NO: 113822

SEQ ID NO: 114159 - DNA, 601 bp, Human; identical to SEQ ID NO: 113823

SEQ ID NO: 114160 - DNA, 601 bp, Human; identical to SEQ ID NO: 113824

SEQ ID NO: 114161 - DNA, 601 bp, Human; identical to SEQ ID NO: 113825

SEQ ID NO: 114162 - DNA, 601 bp, Human; identical to SEQ ID NO: 113826

SEQ ID NO: 114163 - DNA, 601 bp, Human; identical to SEQ ID NO: 113827

SEQ ID NO: 114164 - DNA, 601 bp, Human; identical to SEQ ID NO: 113828

SEQ ID NO: 114165 - DNA, 601 bp, Human; identical to SEQ ID NO: 113829

SEQ ID NO: 114166 - DNA, 601 bp, Human; identical to SEQ ID NO: 113830

SEQ ID NO: 114167 - DNA, 601 bp, Human; identical to SEQ ID NO: 113831

SEQ ID NO: 114168 - DNA, 601 bp, Human; identical to SEQ ID NO: 113832

SEQ ID NO: 114169 - DNA, 601 bp, Human; identical to SEQ ID NO: 113833

SEQ ID NO: 114170 - DNA, 601 bp, Human; identical to SEQ ID NO: 113834

SEQ ID NO: 114171 - DNA, 601 bp, Human; identical to SEQ ID NO: 113835

SEQ ID NO: 114172 - DNA, 601 bp, Human; identical to SEQ ID NO: 113836

SEQ ID NO: 114173 - DNA, 601 bp, Human; identical to SEQ ID NO: 113837

SEQ ID NO: 114174 - DNA, 601 bp, Human; identical to SEQ ID NO: 113838

SEQ ID NO: 114175 - DNA, 601 bp, Human; identical to SEQ ID NO: 113839

SEQ ID NO: 114176 - DNA, 601 bp, Human; identical to SEQ ID NO: 113840

SEQ ID NO: 114177 - DNA, 601 bp, Human; identical to SEQ ID NO: 113841

SEQ ID NO: 114178 - DNA, 601 bp, Human; identical to SEQ ID NO: 113842

SEQ ID NO: 114179 - DNA, 601 bp, Human; identical to SEQ ID NO: 113843

SEQ ID NO: 114180 - DNA, 601 bp, Human; identical to SEQ ID NO: 113844

SEQ ID NO: 114181 - DNA, 601 bp, Human; identical to SEQ ID NO: 113845

SEQ ID NO: 114182 - DNA, 601 bp, Human; identical to SEQ ID NO: 113846

SEQ ID NO: 114183 - DNA, 601 bp, Human; identical to SEQ ID NO: 113847

SEQ ID NO: 114184 - DNA, 601 bp, Human; identical to SEQ ID NO: 113848

SEQ ID NO: 114185 - DNA, 601 bp, Human; identical to SEQ ID NO: 113849

SEQ ID NO: 114186 - DNA, 601 bp, Human; identical to SEQ ID NO: 113850

SEQ ID NO: 114187 - DNA, 601 bp, Human; identical to SEQ ID NO: 113851

SEQ ID NO: 114188 - DNA, 601 bp, Human; identical to SEQ ID NO: 113852

SEQ ID NO: 114189 - DNA, 601 bp, Human; identical to SEQ ID NO: 113853

SEQ ID NO: 114190 - DNA, 601 bp, Human; identical to SEQ ID NO: 113854

SEQ ID NO: 114191 - DNA, 601 bp, Human; identical to SEQ ID NO: 17663

SEQ ID NO: 114192 - DNA, 601 bp, Human; identical to SEQ ID NO: 17664

SEQ ID NO: 114193 - DNA, 601 bp, Human; identical to SEQ ID NO: 17665

SEQ ID NO: 114194 - DNA, 601 bp, Human; identical to SEQ ID NO: 17666

SEQ ID NO: 114195 - DNA, 601 bp, Human; identical to SEQ ID NO: 17667

SEQ ID NO: 114196 - DNA, 601 bp, Human; identical to SEQ ID NO: 17668

SEQ ID NO: 114197 - DNA, 601 bp, Human; identical to SEQ ID NO: 17669

SEQ ID NO: 114198 - DNA, 601 bp, Human; identical to SEQ ID NO: 17670

SEQ ID NO: 114199 - DNA, 601 bp, Human; identical to SEQ ID NO: 17671

SEQ ID NO: 114200 - DNA, 601 bp, Human; identical to SEQ ID NO: 17672

SEQ ID NO: 114201 - DNA, 601 bp, Human; identical to SEQ ID NO: 17673

SEQ ID NO: 114202 - DNA, 601 bp, Human; identical to SEQ ID NO: 17674

SEQ ID NO: 114203 - DNA, 601 bp, Human; identical to SEQ ID NO: 17675

SEQ ID NO: 114204 - DNA, 601 bp, Human; identical to SEQ ID NO: 17676

SEQ ID NO: 114205 - DNA, 601 bp, Human; identical to SEQ ID NO: 17677

SEQ ID NO: 114206 - DNA, 601 bp, Human; identical to SEQ ID NO: 17678

SEQ ID NO: 114207 - DNA, 601 bp, Human; identical to SEQ ID NO: 17679

SEQ ID NO: 114208 - DNA, 601 bp, Human; identical to SEQ ID NO: 17680

SEQ ID NO: 114209 - DNA, 601 bp, Human; identical to SEQ ID NO: 17681

SEQ ID NO: 114210 - DNA, 601 bp, Human; identical to SEQ ID NO: 17682

SEQ ID NO: 114211 - DNA, 601 bp, Human; identical to SEQ ID NO: 17683

SEQ ID NO: 114212 - DNA, 601 bp, Human; identical to SEQ ID NO: 17684

SEQ ID NO: 114213 - DNA, 601 bp, Human; identical to SEQ ID NO: 17685

SEQ ID NO: 114214 - DNA, 601 bp, Human; identical to SEQ ID NO: 17686

SEQ ID NO: 114215 - DNA, 601 bp, Human; identical to SEQ ID NO: 17687

SEQ ID NO: 114216 - DNA, 601 bp, Human; identical to SEQ ID NO: 17688

SEQ ID NO: 114217 - DNA, 601 bp, Human; identical to SEQ ID NO: 17689

SEQ ID NO: 114218 - DNA, 601 bp, Human; identical to SEQ ID NO: 17690

SEQ ID NO: 114219 - DNA, 601 bp, Human; identical to SEQ ID NO: 17691

SEQ ID NO: 114220 - DNA, 601 bp, Human; identical to SEQ ID NO: 17692

SEQ ID NO: 114221 - DNA, 601 bp, Human; identical to SEQ ID NO: 17693

SEQ ID NO: 114222 - DNA, 601 bp, Human; identical to SEQ ID NO: 17694

SEQ ID NO: 114223 - DNA, 601 bp, Human; identical to SEQ ID NO: 113887

SEQ ID NO: 114224 - DNA, 601 bp, Human; identical to SEQ ID NO: 113888

SEQ ID NO: 114225 - DNA, 601 bp, Human; identical to SEQ ID NO: 113889

SEQ ID NO: 114226 - DNA, 601 bp, Human; identical to SEQ ID NO: 113890

SEQ ID NO: 114227 - DNA, 601 bp, Human; identical to SEQ ID NO: 113891

SEQ ID NO: 114228 - DNA, 601 bp, Human; identical to SEQ ID NO: 113892

SEQ ID NO: 114229 - DNA, 601 bp, Human; identical to SEQ ID NO: 113893

SEQ ID NO: 114230 - DNA, 601 bp, Human; identical to SEQ ID NO: 113894

SEQ ID NO: 114231 - DNA, 601 bp, Human; identical to SEQ ID NO: 113895

SEQ ID NO: 114232 - DNA, 601 bp, Human; identical to SEQ ID NO: 113896

SEQ ID NO: 114233 - DNA, 601 bp, Human; identical to SEQ ID NO: 113897

SEQ ID NO: 114234 - DNA, 601 bp, Human; identical to SEQ ID NO: 113898

SEQ ID NO: 114235 - DNA, 601 bp, Human; identical to SEQ ID NO: 113899

SEQ ID NO: 114236 - DNA, 601 bp, Human; identical to SEQ ID NO: 113900

SEQ ID NO: 114237 - DNA, 601 bp, Human; identical to SEQ ID NO: 39390

SEQ ID NO: 114238 - DNA, 601 bp, Human; identical to SEQ ID NO: 39391

SEQ ID NO: 114239 - DNA, 601 bp, Human; identical to SEQ ID NO: 39392

SEQ ID NO: 114240 - DNA, 601 bp, Human; identical to SEQ ID NO: 39393

SEQ ID NO: 114241 - DNA, 601 bp, Human; identical to SEQ ID NO: 39394

SEQ ID NO: 114242 - DNA, 601 bp, Human; identical to SEQ ID NO: 39395

SEQ ID NO: 114243 - DNA, 601 bp, Human; identical to SEQ ID NO: 39396

SEQ ID NO: 114244 - DNA, 601 bp, Human; identical to SEQ ID NO: 39397

SEQ ID NO: 114245 - DNA, 601 bp, Human; identical to SEQ ID NO: 39398

SEQ ID NO: 114246 - DNA, 601 bp, Human; identical to SEQ ID NO: 39399

SEQ ID NO: 114247 - DNA, 601 bp, Human; identical to SEQ ID NO: 39400

SEQ ID NO: 114248 - DNA, 601 bp, Human; identical to SEQ ID NO: 39401

SEQ ID NO: 114249 - DNA, 601 bp, Human; identical to SEQ ID NO: 39402

SEQ ID NO: 114250 - DNA, 601 bp, Human; identical to SEQ ID NO: 39403

SEQ ID NO: 114251 - DNA, 601 bp, Human; identical to SEQ ID NO: 39404

SEQ ID NO: 114252 - DNA, 601 bp, Human; identical to SEQ ID NO: 39405

SEQ ID NO: 114253 - DNA, 601 bp, Human; identical to SEQ ID NO: 39406

SEQ ID NO: 114254 - DNA, 601 bp, Human; identical to SEQ ID NO: 39407

SEQ ID NO: 114255 - DNA, 601 bp, Human; identical to SEQ ID NO: 39408

SEQ ID NO: 114256 - DNA, 601 bp, Human; identical to SEQ ID NO: 39409

SEQ ID NO: 114257 - DNA, 601 bp, Human; identical to SEQ ID NO: 39410

SEQ ID NO: 114258 - DNA, 601 bp, Human; identical to SEQ ID NO: 113754

SEQ ID NO: 114259 - DNA, 601 bp, Human; identical to SEQ ID NO: 113755

SEQ ID NO: 114260 - DNA, 601 bp, Human; identical to SEQ ID NO: 113756

SEQ ID NO: 114261 - DNA, 601 bp, Human; identical to SEQ ID NO: 113757

SEQ ID NO: 114262 - DNA, 601 bp, Human; identical to SEQ ID NO: 113758

SEQ ID NO: 114263 - DNA, 601 bp, Human; identical to SEQ ID NO: 113759

SEQ ID NO: 114264 - DNA, 601 bp, Human; identical to SEQ ID NO: 113760

SEQ ID NO: 114265 - DNA, 601 bp, Human; identical to SEQ ID NO: 113761

SEQ ID NO: 114266 - DNA, 601 bp, Human; identical to SEQ ID NO: 113762

SEQ ID NO: 114267 - DNA, 601 bp, Human; identical to SEQ ID NO: 113763

SEQ ID NO: 114268 - DNA, 601 bp, Human; identical to SEQ ID NO: 113764

SEQ ID NO: 114269 - DNA, 601 bp, Human; identical to SEQ ID NO: 113765

SEQ ID NO: 114270 - DNA, 601 bp, Human; identical to SEQ ID NO: 113766

SEQ ID NO: 114271 - DNA, 601 bp, Human; identical to SEQ ID NO: 113767

SEQ ID NO: 114272 - DNA, 601 bp, Human; identical to SEQ ID NO: 113768

SEQ ID NO: 114273 - DNA, 601 bp, Human; identical to SEQ ID NO: 113769

SEQ ID NO: 114274 - DNA, 601 bp, Human; identical to SEQ ID NO: 113770

SEQ ID NO: 114275 - DNA, 601 bp, Human; identical to SEQ ID NO: 113771

SEQ ID NO: 114276 - DNA, 601 bp, Human; identical to SEQ ID NO: 113772

SEQ ID NO: 114277 - DNA, 601 bp, Human; identical to SEQ ID NO: 113773

SEQ ID NO: 114278 - DNA, 601 bp, Human; identical to SEQ ID NO: 113774

SEQ ID NO: 114279 - DNA, 601 bp, Human; identical to SEQ ID NO: 113775

SEQ ID NO: 114280 - DNA, 601 bp, Human; identical to SEQ ID NO: 113776

SEQ ID NO: 114281 - DNA, 601 bp, Human; identical to SEQ ID NO: 113777

SEQ ID NO: 114282 - DNA, 601 bp, Human; identical to SEQ ID NO: 113778

SEQ ID NO: 114283 - DNA, 601 bp, Human; identical to SEQ ID NO: 113779

SEQ ID NO: 114284 - DNA, 601 bp, Human; identical to SEQ ID NO: 113780

SEQ ID NO: 114285 - DNA, 601 bp, Human; identical to SEQ ID NO: 113781

SEQ ID NO: 114286 - DNA, 601 bp, Human; identical to SEQ ID NO: 113782

SEQ ID NO: 114287 - DNA, 601 bp, Human; identical to SEQ ID NO: 113783

SEQ ID NO: 114288 - DNA, 601 bp, Human; identical to SEQ ID NO: 113784

SEQ ID NO: 114289 - DNA, 601 bp, Human; identical to SEQ ID NO: 113785

SEQ ID NO: 114290 - DNA, 601 bp, Human; identical to SEQ ID NO: 113786

SEQ ID NO: 114291 - DNA, 601 bp, Human; identical to SEQ ID NO: 113787

SEQ ID NO: 114292 - DNA, 601 bp, Human; identical to SEQ ID NO: 113788

SEQ ID NO: 114293 - DNA, 601 bp, Human; identical to SEQ ID NO: 113789

SEQ ID NO: 114294 - DNA, 601 bp, Human; identical to SEQ ID NO: 113790

SEQ ID NO: 114295 - DNA, 601 bp, Human; identical to SEQ ID NO: 113791

SEQ ID NO: 114296 - DNA, 601 bp, Human; identical to SEQ ID NO: 113792

SEQ ID NO: 114297 - DNA, 601 bp, Human; identical to SEQ ID NO: 113793

SEQ ID NO: 114298 - DNA, 601 bp, Human; identical to SEQ ID NO: 113794

SEQ ID NO: 114299 - DNA, 601 bp, Human; identical to SEQ ID NO: 113795

SEQ ID NO: 114300 - DNA, 601 bp, Human; identical to SEQ ID NO: 113796

SEQ ID NO: 114301 - DNA, 601 bp, Human; identical to SEQ ID NO: 113797

SEQ ID NO: 114302 - DNA, 601 bp, Human; identical to SEQ ID NO: 113798

SEQ ID NO: 114303 - DNA, 601 bp, Human; identical to SEQ ID NO: 113799

SEQ ID NO: 114304 - DNA, 601 bp, Human; identical to SEQ ID NO: 113800

SEQ ID NO: 114305 - DNA, 601 bp, Human; identical to SEQ ID NO: 113801

SEQ ID NO: 114306 - DNA, 601 bp, Human; identical to SEQ ID NO: 113802

SEQ ID NO: 114307 - DNA, 601 bp, Human; identical to SEQ ID NO: 113803

SEQ ID NO: 114308 - DNA, 601 bp, Human; identical to SEQ ID NO: 113804

SEQ ID NO: 114309 - DNA, 601 bp, Human; identical to SEQ ID NO: 113805

SEQ ID NO: 114310 - DNA, 601 bp, Human; identical to SEQ ID NO: 113806

SEQ ID NO: 114311 - DNA, 601 bp, Human; identical to SEQ ID NO: 113807

SEQ ID NO: 114312 - DNA, 601 bp, Human; identical to SEQ ID NO: 113808

SEQ ID NO: 114313 - DNA, 601 bp, Human; identical to SEQ ID NO: 113809

SEQ ID NO: 114314 - DNA, 601 bp, Human; identical to SEQ ID NO: 113810

SEQ ID NO: 114315 - DNA, 601 bp, Human; identical to SEQ ID NO: 113811

SEQ ID NO: 114316 - DNA, 601 bp, Human; identical to SEQ ID NO: 113812

SEQ ID NO: 114317 - DNA, 601 bp, Human; identical to SEQ ID NO: 113813

SEQ ID NO: 114318 - DNA, 601 bp, Human; identical to SEQ ID NO: 113814

SEQ ID NO: 114319 - DNA, 601 bp, Human; identical to SEQ ID NO: 113815

SEQ ID NO: 114320 - DNA, 601 bp, Human; identical to SEQ ID NO: 113816

SEQ ID NO: 114321 - DNA, 601 bp, Human; identical to SEQ ID NO: 113817

SEQ ID NO: 114322 - DNA, 601 bp, Human; identical to SEQ ID NO: 113818

SEQ ID NO: 114323 - DNA, 601 bp, Human; identical to SEQ ID NO: 113819

SEQ ID NO: 114324 - DNA, 601 bp, Human; identical to SEQ ID NO: 113820

SEQ ID NO: 114325 - DNA, 601 bp, Human; identical to SEQ ID NO: 113821

SEQ ID NO: 114326 - DNA, 601 bp, Human; identical to SEQ ID NO: 113822

SEQ ID NO: 114327 - DNA, 601 bp, Human; identical to SEQ ID NO: 113823

SEQ ID NO: 114328 - DNA, 601 bp, Human; identical to SEQ ID NO: 113824

SEQ ID NO: 114329 - DNA, 601 bp, Human; identical to SEQ ID NO: 113825

SEQ ID NO: 114330 - DNA, 601 bp, Human; identical to SEQ ID NO: 113826

SEQ ID NO: 114331 - DNA, 601 bp, Human; identical to SEQ ID NO: 113827

SEQ ID NO: 114332 - DNA, 601 bp, Human; identical to SEQ ID NO: 113828

SEQ ID NO: 114333 - DNA, 601 bp, Human; identical to SEQ ID NO: 113829

SEQ ID NO: 114334 - DNA, 601 bp, Human; identical to SEQ ID NO: 113830

SEQ ID NO: 114335 - DNA, 601 bp, Human; identical to SEQ ID NO: 113831

SEQ ID NO: 114336 - DNA, 601 bp, Human; identical to SEQ ID NO: 113832

SEQ ID NO: 114337 - DNA, 601 bp, Human; identical to SEQ ID NO: 113833

SEQ ID NO: 114338 - DNA, 601 bp, Human; identical to SEQ ID NO: 113834

SEQ ID NO: 114339 - DNA, 601 bp, Human; identical to SEQ ID NO: 113835

SEQ ID NO: 114340 - DNA, 601 bp, Human; identical to SEQ ID NO: 113836

SEQ ID NO: 114341 - DNA, 601 bp, Human; identical to SEQ ID NO: 113837

SEQ ID NO: 114342 - DNA, 601 bp, Human; identical to SEQ ID NO: 113838

SEQ ID NO: 114343 - DNA, 601 bp, Human; identical to SEQ ID NO: 113839

SEQ ID NO: 114344 - DNA, 601 bp, Human; identical to SEQ ID NO: 113840

SEQ ID NO: 114345 - DNA, 601 bp, Human; identical to SEQ ID NO: 113841

SEQ ID NO: 114346 - DNA, 601 bp, Human; identical to SEQ ID NO: 113842

SEQ ID NO: 114347 - DNA, 601 bp, Human; identical to SEQ ID NO: 113843

SEQ ID NO: 114348 - DNA, 601 bp, Human; identical to SEQ ID NO: 113844

SEQ ID NO: 114349 - DNA, 601 bp, Human; identical to SEQ ID NO: 113845

SEQ ID NO: 114350 - DNA, 601 bp, Human; identical to SEQ ID NO: 113846

SEQ ID NO: 114351 - DNA, 601 bp, Human; identical to SEQ ID NO: 113847

SEQ ID NO: 114352 - DNA, 601 bp, Human; identical to SEQ ID NO: 113848

SEQ ID NO: 114353 - DNA, 601 bp, Human; identical to SEQ ID NO: 113849

SEQ ID NO: 114354 - DNA, 601 bp, Human; identical to SEQ ID NO: 113850

SEQ ID NO: 114355 - DNA, 601 bp, Human; identical to SEQ ID NO: 113851

SEQ ID NO: 114356 - DNA, 601 bp, Human; identical to SEQ ID NO: 113852

SEQ ID NO: 114357 - DNA, 601 bp, Human; identical to SEQ ID NO: 113853

SEQ ID NO: 114358 - DNA, 601 bp, Human; identical to SEQ ID NO: 113854

SEQ ID NO: 114359 - DNA, 601 bp, Human; identical to SEQ ID NO: 17663

SEQ ID NO: 114360 - DNA, 601 bp, Human; identical to SEQ ID NO: 17664

SEQ ID NO: 114361 - DNA, 601 bp, Human; identical to SEQ ID NO: 17665

SEQ ID NO: 114362 - DNA, 601 bp, Human; identical to SEQ ID NO: 17666

SEQ ID NO: 114363 - DNA, 601 bp, Human; identical to SEQ ID NO: 17667

SEQ ID NO: 114364 - DNA, 601 bp, Human; identical to SEQ ID NO: 17668

SEQ ID NO: 114365 - DNA, 601 bp, Human; identical to SEQ ID NO: 17669

SEQ ID NO: 114366 - DNA, 601 bp, Human; identical to SEQ ID NO: 17670

SEQ ID NO: 114367 - DNA, 601 bp, Human; identical to SEQ ID NO: 17671

SEQ ID NO: 114368 - DNA, 601 bp, Human; identical to SEQ ID NO: 17672

SEQ ID NO: 114369 - DNA, 601 bp, Human; identical to SEQ ID NO: 17673

SEQ ID NO: 114370 - DNA, 601 bp, Human; identical to SEQ ID NO: 17674

SEQ ID NO: 114371 - DNA, 601 bp, Human; identical to SEQ ID NO: 17675

SEQ ID NO: 114372 - DNA, 601 bp, Human; identical to SEQ ID NO: 17676

SEQ ID NO: 114373 - DNA, 601 bp, Human; identical to SEQ ID NO: 17677

SEQ ID NO: 114374 - DNA, 601 bp, Human; identical to SEQ ID NO: 17678

SEQ ID NO: 114375 - DNA, 601 bp, Human; identical to SEQ ID NO: 17679

SEQ ID NO: 114376 - DNA, 601 bp, Human; identical to SEQ ID NO: 17680

SEQ ID NO: 114377 - DNA, 601 bp, Human; identical to SEQ ID NO: 17681

SEQ ID NO: 114378 - DNA, 601 bp, Human; identical to SEQ ID NO: 17682

SEQ ID NO: 114379 - DNA, 601 bp, Human; identical to SEQ ID NO: 17683

SEQ ID NO: 114380 - DNA, 601 bp, Human; identical to SEQ ID NO: 17684

SEQ ID NO: 114381 - DNA, 601 bp, Human; identical to SEQ ID NO: 17685

SEQ ID NO: 114382 - DNA, 601 bp, Human; identical to SEQ ID NO: 17686

SEQ ID NO: 114383 - DNA, 601 bp, Human; identical to SEQ ID NO: 17687

SEQ ID NO: 114384 - DNA, 601 bp, Human; identical to SEQ ID NO: 17688

SEQ ID NO: 114385 - DNA, 601 bp, Human; identical to SEQ ID NO: 17689

SEQ ID NO: 114386 - DNA, 601 bp, Human; identical to SEQ ID NO: 17690

SEQ ID NO: 114387 - DNA, 601 bp, Human; identical to SEQ ID NO: 17691

SEQ ID NO: 114388 - DNA, 601 bp, Human; identical to SEQ ID NO: 17692

SEQ ID NO: 114389 - DNA, 601 bp, Human; identical to SEQ ID NO: 17693

SEQ ID NO: 114390 - DNA, 601 bp, Human; identical to SEQ ID NO: 17694

SEQ ID NO: 114391 - DNA, 601 bp, Human; identical to SEQ ID NO: 113887

SEQ ID NO: 114392 - DNA, 601 bp, Human; identical to SEQ ID NO: 113888

SEQ ID NO: 114393 - DNA, 601 bp, Human; identical to SEQ ID NO: 113889

SEQ ID NO: 114394 - DNA, 601 bp, Human; identical to SEQ ID NO: 113890

SEQ ID NO: 114395 - DNA, 601 bp, Human; identical to SEQ ID NO: 113891

SEQ ID NO: 114396 - DNA, 601 bp, Human; identical to SEQ ID NO: 113892

SEQ ID NO: 114397 - DNA, 601 bp, Human; identical to SEQ ID NO: 113893

SEQ ID NO: 114398 - DNA, 601 bp, Human; identical to SEQ ID NO: 113894

SEQ ID NO: 114399 - DNA, 601 bp, Human; identical to SEQ ID NO: 113895

SEQ ID NO: 114400 - DNA, 601 bp, Human; identical to SEQ ID NO: 113896

SEQ ID NO: 114401 - DNA, 601 bp, Human; identical to SEQ ID NO: 113897

SEQ ID NO: 114402 - DNA, 601 bp, Human; identical to SEQ ID NO: 113898

SEQ ID NO: 114403 - DNA, 601 bp, Human; identical to SEQ ID NO: 113899

SEQ ID NO: 114404 - DNA, 601 bp, Human; identical to SEQ ID NO: 113900

SEQ ID NO: 114405 - DNA, 601 bp, Human; identical to SEQ ID NO: 39390

SEQ ID NO: 114406 - DNA, 601 bp, Human; identical to SEQ ID NO: 39391

SEQ ID NO: 114407 - DNA, 601 bp, Human; identical to SEQ ID NO: 39392

SEQ ID NO: 114408 - DNA, 601 bp, Human; identical to SEQ ID NO: 39393

SEQ ID NO: 114409 - DNA, 601 bp, Human; identical to SEQ ID NO: 39394

SEQ ID NO: 114410 - DNA, 601 bp, Human; identical to SEQ ID NO: 39395

SEQ ID NO: 114411 - DNA, 601 bp, Human; identical to SEQ ID NO: 39396

SEQ ID NO: 114412 - DNA, 601 bp, Human; identical to SEQ ID NO: 39397

SEQ ID NO: 114413 - DNA, 601 bp, Human; identical to SEQ ID NO: 39398

SEQ ID NO: 114414 - DNA, 601 bp, Human; identical to SEQ ID NO: 39399

SEQ ID NO: 114415 - DNA, 601 bp, Human; identical to SEQ ID NO: 39400

SEQ ID NO: 114416 - DNA, 601 bp, Human; identical to SEQ ID NO: 39401

SEQ ID NO: 114417 - DNA, 601 bp, Human; identical to SEQ ID NO: 39402

SEQ ID NO: 114418 - DNA, 601 bp, Human; identical to SEQ ID NO: 39403

SEQ ID NO: 114419 - DNA, 601 bp, Human; identical to SEQ ID NO: 39404

SEQ ID NO: 114420 - DNA, 601 bp, Human; identical to SEQ ID NO: 39405

SEQ ID NO: 114421 - DNA, 601 bp, Human; identical to SEQ ID NO: 39406

SEQ ID NO: 114422 - DNA, 601 bp, Human; identical to SEQ ID NO: 39407

SEQ ID NO: 114423 - DNA, 601 bp, Human; identical to SEQ ID NO: 39408

SEQ ID NO: 114424 - DNA, 601 bp, Human; identical to SEQ ID NO: 39409

SEQ ID NO: 114425 - DNA, 601 bp, Human; identical to SEQ ID NO: 39410

SEQ ID NO: 114426 - DNA, 601 bp, Human; identical to SEQ ID NO: 113754

SEQ ID NO: 114427 - DNA, 601 bp, Human; identical to SEQ ID NO: 113755

SEQ ID NO: 114428 - DNA, 601 bp, Human; identical to SEQ ID NO: 113756

SEQ ID NO: 114429 - DNA, 601 bp, Human; identical to SEQ ID NO: 113757

SEQ ID NO: 114430 - DNA, 601 bp, Human; identical to SEQ ID NO: 113758

SEQ ID NO: 114431 - DNA, 601 bp, Human; identical to SEQ ID NO: 113759

SEQ ID NO: 114432 - DNA, 601 bp, Human; identical to SEQ ID NO: 113760

SEQ ID NO: 114433 - DNA, 601 bp, Human; identical to SEQ ID NO: 113761

SEQ ID NO: 114434 - DNA, 601 bp, Human; identical to SEQ ID NO: 113762

SEQ ID NO: 114435 - DNA, 601 bp, Human; identical to SEQ ID NO: 113763

SEQ ID NO: 114436 - DNA, 601 bp, Human; identical to SEQ ID NO: 113764

SEQ ID NO: 114437 - DNA, 601 bp, Human; identical to SEQ ID NO: 113765

SEQ ID NO: 114438 - DNA, 601 bp, Human; identical to SEQ ID NO: 113766

SEQ ID NO: 114439 - DNA, 601 bp, Human; identical to SEQ ID NO: 113767

SEQ ID NO: 114440 - DNA, 601 bp, Human; identical to SEQ ID NO: 113768

SEQ ID NO: 114441 - DNA, 601 bp, Human; identical to SEQ ID NO: 113769

SEQ ID NO: 114442 - DNA, 601 bp, Human; identical to SEQ ID NO: 113770

SEQ ID NO: 114443 - DNA, 601 bp, Human; identical to SEQ ID NO: 113771

SEQ ID NO: 114444 - DNA, 601 bp, Human; identical to SEQ ID NO: 113772

SEQ ID NO: 114445 - DNA, 601 bp, Human; identical to SEQ ID NO: 113773

SEQ ID NO: 114446 - DNA, 601 bp, Human; identical to SEQ ID NO: 113774

SEQ ID NO: 114447 - DNA, 601 bp, Human; identical to SEQ ID NO: 113775

SEQ ID NO: 114448 - DNA, 601 bp, Human; identical to SEQ ID NO: 113776

SEQ ID NO: 114449 - DNA, 601 bp, Human; identical to SEQ ID NO: 113777

SEQ ID NO: 114450 - DNA, 601 bp, Human; identical to SEQ ID NO: 113778

SEQ ID NO: 114451 - DNA, 601 bp, Human; identical to SEQ ID NO: 113779

SEQ ID NO: 114452 - DNA, 601 bp, Human; identical to SEQ ID NO: 113780

SEQ ID NO: 114453 - DNA, 601 bp, Human; identical to SEQ ID NO: 113781

SEQ ID NO: 114454 - DNA, 601 bp, Human; identical to SEQ ID NO: 113782

SEQ ID NO: 114455 - DNA, 601 bp, Human; identical to SEQ ID NO: 113783

SEQ ID NO: 114456 - DNA, 601 bp, Human; identical to SEQ ID NO: 113784

SEQ ID NO: 114457 - DNA, 601 bp, Human; identical to SEQ ID NO: 113785

SEQ ID NO: 114458 - DNA, 601 bp, Human; identical to SEQ ID NO: 113786

SEQ ID NO: 114459 - DNA, 601 bp, Human; identical to SEQ ID NO: 113787

SEQ ID NO: 114460 - DNA, 601 bp, Human; identical to SEQ ID NO: 113788

SEQ ID NO: 114461 - DNA, 601 bp, Human; identical to SEQ ID NO: 113789

SEQ ID NO: 114462 - DNA, 601 bp, Human; identical to SEQ ID NO: 113790

SEQ ID NO: 114463 - DNA, 601 bp, Human; identical to SEQ ID NO: 113791

SEQ ID NO: 114464 - DNA, 601 bp, Human; identical to SEQ ID NO: 113792

SEQ ID NO: 114465 - DNA, 601 bp, Human; identical to SEQ ID NO: 113793

SEQ ID NO: 114466 - DNA, 601 bp, Human; identical to SEQ ID NO: 113794

SEQ ID NO: 114467 - DNA, 601 bp, Human; identical to SEQ ID NO: 113795

SEQ ID NO: 114468 - DNA, 601 bp, Human; identical to SEQ ID NO: 113796

SEQ ID NO: 114469 - DNA, 601 bp, Human; identical to SEQ ID NO: 113797

SEQ ID NO: 114470 - DNA, 601 bp, Human; identical to SEQ ID NO: 113798

SEQ ID NO: 114471 - DNA, 601 bp, Human; identical to SEQ ID NO: 113799

SEQ ID NO: 114472 - DNA, 601 bp, Human; identical to SEQ ID NO: 113800

SEQ ID NO: 114473 - DNA, 601 bp, Human; identical to SEQ ID NO: 113801

SEQ ID NO: 114474 - DNA, 601 bp, Human; identical to SEQ ID NO: 113802

SEQ ID NO: 114475 - DNA, 601 bp, Human; identical to SEQ ID NO: 113803

SEQ ID NO: 114476 - DNA, 601 bp, Human; identical to SEQ ID NO: 113804

SEQ ID NO: 114477 - DNA, 601 bp, Human; identical to SEQ ID NO: 113805

SEQ ID NO: 114478 - DNA, 601 bp, Human; identical to SEQ ID NO: 113806

SEQ ID NO: 114479 - DNA, 601 bp, Human; identical to SEQ ID NO: 113807

SEQ ID NO: 114480 - DNA, 601 bp, Human; identical to SEQ ID NO: 113808

SEQ ID NO: 114481 - DNA, 601 bp, Human; identical to SEQ ID NO: 113809

SEQ ID NO: 114482 - DNA, 601 bp, Human; identical to SEQ ID NO: 113810

SEQ ID NO: 114483 - DNA, 601 bp, Human; identical to SEQ ID NO: 113811

SEQ ID NO: 114484 - DNA, 601 bp, Human; identical to SEQ ID NO: 113812

SEQ ID NO: 114485 - DNA, 601 bp, Human; identical to SEQ ID NO: 113813

SEQ ID NO: 114486 - DNA, 601 bp, Human; identical to SEQ ID NO: 113814

SEQ ID NO: 114487 - DNA, 601 bp, Human; identical to SEQ ID NO: 113815

SEQ ID NO: 114488 - DNA, 601 bp, Human; identical to SEQ ID NO: 113816

SEQ ID NO: 114489 - DNA, 601 bp, Human; identical to SEQ ID NO: 113817

SEQ ID NO: 114490 - DNA, 601 bp, Human; identical to SEQ ID NO: 113818

SEQ ID NO: 114491 - DNA, 601 bp, Human; identical to SEQ ID NO: 113819

SEQ ID NO: 114492 - DNA, 601 bp, Human; identical to SEQ ID NO: 113820

SEQ ID NO: 114493 - DNA, 601 bp, Human; identical to SEQ ID NO: 113821

SEQ ID NO: 114494 - DNA, 601 bp, Human; identical to SEQ ID NO: 113822

SEQ ID NO: 114495 - DNA, 601 bp, Human; identical to SEQ ID NO: 113823

SEQ ID NO: 114496 - DNA, 601 bp, Human; identical to SEQ ID NO: 113824

SEQ ID NO: 114497 - DNA, 601 bp, Human; identical to SEQ ID NO: 113825

SEQ ID NO: 114498 - DNA, 601 bp, Human; identical to SEQ ID NO: 113826

SEQ ID NO: 114499 - DNA, 601 bp, Human; identical to SEQ ID NO: 113827

SEQ ID NO: 114500 - DNA, 601 bp, Human; identical to SEQ ID NO: 113828

SEQ ID NO: 114501 - DNA, 601 bp, Human; identical to SEQ ID NO: 113829

SEQ ID NO: 114502 - DNA, 601 bp, Human; identical to SEQ ID NO: 113830

SEQ ID NO: 114503 - DNA, 601 bp, Human; identical to SEQ ID NO: 113831

SEQ ID NO: 114504 - DNA, 601 bp, Human; identical to SEQ ID NO: 113832

SEQ ID NO: 114505 - DNA, 601 bp, Human; identical to SEQ ID NO: 113833

SEQ ID NO: 114506 - DNA, 601 bp, Human; identical to SEQ ID NO: 113834

SEQ ID NO: 114507 - DNA, 601 bp, Human; identical to SEQ ID NO: 113835

SEQ ID NO: 114508 - DNA, 601 bp, Human; identical to SEQ ID NO: 113836

SEQ ID NO: 114509 - DNA, 601 bp, Human; identical to SEQ ID NO: 113837

SEQ ID NO: 114510 - DNA, 601 bp, Human; identical to SEQ ID NO: 113838

SEQ ID NO: 114511 - DNA, 601 bp, Human; identical to SEQ ID NO: 113839

SEQ ID NO: 114512 - DNA, 601 bp, Human; identical to SEQ ID NO: 113840

SEQ ID NO: 114513 - DNA, 601 bp, Human; identical to SEQ ID NO: 113841

SEQ ID NO: 114514 - DNA, 601 bp, Human; identical to SEQ ID NO: 113842

SEQ ID NO: 114515 - DNA, 601 bp, Human; identical to SEQ ID NO: 113843

SEQ ID NO: 114516 - DNA, 601 bp, Human; identical to SEQ ID NO: 113844

SEQ ID NO: 114517 - DNA, 601 bp, Human; identical to SEQ ID NO: 113845

SEQ ID NO: 114518 - DNA, 601 bp, Human; identical to SEQ ID NO: 113846

SEQ ID NO: 114519 - DNA, 601 bp, Human; identical to SEQ ID NO: 113847

SEQ ID NO: 114520 - DNA, 601 bp, Human; identical to SEQ ID NO: 113848

SEQ ID NO: 114521 - DNA, 601 bp, Human; identical to SEQ ID NO: 113849

SEQ ID NO: 114522 - DNA, 601 bp, Human; identical to SEQ ID NO: 113850

SEQ ID NO: 114523 - DNA, 601 bp, Human; identical to SEQ ID NO: 113851

SEQ ID NO: 114524 - DNA, 601 bp, Human; identical to SEQ ID NO: 113852

SEQ ID NO: 114525 - DNA, 601 bp, Human; identical to SEQ ID NO: 113853

SEQ ID NO: 114526 - DNA, 601 bp, Human; identical to SEQ ID NO: 113854

SEQ ID NO: 114527 - DNA, 601 bp, Human; identical to SEQ ID NO: 17663

SEQ ID NO: 114528 - DNA, 601 bp, Human; identical to SEQ ID NO: 17664

SEQ ID NO: 114529 - DNA, 601 bp, Human; identical to SEQ ID NO: 17665

SEQ ID NO: 114530 - DNA, 601 bp, Human; identical to SEQ ID NO: 17666

SEQ ID NO: 114531 - DNA, 601 bp, Human; identical to SEQ ID NO: 17667

SEQ ID NO: 114532 - DNA, 601 bp, Human; identical to SEQ ID NO: 17668

SEQ ID NO: 114533 - DNA, 601 bp, Human; identical to SEQ ID NO: 17669

SEQ ID NO: 114534 - DNA, 601 bp, Human; identical to SEQ ID NO: 17670

SEQ ID NO: 114535 - DNA, 601 bp, Human; identical to SEQ ID NO: 17671

SEQ ID NO: 114536 - DNA, 601 bp, Human; identical to SEQ ID NO: 17672

SEQ ID NO: 114537 - DNA, 601 bp, Human; identical to SEQ ID NO: 17673

SEQ ID NO: 114538 - DNA, 601 bp, Human; identical to SEQ ID NO: 17674

SEQ ID NO: 114539 - DNA, 601 bp, Human; identical to SEQ ID NO: 17675

SEQ ID NO: 114540 - DNA, 601 bp, Human; identical to SEQ ID NO: 17676

SEQ ID NO: 114541 - DNA, 601 bp, Human; identical to SEQ ID NO: 17677

SEQ ID NO: 114542 - DNA, 601 bp, Human; identical to SEQ ID NO: 17678

SEQ ID NO: 114543 - DNA, 601 bp, Human; identical to SEQ ID NO: 17679

SEQ ID NO: 114544 - DNA, 601 bp, Human; identical to SEQ ID NO: 17680

SEQ ID NO: 114545 - DNA, 601 bp, Human; identical to SEQ ID NO: 17681

SEQ ID NO: 114546 - DNA, 601 bp, Human; identical to SEQ ID NO: 17682

SEQ ID NO: 114547 - DNA, 601 bp, Human; identical to SEQ ID NO: 17683

SEQ ID NO: 114548 - DNA, 601 bp, Human; identical to SEQ ID NO: 17684

SEQ ID NO: 114549 - DNA, 601 bp, Human; identical to SEQ ID NO: 17685

SEQ ID NO: 114550 - DNA, 601 bp, Human; identical to SEQ ID NO: 17686

SEQ ID NO: 114551 - DNA, 601 bp, Human; identical to SEQ ID NO: 17687

SEQ ID NO: 114552 - DNA, 601 bp, Human; identical to SEQ ID NO: 17688

SEQ ID NO: 114553 - DNA, 601 bp, Human; identical to SEQ ID NO: 17689

SEQ ID NO: 114554 - DNA, 601 bp, Human; identical to SEQ ID NO: 17690

SEQ ID NO: 114555 - DNA, 601 bp, Human; identical to SEQ ID NO: 17691

SEQ ID NO: 114556 - DNA, 601 bp, Human; identical to SEQ ID NO: 17692

SEQ ID NO: 114557 - DNA, 601 bp, Human; identical to SEQ ID NO: 17693

SEQ ID NO: 114558 - DNA, 601 bp, Human; identical to SEQ ID NO: 17694

SEQ ID NO: 114559 - DNA, 601 bp, Human; identical to SEQ ID NO: 113887

SEQ ID NO: 114560 - DNA, 601 bp, Human; identical to SEQ ID NO: 113888

SEQ ID NO: 114561 - DNA, 601 bp, Human; identical to SEQ ID NO: 113889

SEQ ID NO: 114562 - DNA, 601 bp, Human; identical to SEQ ID NO: 113890

SEQ ID NO: 114563 - DNA, 601 bp, Human; identical to SEQ ID NO: 113891

SEQ ID NO: 114564 - DNA, 601 bp, Human; identical to SEQ ID NO: 113892

SEQ ID NO: 114565 - DNA, 601 bp, Human; identical to SEQ ID NO: 113893

SEQ ID NO: 114566 - DNA, 601 bp, Human; identical to SEQ ID NO: 113894

SEQ ID NO: 114567 - DNA, 601 bp, Human; identical to SEQ ID NO: 113895

SEQ ID NO: 114568 - DNA, 601 bp, Human; identical to SEQ ID NO: 113896

SEQ ID NO: 114569 - DNA, 601 bp, Human; identical to SEQ ID NO: 113897

SEQ ID NO: 114570 - DNA, 601 bp, Human; identical to SEQ ID NO: 113898

SEQ ID NO: 114571 - DNA, 601 bp, Human; identical to SEQ ID NO: 113899

SEQ ID NO: 114572 - DNA, 601 bp, Human; identical to SEQ ID NO: 113900

SEQ ID NO: 114573 - DNA, 601 bp, Human; identical to SEQ ID NO: 39390

SEQ ID NO: 114574 - DNA, 601 bp, Human; identical to SEQ ID NO: 39391

SEQ ID NO: 114575 - DNA, 601 bp, Human; identical to SEQ ID NO: 39392

SEQ ID NO: 114576 - DNA, 601 bp, Human; identical to SEQ ID NO: 39393

SEQ ID NO: 114577 - DNA, 601 bp, Human; identical to SEQ ID NO: 39394

SEQ ID NO: 114578 - DNA, 601 bp, Human; identical to SEQ ID NO: 39395

SEQ ID NO: 114579 - DNA, 601 bp, Human; identical to SEQ ID NO: 39396

SEQ ID NO: 114580 - DNA, 601 bp, Human; identical to SEQ ID NO: 39397

SEQ ID NO: 114581 - DNA, 601 bp, Human; identical to SEQ ID NO: 39398

SEQ ID NO: 114582 - DNA, 601 bp, Human; identical to SEQ ID NO: 39399

SEQ ID NO: 114583 - DNA, 601 bp, Human; identical to SEQ ID NO: 39400

SEQ ID NO: 114584 - DNA, 601 bp, Human; identical to SEQ ID NO: 39401

SEQ ID NO: 114585 - DNA, 601 bp, Human; identical to SEQ ID NO: 39402

SEQ ID NO: 114586 - DNA, 601 bp, Human; identical to SEQ ID NO: 39403

SEQ ID NO: 114587 - DNA, 601 bp, Human; identical to SEQ ID NO: 39404

SEQ ID NO: 114588 - DNA, 601 bp, Human; identical to SEQ ID NO: 39405

SEQ ID NO: 114589 - DNA, 601 bp, Human; identical to SEQ ID NO: 39406

SEQ ID NO: 114590 - DNA, 601 bp, Human; identical to SEQ ID NO: 39407

SEQ ID NO: 114591 - DNA, 601 bp, Human; identical to SEQ ID NO: 39408

SEQ ID NO: 114592 - DNA, 601 bp, Human; identical to SEQ ID NO: 39409

SEQ ID NO: 114593 - DNA, 601 bp, Human; identical to SEQ ID NO: 39410

SEQ ID NO: 114594 - DNA, 601 bp, Human; identical to SEQ ID NO: 113754

SEQ ID NO: 114595 - DNA, 601 bp, Human; identical to SEQ ID NO: 113755

SEQ ID NO: 114596 - DNA, 601 bp, Human; identical to SEQ ID NO: 113756

SEQ ID NO: 114597 - DNA, 601 bp, Human; identical to SEQ ID NO: 113757

SEQ ID NO: 114598 - DNA, 601 bp, Human; identical to SEQ ID NO: 113758

SEQ ID NO: 114599 - DNA, 601 bp, Human; identical to SEQ ID NO: 113759

SEQ ID NO: 114600 - DNA, 601 bp, Human; identical to SEQ ID NO: 113760

SEQ ID NO: 114601 - DNA, 601 bp, Human; identical to SEQ ID NO: 113761

SEQ ID NO: 114602 - DNA, 601 bp, Human; identical to SEQ ID NO: 113762

SEQ ID NO: 114603 - DNA, 601 bp, Human; identical to SEQ ID NO: 113763

SEQ ID NO: 114604 - DNA, 601 bp, Human; identical to SEQ ID NO: 113764

SEQ ID NO: 114605 - DNA, 601 bp, Human; identical to SEQ ID NO: 113765

SEQ ID NO: 114606 - DNA, 601 bp, Human; identical to SEQ ID NO: 113766

SEQ ID NO: 114607 - DNA, 601 bp, Human; identical to SEQ ID NO: 113767

SEQ ID NO: 114608 - DNA, 601 bp, Human; identical to SEQ ID NO: 113768

SEQ ID NO: 114609 - DNA, 601 bp, Human; identical to SEQ ID NO: 113769

SEQ ID NO: 114610 - DNA, 601 bp, Human; identical to SEQ ID NO: 113770

SEQ ID NO: 114611 - DNA, 601 bp, Human; identical to SEQ ID NO: 113771

SEQ ID NO: 114612 - DNA, 601 bp, Human; identical to SEQ ID NO: 113772

SEQ ID NO: 114613 - DNA, 601 bp, Human; identical to SEQ ID NO: 113773

SEQ ID NO: 114614 - DNA, 601 bp, Human; identical to SEQ ID NO: 113774

SEQ ID NO: 114615 - DNA, 601 bp, Human; identical to SEQ ID NO: 113775

SEQ ID NO: 114616 - DNA, 601 bp, Human; identical to SEQ ID NO: 113776

SEQ ID NO: 114617 - DNA, 601 bp, Human; identical to SEQ ID NO: 113777

SEQ ID NO: 114618 - DNA, 601 bp, Human; identical to SEQ ID NO: 113778

SEQ ID NO: 114619 - DNA, 601 bp, Human; identical to SEQ ID NO: 113779

SEQ ID NO: 114620 - DNA, 601 bp, Human; identical to SEQ ID NO: 113780

SEQ ID NO: 114621 - DNA, 601 bp, Human; identical to SEQ ID NO: 113781

SEQ ID NO: 114622 - DNA, 601 bp, Human; identical to SEQ ID NO: 113782

SEQ ID NO: 114623 - DNA, 601 bp, Human; identical to SEQ ID NO: 113783

SEQ ID NO: 114624 - DNA, 601 bp, Human; identical to SEQ ID NO: 113784

SEQ ID NO: 114625 - DNA, 601 bp, Human; identical to SEQ ID NO: 113785

SEQ ID NO: 114626 - DNA, 601 bp, Human; identical to SEQ ID NO: 113786

SEQ ID NO: 114627 - DNA, 601 bp, Human; identical to SEQ ID NO: 113787

SEQ ID NO: 114628 - DNA, 601 bp, Human; identical to SEQ ID NO: 113788

SEQ ID NO: 114629 - DNA, 601 bp, Human; identical to SEQ ID NO: 113789

SEQ ID NO: 114630 - DNA, 601 bp, Human; identical to SEQ ID NO: 113790

SEQ ID NO: 114631 - DNA, 601 bp, Human; identical to SEQ ID NO: 113791

SEQ ID NO: 114632 - DNA, 601 bp, Human; identical to SEQ ID NO: 113792

SEQ ID NO: 114633 - DNA, 601 bp, Human; identical to SEQ ID NO: 113793

SEQ ID NO: 114634 - DNA, 601 bp, Human; identical to SEQ ID NO: 113794

SEQ ID NO: 114635 - DNA, 601 bp, Human; identical to SEQ ID NO: 113795

SEQ ID NO: 114636 - DNA, 601 bp, Human; identical to SEQ ID NO: 113796

SEQ ID NO: 114637 - DNA, 601 bp, Human; identical to SEQ ID NO: 113797

SEQ ID NO: 114638 - DNA, 601 bp, Human; identical to SEQ ID NO: 113798

SEQ ID NO: 114639 - DNA, 601 bp, Human; identical to SEQ ID NO: 113799

SEQ ID NO: 114640 - DNA, 601 bp, Human; identical to SEQ ID NO: 113800

SEQ ID NO: 114641 - DNA, 601 bp, Human; identical to SEQ ID NO: 113801

SEQ ID NO: 114642 - DNA, 601 bp, Human; identical to SEQ ID NO: 113802

SEQ ID NO: 114643 - DNA, 601 bp, Human; identical to SEQ ID NO: 113803

SEQ ID NO: 114644 - DNA, 601 bp, Human; identical to SEQ ID NO: 113804

SEQ ID NO: 114645 - DNA, 601 bp, Human; identical to SEQ ID NO: 113805

SEQ ID NO: 114646 - DNA, 601 bp, Human; identical to SEQ ID NO: 113806

SEQ ID NO: 114647 - DNA, 601 bp, Human; identical to SEQ ID NO: 113807

SEQ ID NO: 114648 - DNA, 601 bp, Human; identical to SEQ ID NO: 113808

SEQ ID NO: 114649 - DNA, 601 bp, Human; identical to SEQ ID NO: 113809

SEQ ID NO: 114650 - DNA, 601 bp, Human; identical to SEQ ID NO: 113810

SEQ ID NO: 114651 - DNA, 601 bp, Human; identical to SEQ ID NO: 113811

SEQ ID NO: 114652 - DNA, 601 bp, Human; identical to SEQ ID NO: 113812

SEQ ID NO: 114653 - DNA, 601 bp, Human; identical to SEQ ID NO: 113813

SEQ ID NO: 114654 - DNA, 601 bp, Human; identical to SEQ ID NO: 113814

SEQ ID NO: 114655 - DNA, 601 bp, Human; identical to SEQ ID NO: 113815

SEQ ID NO: 114656 - DNA, 601 bp, Human; identical to SEQ ID NO: 113816

SEQ ID NO: 114657 - DNA, 601 bp, Human; identical to SEQ ID NO: 113817

SEQ ID NO: 114658 - DNA, 601 bp, Human; identical to SEQ ID NO: 113818

SEQ ID NO: 114659 - DNA, 601 bp, Human; identical to SEQ ID NO: 113819

SEQ ID NO: 114660 - DNA, 601 bp, Human; identical to SEQ ID NO: 113820

SEQ ID NO: 114661 - DNA, 601 bp, Human; identical to SEQ ID NO: 113821

SEQ ID NO: 114662 - DNA, 601 bp, Human; identical to SEQ ID NO: 113822

SEQ ID NO: 114663 - DNA, 601 bp, Human; identical to SEQ ID NO: 113823

SEQ ID NO: 114664 - DNA, 601 bp, Human; identical to SEQ ID NO: 113824

SEQ ID NO: 114665 - DNA, 601 bp, Human; identical to SEQ ID NO: 113825

SEQ ID NO: 114666 - DNA, 601 bp, Human; identical to SEQ ID NO: 113826

SEQ ID NO: 114667 - DNA, 601 bp, Human; identical to SEQ ID NO: 113827

SEQ ID NO: 114668 - DNA, 601 bp, Human; identical to SEQ ID NO: 113828

SEQ ID NO: 114669 - DNA, 601 bp, Human; identical to SEQ ID NO: 113829

SEQ ID NO: 114670 - DNA, 601 bp, Human; identical to SEQ ID NO: 113830

SEQ ID NO: 114671 - DNA, 601 bp, Human; identical to SEQ ID NO: 113831

SEQ ID NO: 114672 - DNA, 601 bp, Human; identical to SEQ ID NO: 113832

SEQ ID NO: 114673 - DNA, 601 bp, Human; identical to SEQ ID NO: 113833

SEQ ID NO: 114674 - DNA, 601 bp, Human; identical to SEQ ID NO: 113834

SEQ ID NO: 114675 - DNA, 601 bp, Human; identical to SEQ ID NO: 113835

SEQ ID NO: 114676 - DNA, 601 bp, Human; identical to SEQ ID NO: 113836

SEQ ID NO: 114677 - DNA, 601 bp, Human; identical to SEQ ID NO: 113837

SEQ ID NO: 114678 - DNA, 601 bp, Human; identical to SEQ ID NO: 113838

SEQ ID NO: 114679 - DNA, 601 bp, Human; identical to SEQ ID NO: 113839

SEQ ID NO: 114680 - DNA, 601 bp, Human; identical to SEQ ID NO: 113840

SEQ ID NO: 114681 - DNA, 601 bp, Human; identical to SEQ ID NO: 113841

SEQ ID NO: 114682 - DNA, 601 bp, Human; identical to SEQ ID NO: 113842

SEQ ID NO: 114683 - DNA, 601 bp, Human; identical to SEQ ID NO: 113843

SEQ ID NO: 114684 - DNA, 601 bp, Human; identical to SEQ ID NO: 113844

SEQ ID NO: 114685 - DNA, 601 bp, Human; identical to SEQ ID NO: 113845

SEQ ID NO: 114686 - DNA, 601 bp, Human; identical to SEQ ID NO: 113846

SEQ ID NO: 114687 - DNA, 601 bp, Human; identical to SEQ ID NO: 113847

SEQ ID NO: 114688 - DNA, 601 bp, Human; identical to SEQ ID NO: 113848

SEQ ID NO: 114689 - DNA, 601 bp, Human; identical to SEQ ID NO: 113849

SEQ ID NO: 114690 - DNA, 601 bp, Human; identical to SEQ ID NO: 113850

SEQ ID NO: 114691 - DNA, 601 bp, Human; identical to SEQ ID NO: 113851

SEQ ID NO: 114692 - DNA, 601 bp, Human; identical to SEQ ID NO: 113852

SEQ ID NO: 114693 - DNA, 601 bp, Human; identical to SEQ ID NO: 113853

SEQ ID NO: 114694 - DNA, 601 bp, Human; identical to SEQ ID NO: 113854

SEQ ID NO: 114695 - DNA, 601 bp, Human; identical to SEQ ID NO: 17663

SEQ ID NO: 114696 - DNA, 601 bp, Human; identical to SEQ ID NO: 17664

SEQ ID NO: 114697 - DNA, 601 bp, Human; identical to SEQ ID NO: 17665

SEQ ID NO: 114698 - DNA, 601 bp, Human; identical to SEQ ID NO: 17666

SEQ ID NO: 114699 - DNA, 601 bp, Human; identical to SEQ ID NO: 17667

SEQ ID NO: 114700 - DNA, 601 bp, Human; identical to SEQ ID NO: 17668

SEQ ID NO: 114701 - DNA, 601 bp, Human; identical to SEQ ID NO: 17669

SEQ ID NO: 114702 - DNA, 601 bp, Human; identical to SEQ ID NO: 17670

SEQ ID NO: 114703 - DNA, 601 bp, Human; identical to SEQ ID NO: 17671

SEQ ID NO: 114704 - DNA, 601 bp, Human; identical to SEQ ID NO: 17672

SEQ ID NO: 114705 - DNA, 601 bp, Human; identical to SEQ ID NO: 17673

SEQ ID NO: 114706 - DNA, 601 bp, Human; identical to SEQ ID NO: 17674

SEQ ID NO: 114707 - DNA, 601 bp, Human; identical to SEQ ID NO: 17675

SEQ ID NO: 114708 - DNA, 601 bp, Human; identical to SEQ ID NO: 17676

SEQ ID NO: 114709 - DNA, 601 bp, Human; identical to SEQ ID NO: 17677

SEQ ID NO: 114710 - DNA, 601 bp, Human; identical to SEQ ID NO: 17678

SEQ ID NO: 114711 - DNA, 601 bp, Human; identical to SEQ ID NO: 17679

SEQ ID NO: 114712 - DNA, 601 bp, Human; identical to SEQ ID NO: 17680

SEQ ID NO: 114713 - DNA, 601 bp, Human; identical to SEQ ID NO: 17681

SEQ ID NO: 114714 - DNA, 601 bp, Human; identical to SEQ ID NO: 17682

SEQ ID NO: 114715 - DNA, 601 bp, Human; identical to SEQ ID NO: 17683

SEQ ID NO: 114716 - DNA, 601 bp, Human; identical to SEQ ID NO: 17684

SEQ ID NO: 114717 - DNA, 601 bp, Human; identical to SEQ ID NO: 17685

SEQ ID NO: 114718 - DNA, 601 bp, Human; identical to SEQ ID NO: 17686

SEQ ID NO: 114719 - DNA, 601 bp, Human; identical to SEQ ID NO: 17687

SEQ ID NO: 114720 - DNA, 601 bp, Human; identical to SEQ ID NO: 17688

SEQ ID NO: 114721 - DNA, 601 bp, Human; identical to SEQ ID NO: 17689

SEQ ID NO: 114722 - DNA, 601 bp, Human; identical to SEQ ID NO: 17690

SEQ ID NO: 114723 - DNA, 601 bp, Human; identical to SEQ ID NO: 17691

SEQ ID NO: 114724 - DNA, 601 bp, Human; identical to SEQ ID NO: 17692

SEQ ID NO: 114725 - DNA, 601 bp, Human; identical to SEQ ID NO: 17693

SEQ ID NO: 114726 - DNA, 601 bp, Human; identical to SEQ ID NO: 17694

SEQ ID NO: 114727 - DNA, 601 bp, Human; identical to SEQ ID NO: 113887

SEQ ID NO: 114728 - DNA, 601 bp, Human; identical to SEQ ID NO: 113888

SEQ ID NO: 114729 - DNA, 601 bp, Human; identical to SEQ ID NO: 113889

SEQ ID NO: 114730 - DNA, 601 bp, Human; identical to SEQ ID NO: 113890

SEQ ID NO: 114731 - DNA, 601 bp, Human; identical to SEQ ID NO: 113891

SEQ ID NO: 114732 - DNA, 601 bp, Human; identical to SEQ ID NO: 113892

SEQ ID NO: 114733 - DNA, 601 bp, Human; identical to SEQ ID NO: 113893

SEQ ID NO: 114734 - DNA, 601 bp, Human; identical to SEQ ID NO: 113894

SEQ ID NO: 114735 - DNA, 601 bp, Human; identical to SEQ ID NO: 113895

SEQ ID NO: 114736 - DNA, 601 bp, Human; identical to SEQ ID NO: 113896

SEQ ID NO: 114737 - DNA, 601 bp, Human; identical to SEQ ID NO: 113897

SEQ ID NO: 114738 - DNA, 601 bp, Human; identical to SEQ ID NO: 113898

SEQ ID NO: 114739 - DNA, 601 bp, Human; identical to SEQ ID NO: 113899

SEQ ID NO: 114740 - DNA, 601 bp, Human; identical to SEQ ID NO: 113900

SEQ ID NO: 114741 - DNA, 601 bp, Human; identical to SEQ ID NO: 39390

SEQ ID NO: 114742 - DNA, 601 bp, Human; identical to SEQ ID NO: 39391

SEQ ID NO: 114743 - DNA, 601 bp, Human; identical to SEQ ID NO: 39392

SEQ ID NO: 114744 - DNA, 601 bp, Human; identical to SEQ ID NO: 39393

SEQ ID NO: 114745 - DNA, 601 bp, Human; identical to SEQ ID NO: 39394

SEQ ID NO: 114746 - DNA, 601 bp, Human; identical to SEQ ID NO: 39395

SEQ ID NO: 114747 - DNA, 601 bp, Human; identical to SEQ ID NO: 39396

SEQ ID NO: 114748 - DNA, 601 bp, Human; identical to SEQ ID NO: 39397

SEQ ID NO: 114749 - DNA, 601 bp, Human; identical to SEQ ID NO: 39398

SEQ ID NO: 114750 - DNA, 601 bp, Human; identical to SEQ ID NO: 39399

SEQ ID NO: 114751 - DNA, 601 bp, Human; identical to SEQ ID NO: 39400

SEQ ID NO: 114752 - DNA, 601 bp, Human; identical to SEQ ID NO: 39401

SEQ ID NO: 114753 - DNA, 601 bp, Human; identical to SEQ ID NO: 39402

SEQ ID NO: 114754 - DNA, 601 bp, Human; identical to SEQ ID NO: 39403

SEQ ID NO: 114755 - DNA, 601 bp, Human; identical to SEQ ID NO: 39404

SEQ ID NO: 114756 - DNA, 601 bp, Human; identical to SEQ ID NO: 39405

SEQ ID NO: 114757 - DNA, 601 bp, Human; identical to SEQ ID NO: 39406

SEQ ID NO: 114758 - DNA, 601 bp, Human; identical to SEQ ID NO: 39407

SEQ ID NO: 114759 - DNA, 601 bp, Human; identical to SEQ ID NO: 39408

SEQ ID NO: 114760 - DNA, 601 bp, Human; identical to SEQ ID NO: 39409

SEQ ID NO: 114761 - DNA, 601 bp, Human; identical to SEQ ID NO: 39410

SEQ ID NO: 114762 - DNA, 601 bp, Human; identical to SEQ ID NO: 113754

SEQ ID NO: 114763 - DNA, 601 bp, Human; identical to SEQ ID NO: 113755

SEQ ID NO: 114764 - DNA, 601 bp, Human; identical to SEQ ID NO: 113756

SEQ ID NO: 114765 - DNA, 601 bp, Human; identical to SEQ ID NO: 113757

SEQ ID NO: 114766 - DNA, 601 bp, Human; identical to SEQ ID NO: 113758

SEQ ID NO: 114767 - DNA, 601 bp, Human; identical to SEQ ID NO: 113759

SEQ ID NO: 114768 - DNA, 601 bp, Human; identical to SEQ ID NO: 113760

SEQ ID NO: 114769 - DNA, 601 bp, Human; identical to SEQ ID NO: 113761

SEQ ID NO: 114770 - DNA, 601 bp, Human; identical to SEQ ID NO: 113762

SEQ ID NO: 114771 - DNA, 601 bp, Human; identical to SEQ ID NO: 113763

SEQ ID NO: 114772 - DNA, 601 bp, Human; identical to SEQ ID NO: 113764

SEQ ID NO: 114773 - DNA, 601 bp, Human; identical to SEQ ID NO: 113765

SEQ ID NO: 114774 - DNA, 601 bp, Human; identical to SEQ ID NO: 113766

SEQ ID NO: 114775 - DNA, 601 bp, Human; identical to SEQ ID NO: 113767

SEQ ID NO: 114776 - DNA, 601 bp, Human; identical to SEQ ID NO: 113768

SEQ ID NO: 114777 - DNA, 601 bp, Human; identical to SEQ ID NO: 113769

SEQ ID NO: 114778 - DNA, 601 bp, Human; identical to SEQ ID NO: 113770

SEQ ID NO: 114779 - DNA, 601 bp, Human; identical to SEQ ID NO: 113771

SEQ ID NO: 114780 - DNA, 601 bp, Human; identical to SEQ ID NO: 113772

SEQ ID NO: 114781 - DNA, 601 bp, Human; identical to SEQ ID NO: 113773

SEQ ID NO: 114782 - DNA, 601 bp, Human; identical to SEQ ID NO: 113774

SEQ ID NO: 114783 - DNA, 601 bp, Human; identical to SEQ ID NO: 113775

SEQ ID NO: 114784 - DNA, 601 bp, Human; identical to SEQ ID NO: 113776

SEQ ID NO: 114785 - DNA, 601 bp, Human; identical to SEQ ID NO: 113777

SEQ ID NO: 114786 - DNA, 601 bp, Human; identical to SEQ ID NO: 113778

SEQ ID NO: 114787 - DNA, 601 bp, Human; identical to SEQ ID NO: 113779

SEQ ID NO: 114788 - DNA, 601 bp, Human; identical to SEQ ID NO: 113780

SEQ ID NO: 114789 - DNA, 601 bp, Human; identical to SEQ ID NO: 113781

SEQ ID NO: 114790 - DNA, 601 bp, Human; identical to SEQ ID NO: 113782

SEQ ID NO: 114791 - DNA, 601 bp, Human; identical to SEQ ID NO: 113783

SEQ ID NO: 114792 - DNA, 601 bp, Human; identical to SEQ ID NO: 113784

SEQ ID NO: 114793 - DNA, 601 bp, Human; identical to SEQ ID NO: 113785

SEQ ID NO: 114794 - DNA, 601 bp, Human; identical to SEQ ID NO: 113786

SEQ ID NO: 114795 - DNA, 601 bp, Human; identical to SEQ ID NO: 113787

SEQ ID NO: 114796 - DNA, 601 bp, Human; identical to SEQ ID NO: 113788

SEQ ID NO: 114797 - DNA, 601 bp, Human; identical to SEQ ID NO: 113789

SEQ ID NO: 114798 - DNA, 601 bp, Human; identical to SEQ ID NO: 113790

SEQ ID NO: 114799 - DNA, 601 bp, Human; identical to SEQ ID NO: 113791

SEQ ID NO: 114800 - DNA, 601 bp, Human; identical to SEQ ID NO: 113792

SEQ ID NO: 114801 - DNA, 601 bp, Human; identical to SEQ ID NO: 113793

SEQ ID NO: 114802 - DNA, 601 bp, Human; identical to SEQ ID NO: 113794

SEQ ID NO: 114803 - DNA, 601 bp, Human; identical to SEQ ID NO: 113795

SEQ ID NO: 114804 - DNA, 601 bp, Human; identical to SEQ ID NO: 113796

SEQ ID NO: 114805 - DNA, 601 bp, Human; identical to SEQ ID NO: 113797

SEQ ID NO: 114806 - DNA, 601 bp, Human; identical to SEQ ID NO: 113798

SEQ ID NO: 114807 - DNA, 601 bp, Human; identical to SEQ ID NO: 113799

SEQ ID NO: 114808 - DNA, 601 bp, Human; identical to SEQ ID NO: 113800

SEQ ID NO: 114809 - DNA, 601 bp, Human; identical to SEQ ID NO: 113801

SEQ ID NO: 114810 - DNA, 601 bp, Human; identical to SEQ ID NO: 113802

SEQ ID NO: 114811 - DNA, 601 bp, Human; identical to SEQ ID NO: 113803

SEQ ID NO: 114812 - DNA, 601 bp, Human; identical to SEQ ID NO: 113804

SEQ ID NO: 114813 - DNA, 601 bp, Human; identical to SEQ ID NO: 113805

SEQ ID NO: 114814 - DNA, 601 bp, Human; identical to SEQ ID NO: 113806

SEQ ID NO: 114815 - DNA, 601 bp, Human; identical to SEQ ID NO: 113807

SEQ ID NO: 114816 - DNA, 601 bp, Human; identical to SEQ ID NO: 113808

SEQ ID NO: 114817 - DNA, 601 bp, Human; identical to SEQ ID NO: 113809

SEQ ID NO: 114818 - DNA, 601 bp, Human; identical to SEQ ID NO: 113810

SEQ ID NO: 114819 - DNA, 601 bp, Human; identical to SEQ ID NO: 113811

SEQ ID NO: 114820 - DNA, 601 bp, Human; identical to SEQ ID NO: 113812

SEQ ID NO: 114821 - DNA, 601 bp, Human; identical to SEQ ID NO: 113813

SEQ ID NO: 114822 - DNA, 601 bp, Human; identical to SEQ ID NO: 113814

SEQ ID NO: 114823 - DNA, 601 bp, Human; identical to SEQ ID NO: 113815

SEQ ID NO: 114824 - DNA, 601 bp, Human; identical to SEQ ID NO: 113816

SEQ ID NO: 114825 - DNA, 601 bp, Human; identical to SEQ ID NO: 113817

SEQ ID NO: 114826 - DNA, 601 bp, Human; identical to SEQ ID NO: 113818

SEQ ID NO: 114827 - DNA, 601 bp, Human; identical to SEQ ID NO: 113819

SEQ ID NO: 114828 - DNA, 601 bp, Human; identical to SEQ ID NO: 113820

SEQ ID NO: 114829 - DNA, 601 bp, Human; identical to SEQ ID NO: 113821

SEQ ID NO: 114830 - DNA, 601 bp, Human; identical to SEQ ID NO: 113822

SEQ ID NO: 114831 - DNA, 601 bp, Human; identical to SEQ ID NO: 113823

SEQ ID NO: 114832 - DNA, 601 bp, Human; identical to SEQ ID NO: 113824

SEQ ID NO: 114833 - DNA, 601 bp, Human; identical to SEQ ID NO: 113825

SEQ ID NO: 114834 - DNA, 601 bp, Human; identical to SEQ ID NO: 113826

SEQ ID NO: 114835 - DNA, 601 bp, Human; identical to SEQ ID NO: 113827

SEQ ID NO: 114836 - DNA, 601 bp, Human; identical to SEQ ID NO: 113828

SEQ ID NO: 114837 - DNA, 601 bp, Human; identical to SEQ ID NO: 113829

SEQ ID NO: 114838 - DNA, 601 bp, Human; identical to SEQ ID NO: 113830

SEQ ID NO: 114839 - DNA, 601 bp, Human; identical to SEQ ID NO: 113831

SEQ ID NO: 114840 - DNA, 601 bp, Human; identical to SEQ ID NO: 113832

SEQ ID NO: 114841 - DNA, 601 bp, Human; identical to SEQ ID NO: 113833

SEQ ID NO: 114842 - DNA, 601 bp, Human; identical to SEQ ID NO: 113834

SEQ ID NO: 114843 - DNA, 601 bp, Human; identical to SEQ ID NO: 113835

SEQ ID NO: 114844 - DNA, 601 bp, Human; identical to SEQ ID NO: 113836

SEQ ID NO: 114845 - DNA, 601 bp, Human; identical to SEQ ID NO: 113837

SEQ ID NO: 114846 - DNA, 601 bp, Human; identical to SEQ ID NO: 113838

SEQ ID NO: 114847 - DNA, 601 bp, Human; identical to SEQ ID NO: 113839

SEQ ID NO: 114848 - DNA, 601 bp, Human; identical to SEQ ID NO: 113840

SEQ ID NO: 114849 - DNA, 601 bp, Human; identical to SEQ ID NO: 113841

SEQ ID NO: 114850 - DNA, 601 bp, Human; identical to SEQ ID NO: 113842

SEQ ID NO: 114851 - DNA, 601 bp, Human; identical to SEQ ID NO: 113843

SEQ ID NO: 114852 - DNA, 601 bp, Human; identical to SEQ ID NO: 113844

SEQ ID NO: 114853 - DNA, 601 bp, Human; identical to SEQ ID NO: 113845

SEQ ID NO: 114854 - DNA, 601 bp, Human; identical to SEQ ID NO: 113846

SEQ ID NO: 114855 - DNA, 601 bp, Human; identical to SEQ ID NO: 113847

SEQ ID NO: 114856 - DNA, 601 bp, Human; identical to SEQ ID NO: 113848

SEQ ID NO: 114857 - DNA, 601 bp, Human; identical to SEQ ID NO: 113849

SEQ ID NO: 114858 - DNA, 601 bp, Human; identical to SEQ ID NO: 113850

SEQ ID NO: 114859 - DNA, 601 bp, Human; identical to SEQ ID NO: 113851

SEQ ID NO: 114860 - DNA, 601 bp, Human; identical to SEQ ID NO: 113852

SEQ ID NO: 114861 - DNA, 601 bp, Human; identical to SEQ ID NO: 113853

SEQ ID NO: 114862 - DNA, 601 bp, Human; identical to SEQ ID NO: 113854

SEQ ID NO: 114863 - DNA, 601 bp, Human; identical to SEQ ID NO: 17663

SEQ ID NO: 114864 - DNA, 601 bp, Human; identical to SEQ ID NO: 17664

SEQ ID NO: 114865 - DNA, 601 bp, Human; identical to SEQ ID NO: 17665

SEQ ID NO: 114866 - DNA, 601 bp, Human; identical to SEQ ID NO: 17666

SEQ ID NO: 114867 - DNA, 601 bp, Human; identical to SEQ ID NO: 17667

SEQ ID NO: 114868 - DNA, 601 bp, Human; identical to SEQ ID NO: 17668

SEQ ID NO: 114869 - DNA, 601 bp, Human; identical to SEQ ID NO: 17669

SEQ ID NO: 114870 - DNA, 601 bp, Human; identical to SEQ ID NO: 17670

SEQ ID NO: 114871 - DNA, 601 bp, Human; identical to SEQ ID NO: 17671

SEQ ID NO: 114872 - DNA, 601 bp, Human; identical to SEQ ID NO: 17672

SEQ ID NO: 114873 - DNA, 601 bp, Human; identical to SEQ ID NO: 17673

SEQ ID NO: 114874 - DNA, 601 bp, Human; identical to SEQ ID NO: 17674

SEQ ID NO: 114875 - DNA, 601 bp, Human; identical to SEQ ID NO: 17675

SEQ ID NO: 114876 - DNA, 601 bp, Human; identical to SEQ ID NO: 17676

SEQ ID NO: 114877 - DNA, 601 bp, Human; identical to SEQ ID NO: 17677

SEQ ID NO: 114878 - DNA, 601 bp, Human; identical to SEQ ID NO: 17678

SEQ ID NO: 114879 - DNA, 601 bp, Human; identical to SEQ ID NO: 17679

SEQ ID NO: 114880 - DNA, 601 bp, Human; identical to SEQ ID NO: 17680

SEQ ID NO: 114881 - DNA, 601 bp, Human; identical to SEQ ID NO: 17681

SEQ ID NO: 114882 - DNA, 601 bp, Human; identical to SEQ ID NO: 17682

SEQ ID NO: 114883 - DNA, 601 bp, Human; identical to SEQ ID NO: 17683

SEQ ID NO: 114884 - DNA, 601 bp, Human; identical to SEQ ID NO: 17684

SEQ ID NO: 114885 - DNA, 601 bp, Human; identical to SEQ ID NO: 17685

SEQ ID NO: 114886 - DNA, 601 bp, Human; identical to SEQ ID NO: 17686

SEQ ID NO: 114887 - DNA, 601 bp, Human; identical to SEQ ID NO: 17687

SEQ ID NO: 114888 - DNA, 601 bp, Human; identical to SEQ ID NO: 17688

SEQ ID NO: 114889 - DNA, 601 bp, Human; identical to SEQ ID NO: 17689

SEQ ID NO: 114890 - DNA, 601 bp, Human; identical to SEQ ID NO: 17690

SEQ ID NO: 114891 - DNA, 601 bp, Human; identical to SEQ ID NO: 17691

SEQ ID NO: 114892 - DNA, 601 bp, Human; identical to SEQ ID NO: 17692

SEQ ID NO: 114893 - DNA, 601 bp, Human; identical to SEQ ID NO: 17693

SEQ ID NO: 114894 - DNA, 601 bp, Human; identical to SEQ ID NO: 17694

SEQ ID NO: 114895 - DNA, 601 bp, Human; identical to SEQ ID NO: 113887

SEQ ID NO: 114896 - DNA, 601 bp, Human; identical to SEQ ID NO: 113888

SEQ ID NO: 114897 - DNA, 601 bp, Human; identical to SEQ ID NO: 113889

SEQ ID NO: 114898 - DNA, 601 bp, Human; identical to SEQ ID NO: 113890

SEQ ID NO: 114899 - DNA, 601 bp, Human; identical to SEQ ID NO: 113891

SEQ ID NO: 114900 - DNA, 601 bp, Human; identical to SEQ ID NO: 113892

SEQ ID NO: 114901 - DNA, 601 bp, Human; identical to SEQ ID NO: 113893

SEQ ID NO: 114902 - DNA, 601 bp, Human; identical to SEQ ID NO: 113894

SEQ ID NO: 114903 - DNA, 601 bp, Human; identical to SEQ ID NO: 113895

SEQ ID NO: 114904 - DNA, 601 bp, Human; identical to SEQ ID NO: 113896

SEQ ID NO: 114905 - DNA, 601 bp, Human; identical to SEQ ID NO: 113897

SEQ ID NO: 114906 - DNA, 601 bp, Human; identical to SEQ ID NO: 113898

SEQ ID NO: 114907 - DNA, 601 bp, Human; identical to SEQ ID NO: 113899

SEQ ID NO: 114908 - DNA, 601 bp, Human; identical to SEQ ID NO: 113900

SEQ ID NO: 114909 - DNA, 601 bp, Human; identical to SEQ ID NO: 39390

SEQ ID NO: 114910 - DNA, 601 bp, Human; identical to SEQ ID NO: 39391

SEQ ID NO: 114911 - DNA, 601 bp, Human; identical to SEQ ID NO: 39392

SEQ ID NO: 114912 - DNA, 601 bp, Human; identical to SEQ ID NO: 39393

SEQ ID NO: 114913 - DNA, 601 bp, Human; identical to SEQ ID NO: 39394

SEQ ID NO: 114914 - DNA, 601 bp, Human; identical to SEQ ID NO: 39395

SEQ ID NO: 114915 - DNA, 601 bp, Human; identical to SEQ ID NO: 39396

SEQ ID NO: 114916 - DNA, 601 bp, Human; identical to SEQ ID NO: 39397

SEQ ID NO: 114917 - DNA, 601 bp, Human; identical to SEQ ID NO: 39398

SEQ ID NO: 114918 - DNA, 601 bp, Human; identical to SEQ ID NO: 39399

SEQ ID NO: 114919 - DNA, 601 bp, Human; identical to SEQ ID NO: 39400

SEQ ID NO: 114920 - DNA, 601 bp, Human; identical to SEQ ID NO: 39401

SEQ ID NO: 114921 - DNA, 601 bp, Human; identical to SEQ ID NO: 39402

SEQ ID NO: 114922 - DNA, 601 bp, Human; identical to SEQ ID NO: 39403

SEQ ID NO: 114923 - DNA, 601 bp, Human; identical to SEQ ID NO: 39404

SEQ ID NO: 114924 - DNA, 601 bp, Human; identical to SEQ ID NO: 39405

SEQ ID NO: 114925 - DNA, 601 bp, Human; identical to SEQ ID NO: 39406

SEQ ID NO: 114926 - DNA, 601 bp, Human; identical to SEQ ID NO: 39407

SEQ ID NO: 114927 - DNA, 601 bp, Human; identical to SEQ ID NO: 39408

SEQ ID NO: 114928 - DNA, 601 bp, Human; identical to SEQ ID NO: 39409

SEQ ID NO: 114929 - DNA, 601 bp, Human; identical to SEQ ID NO: 39410

SEQ ID NO: 114930 - DNA, 601 bp, Human; identical to SEQ ID NO: 113754

SEQ ID NO: 114931 - DNA, 601 bp, Human; identical to SEQ ID NO: 113755

SEQ ID NO: 114932 - DNA, 601 bp, Human; identical to SEQ ID NO: 113756

SEQ ID NO: 114933 - DNA, 601 bp, Human; identical to SEQ ID NO: 113757

SEQ ID NO: 114934 - DNA, 601 bp, Human; identical to SEQ ID NO: 113758

SEQ ID NO: 114935 - DNA, 601 bp, Human; identical to SEQ ID NO: 113759

SEQ ID NO: 114936 - DNA, 601 bp, Human; identical to SEQ ID NO: 113760

SEQ ID NO: 114937 - DNA, 601 bp, Human; identical to SEQ ID NO: 113761

SEQ ID NO: 114938 - DNA, 601 bp, Human; identical to SEQ ID NO: 113762

SEQ ID NO: 114939 - DNA, 601 bp, Human; identical to SEQ ID NO: 113763

SEQ ID NO: 114940 - DNA, 601 bp, Human; identical to SEQ ID NO: 113764

SEQ ID NO: 114941 - DNA, 601 bp, Human; identical to SEQ ID NO: 113765

SEQ ID NO: 114942 - DNA, 601 bp, Human; identical to SEQ ID NO: 113766

SEQ ID NO: 114943 - DNA, 601 bp, Human; identical to SEQ ID NO: 113767

SEQ ID NO: 114944 - DNA, 601 bp, Human; identical to SEQ ID NO: 113768

SEQ ID NO: 114945 - DNA, 601 bp, Human; identical to SEQ ID NO: 113769

SEQ ID NO: 114946 - DNA, 601 bp, Human; identical to SEQ ID NO: 113770

SEQ ID NO: 114947 - DNA, 601 bp, Human; identical to SEQ ID NO: 113771

SEQ ID NO: 114948 - DNA, 601 bp, Human; identical to SEQ ID NO: 113772

SEQ ID NO: 114949 - DNA, 601 bp, Human; identical to SEQ ID NO: 113773

SEQ ID NO: 114950 - DNA, 601 bp, Human; identical to SEQ ID NO: 113774

SEQ ID NO: 114951 - DNA, 601 bp, Human; identical to SEQ ID NO: 113775

SEQ ID NO: 114952 - DNA, 601 bp, Human; identical to SEQ ID NO: 113776

SEQ ID NO: 114953 - DNA, 601 bp, Human; identical to SEQ ID NO: 113777

SEQ ID NO: 114954 - DNA, 601 bp, Human; identical to SEQ ID NO: 113778

SEQ ID NO: 114955 - DNA, 601 bp, Human; identical to SEQ ID NO: 113779

SEQ ID NO: 114956 - DNA, 601 bp, Human; identical to SEQ ID NO: 113780

SEQ ID NO: 114957 - DNA, 601 bp, Human; identical to SEQ ID NO: 113781

SEQ ID NO: 114958 - DNA, 601 bp, Human; identical to SEQ ID NO: 113782

SEQ ID NO: 114959 - DNA, 601 bp, Human; identical to SEQ ID NO: 113783

SEQ ID NO: 114960 - DNA, 601 bp, Human; identical to SEQ ID NO: 113784

SEQ ID NO: 114961 - DNA, 601 bp, Human; identical to SEQ ID NO: 113785

SEQ ID NO: 114962 - DNA, 601 bp, Human; identical to SEQ ID NO: 113786

SEQ ID NO: 114963 - DNA, 601 bp, Human; identical to SEQ ID NO: 113787

SEQ ID NO: 114964 - DNA, 601 bp, Human; identical to SEQ ID NO: 113788

SEQ ID NO: 114965 - DNA, 601 bp, Human; identical to SEQ ID NO: 113789

SEQ ID NO: 114966 - DNA, 601 bp, Human; identical to SEQ ID NO: 113790

SEQ ID NO: 114967 - DNA, 601 bp, Human; identical to SEQ ID NO: 113791

SEQ ID NO: 114968 - DNA, 601 bp, Human; identical to SEQ ID NO: 113792

SEQ ID NO: 114969 - DNA, 601 bp, Human; identical to SEQ ID NO: 113793

SEQ ID NO: 114970 - DNA, 601 bp, Human; identical to SEQ ID NO: 113794

SEQ ID NO: 114971 - DNA, 601 bp, Human; identical to SEQ ID NO: 113795

SEQ ID NO: 114972 - DNA, 601 bp, Human; identical to SEQ ID NO: 113796

SEQ ID NO: 114973 - DNA, 601 bp, Human; identical to SEQ ID NO: 113797

SEQ ID NO: 114974 - DNA, 601 bp, Human; identical to SEQ ID NO: 113798

SEQ ID NO: 114975 - DNA, 601 bp, Human; identical to SEQ ID NO: 113799

SEQ ID NO: 114976 - DNA, 601 bp, Human; identical to SEQ ID NO: 113800

SEQ ID NO: 114977 - DNA, 601 bp, Human; identical to SEQ ID NO: 113801

SEQ ID NO: 114978 - DNA, 601 bp, Human; identical to SEQ ID NO: 113802

SEQ ID NO: 114979 - DNA, 601 bp, Human; identical to SEQ ID NO: 113803

SEQ ID NO: 114980 - DNA, 601 bp, Human; identical to SEQ ID NO: 113804

SEQ ID NO: 114981 - DNA, 601 bp, Human; identical to SEQ ID NO: 113805

SEQ ID NO: 114982 - DNA, 601 bp, Human; identical to SEQ ID NO: 113806

SEQ ID NO: 114983 - DNA, 601 bp, Human; identical to SEQ ID NO: 113807

SEQ ID NO: 114984 - DNA, 601 bp, Human; identical to SEQ ID NO: 113808

SEQ ID NO: 114985 - DNA, 601 bp, Human; identical to SEQ ID NO: 113809

SEQ ID NO: 114986 - DNA, 601 bp, Human; identical to SEQ ID NO: 113810

SEQ ID NO: 114987 - DNA, 601 bp, Human; identical to SEQ ID NO: 113811

SEQ ID NO: 114988 - DNA, 601 bp, Human; identical to SEQ ID NO: 113812

SEQ ID NO: 114989 - DNA, 601 bp, Human; identical to SEQ ID NO: 113813

SEQ ID NO: 114990 - DNA, 601 bp, Human; identical to SEQ ID NO: 113814

SEQ ID NO: 114991 - DNA, 601 bp, Human; identical to SEQ ID NO: 113815

SEQ ID NO: 114992 - DNA, 601 bp, Human; identical to SEQ ID NO: 113816

SEQ ID NO: 114993 - DNA, 601 bp, Human; identical to SEQ ID NO: 113817

SEQ ID NO: 114994 - DNA, 601 bp, Human; identical to SEQ ID NO: 113818

SEQ ID NO: 114995 - DNA, 601 bp, Human; identical to SEQ ID NO: 113819

SEQ ID NO: 114996 - DNA, 601 bp, Human; identical to SEQ ID NO: 113820

SEQ ID NO: 114997 - DNA, 601 bp, Human; identical to SEQ ID NO: 113821

SEQ ID NO: 114998 - DNA, 601 bp, Human; identical to SEQ ID NO: 113822

SEQ ID NO: 114999 - DNA, 601 bp, Human; identical to SEQ ID NO: 113823

SEQ ID NO: 115000 - DNA, 601 bp, Human; identical to SEQ ID NO: 113824

SEQ ID NO: 115001 - DNA, 601 bp, Human; identical to SEQ ID NO: 113825

SEQ ID NO: 115002 - DNA, 601 bp, Human; identical to SEQ ID NO: 113826

SEQ ID NO: 115003 - DNA, 601 bp, Human; identical to SEQ ID NO: 113827

SEQ ID NO: 115004 - DNA, 601 bp, Human; identical to SEQ ID NO: 113828

SEQ ID NO: 115005 - DNA, 601 bp, Human; identical to SEQ ID NO: 113829

SEQ ID NO: 115006 - DNA, 601 bp, Human; identical to SEQ ID NO: 113830

SEQ ID NO: 115007 - DNA, 601 bp, Human; identical to SEQ ID NO: 113831

SEQ ID NO: 115008 - DNA, 601 bp, Human; identical to SEQ ID NO: 113832

SEQ ID NO: 115009 - DNA, 601 bp, Human; identical to SEQ ID NO: 113833

SEQ ID NO: 115010 - DNA, 601 bp, Human; identical to SEQ ID NO: 113834

SEQ ID NO: 115011 - DNA, 601 bp, Human; identical to SEQ ID NO: 113835

SEQ ID NO: 115012 - DNA, 601 bp, Human; identical to SEQ ID NO: 113836

SEQ ID NO: 115013 - DNA, 601 bp, Human; identical to SEQ ID NO: 113837

SEQ ID NO: 115014 - DNA, 601 bp, Human; identical to SEQ ID NO: 113838

SEQ ID NO: 115015 - DNA, 601 bp, Human; identical to SEQ ID NO: 113839

SEQ ID NO: 115016 - DNA, 601 bp, Human; identical to SEQ ID NO: 113840

SEQ ID NO: 115017 - DNA, 601 bp, Human; identical to SEQ ID NO: 113841

SEQ ID NO: 115018 - DNA, 601 bp, Human; identical to SEQ ID NO: 113842

SEQ ID NO: 115019 - DNA, 601 bp, Human; identical to SEQ ID NO: 113843

SEQ ID NO: 115020 - DNA, 601 bp, Human; identical to SEQ ID NO: 113844

SEQ ID NO: 115021 - DNA, 601 bp, Human; identical to SEQ ID NO: 113845

SEQ ID NO: 115022 - DNA, 601 bp, Human; identical to SEQ ID NO: 113846

SEQ ID NO: 115023 - DNA, 601 bp, Human; identical to SEQ ID NO: 113847

SEQ ID NO: 115024 - DNA, 601 bp, Human; identical to SEQ ID NO: 113848

SEQ ID NO: 115025 - DNA, 601 bp, Human; identical to SEQ ID NO: 113849

SEQ ID NO: 115026 - DNA, 601 bp, Human; identical to SEQ ID NO: 113850

SEQ ID NO: 115027 - DNA, 601 bp, Human; identical to SEQ ID NO: 113851

SEQ ID NO: 115028 - DNA, 601 bp, Human; identical to SEQ ID NO: 113852

SEQ ID NO: 115029 - DNA, 601 bp, Human; identical to SEQ ID NO: 113853

SEQ ID NO: 115030 - DNA, 601 bp, Human; identical to SEQ ID NO: 113854

SEQ ID NO: 115031 - DNA, 601 bp, Human; identical to SEQ ID NO: 17663

SEQ ID NO: 115032 - DNA, 601 bp, Human; identical to SEQ ID NO: 17664

SEQ ID NO: 115033 - DNA, 601 bp, Human; identical to SEQ ID NO: 17665

SEQ ID NO: 115034 - DNA, 601 bp, Human; identical to SEQ ID NO: 17666

SEQ ID NO: 115035 - DNA, 601 bp, Human; identical to SEQ ID NO: 17667

SEQ ID NO: 115036 - DNA, 601 bp, Human; identical to SEQ ID NO: 17668

SEQ ID NO: 115037 - DNA, 601 bp, Human; identical to SEQ ID NO: 17669

SEQ ID NO: 115038 - DNA, 601 bp, Human; identical to SEQ ID NO: 17670

SEQ ID NO: 115039 - DNA, 601 bp, Human; identical to SEQ ID NO: 17671

SEQ ID NO: 115040 - DNA, 601 bp, Human; identical to SEQ ID NO: 17672

SEQ ID NO: 115041 - DNA, 601 bp, Human; identical to SEQ ID NO: 17673

SEQ ID NO: 115042 - DNA, 601 bp, Human; identical to SEQ ID NO: 17674

SEQ ID NO: 115043 - DNA, 601 bp, Human; identical to SEQ ID NO: 17675

SEQ ID NO: 115044 - DNA, 601 bp, Human; identical to SEQ ID NO: 17676

SEQ ID NO: 115045 - DNA, 601 bp, Human; identical to SEQ ID NO: 17677

SEQ ID NO: 115046 - DNA, 601 bp, Human; identical to SEQ ID NO: 17678

SEQ ID NO: 115047 - DNA, 601 bp, Human; identical to SEQ ID NO: 17679

SEQ ID NO: 115048 - DNA, 601 bp, Human; identical to SEQ ID NO: 17680

SEQ ID NO: 115049 - DNA, 601 bp, Human; identical to SEQ ID NO: 17681

SEQ ID NO: 115050 - DNA, 601 bp, Human; identical to SEQ ID NO: 17682

SEQ ID NO: 115051 - DNA, 601 bp, Human; identical to SEQ ID NO: 17683

SEQ ID NO: 115052 - DNA, 601 bp, Human; identical to SEQ ID NO: 17684

SEQ ID NO: 115053 - DNA, 601 bp, Human; identical to SEQ ID NO: 17685

SEQ ID NO: 115054 - DNA, 601 bp, Human; identical to SEQ ID NO: 17686

SEQ ID NO: 115055 - DNA, 601 bp, Human; identical to SEQ ID NO: 17687

SEQ ID NO: 115056 - DNA, 601 bp, Human; identical to SEQ ID NO: 17688

SEQ ID NO: 115057 - DNA, 601 bp, Human; identical to SEQ ID NO: 17689

SEQ ID NO: 115058 - DNA, 601 bp, Human; identical to SEQ ID NO: 17690

SEQ ID NO: 115059 - DNA, 601 bp, Human; identical to SEQ ID NO: 17691

SEQ ID NO: 115060 - DNA, 601 bp, Human; identical to SEQ ID NO: 17692

SEQ ID NO: 115061 - DNA, 601 bp, Human; identical to SEQ ID NO: 17693

SEQ ID NO: 115062 - DNA, 601 bp, Human; identical to SEQ ID NO: 17694

SEQ ID NO: 115063 - DNA, 601 bp, Human; identical to SEQ ID NO: 113887

SEQ ID NO: 115064 - DNA, 601 bp, Human; identical to SEQ ID NO: 113888

SEQ ID NO: 115065 - DNA, 601 bp, Human; identical to SEQ ID NO: 113889

SEQ ID NO: 115066 - DNA, 601 bp, Human; identical to SEQ ID NO: 113890

SEQ ID NO: 115067 - DNA, 601 bp, Human; identical to SEQ ID NO: 113891

SEQ ID NO: 115068 - DNA, 601 bp, Human; identical to SEQ ID NO: 113892

SEQ ID NO: 115069 - DNA, 601 bp, Human; identical to SEQ ID NO: 113893

SEQ ID NO: 115070 - DNA, 601 bp, Human; identical to SEQ ID NO: 113894

SEQ ID NO: 115071 - DNA, 601 bp, Human; identical to SEQ ID NO: 113895

SEQ ID NO: 115072 - DNA, 601 bp, Human; identical to SEQ ID NO: 113896

SEQ ID NO: 115073 - DNA, 601 bp, Human; identical to SEQ ID NO: 113897

SEQ ID NO: 115074 - DNA, 601 bp, Human; identical to SEQ ID NO: 113898

SEQ ID NO: 115075 - DNA, 601 bp, Human; identical to SEQ ID NO: 113899

SEQ ID NO: 115076 - DNA, 601 bp, Human; identical to SEQ ID NO: 113900

SEQ ID NO: 115077 - DNA, 601 bp, Human; identical to SEQ ID NO: 39390

SEQ ID NO: 115078 - DNA, 601 bp, Human; identical to SEQ ID NO: 39391

SEQ ID NO: 115079 - DNA, 601 bp, Human; identical to SEQ ID NO: 39392

SEQ ID NO: 115080 - DNA, 601 bp, Human; identical to SEQ ID NO: 39393

SEQ ID NO: 115081 - DNA, 601 bp, Human; identical to SEQ ID NO: 39394

SEQ ID NO: 115082 - DNA, 601 bp, Human; identical to SEQ ID NO: 39395

SEQ ID NO: 115083 - DNA, 601 bp, Human; identical to SEQ ID NO: 39396

SEQ ID NO: 115084 - DNA, 601 bp, Human; identical to SEQ ID NO: 39397

SEQ ID NO: 115085 - DNA, 601 bp, Human; identical to SEQ ID NO: 39398

SEQ ID NO: 115086 - DNA, 601 bp, Human; identical to SEQ ID NO: 39399

SEQ ID NO: 115087 - DNA, 601 bp, Human; identical to SEQ ID NO: 39400

SEQ ID NO: 115088 - DNA, 601 bp, Human; identical to SEQ ID NO: 39401

SEQ ID NO: 115089 - DNA, 601 bp, Human; identical to SEQ ID NO: 39402

SEQ ID NO: 115090 - DNA, 601 bp, Human; identical to SEQ ID NO: 39403

SEQ ID NO: 115091 - DNA, 601 bp, Human; identical to SEQ ID NO: 39404

SEQ ID NO: 115092 - DNA, 601 bp, Human; identical to SEQ ID NO: 39405

SEQ ID NO: 115093 - DNA, 601 bp, Human; identical to SEQ ID NO: 39406

SEQ ID NO: 115094 - DNA, 601 bp, Human; identical to SEQ ID NO: 39407

SEQ ID NO: 115095 - DNA, 601 bp, Human; identical to SEQ ID NO: 39408

SEQ ID NO: 115096 - DNA, 601 bp, Human; identical to SEQ ID NO: 39409

SEQ ID NO: 115097 - DNA, 601 bp, Human; identical to SEQ ID NO: 39410

SEQ ID NO: 115098 - DNA, 601 bp, Human
gaactcacttcccagagcagcggctctccccgcggagcggatcagtgcggaccctgcagtggccggccggcggcgggtcttggccgcccggactccgacgacttgtcccctcctccgctgctagggggagggggcgcccggcagccgcggctcgcgctcgcccaagttcaacaaccggtgcgagcgaagctgagcgcacgtccttcttctcttgcgtggctctccgccgccttctggtctttaccgccgtggagaagcctaagacgcaggaaaggcttgcaaaagttcgctccgggactcggccacttgtctccggtcctcccagccgggaaagttctttgctgctgcagccgctcgccgacttcccccggcgggcgcgtgggtaccgctgctttccgccgctgtcaacagcgcctgggcagcagggctctcctcccgggggcggctggagaccaggctctctggacactcccgaaacaccagcccgggagccacaggcgctagctctgggcagttagagagaaggtgaaaagaaaataagatttgcagttcggactatactgccgacctggctggctggctgtgtctgtctgtctgcctg

SEQ ID NO: 115099 - DNA, 601 bp, Human
tctctctgtgttattttttttcttcgttgcccctcagcccccgacggtctctcttcaaaatgtttgcaactgctgcgttagcatgagttggcacccactgttaacgtggttcatgactttctgtttaagctgtgccacctgttccctgagcatgttggccgtggacgccagctccgagttctgagctttcaaggttttcactttttcctccagccgggcgattctctccagcttcctttttcggcacttggaggcagcgatgcggttcctcatgcgcttcctctccgccttgatccgctcytgggactccatgtcgatgggggacaggggcggtgtctcgccgggcatctcgggcactgtctgaggctcctccttcagggcctgcagccgcgggtgctgcacgggcatctgctggggcaggtggtgcggcggctgctgctgctgctggggttgcgcgggaaaggccaggccggccgcgccgtaggagggcgccccgccgccgctgctcagcgcgcctgggttgaagttgctgaggtttgcgtagaccggcggctcgctgtgcaggctggcgctgaagccgccgctgccgctgccccctgcc

SEQ ID NO: 115100 - DNA, 601 bp, Human
ccgtgtttggggcctctttctgcattcattttaggcttgatacctaatggggtcataaggggaatattgagaatattgacagcaaatatttgagcgtttattgtatgctaggcagcgtggcaagaccttttaacagatcattatgtttagttctttgaacaaccctctgaagtaccactgttgtgcccacttaacacagtgggaagttgaacagagaggctaagccatttggccaaggtcacacagctaataagttacgaagcagagatgcaagcccaggcagtcagactccagagcactrtattaaatttctaggttgtactgctttcacgtacccctgaagcttgctggtttatcttttgctacctggtatctgtacctcagtgcctcccaccacctcctttctttctattgatgtcatttgaaagtctttctggtagcatcagttctcccttaaagccataagaaatgccgtttgcgacttatcacacatattgtggtgtagtgtcaccgaattaggagctcttgaataccggcagggtacttaactgaggtttgaaaaattttgcaggtaggcctggcaaacctgcctagtgaacct

SEQ ID NO: 115101 - DNA, 601 bp, Human
taagccatttggccaaggtcacacagctaataagttacgaagcagagatgcaagcccaggcagtcagactccagagcactgtattaaatttctaggttgtactgctttcacgtacccctgaagcttgctggtttatcttttgctacctggtatctgtacctcagtgcctcccaccacctcctttctttctattgatgtcatttgaaagtctttctggtagcatcagttctcccttaaagccataagaaatgccgtttgcgacttatcacacatattgtggtgtagtgtcaccgaattaggmgctcttgaataccggcagggtacttaactgaggtttgaaaaattttgcaggtaggcctggcaaacctgcctagtgaacctttcttacaaccttagttgatggctgtccagccggctggttcttccctattcaaaatactgcatctttggtttcctaaagaacggactcttgtctctttcttgtgacttaagcagctgatgaagcacatgatttctcatccatggatgaataaagtctcctcttagtgtgtttctctcttcaaacttgggaaggtttgttcagatttgagtttaaggactg

SEQ ID NO: 115102 - DNA, 601 bp, Human
ttttatttatattttgagacggagtttccctcttgttgcccaggctagagtgcaatagcgcgatgtcggctcactgcaacctctgcctcccgggttcaagccattctcctgcctcagcctcccgagtggctggaattacaggcatgcgccaccatgcccagctaatcttgtatttttagtagagacaggttttctccatgttggtcaggctggtctcgaactgcctacctcaggtgatccgcctgtctcggcctccgaaaagtgctgggattacaggcatgagccactgcgcccggccgastctggtagcatttttttgttcactcaagaggtagtccatgtcactactgtaattaccttgcactgccatgtctttgagcaaaggtacatttggcatgctggatttttttcttcagctggcaagaaagtttaatgtagcactgatagtgtactggccatagtttcagtaccattctacatagaaaagctgtgttaccctatctcccacaactttctagattcccttctttaagggaagatttggattttacatttgtggtagaactgcataagtaaacagagggtggaatgtagaagatag

SEQ ID NO: 115103 - DNA, 601 bp, Human
ccatgtctttgagcaaaggtacatttggcatgctggatttttttcttcagctggcaagaaagtttaatgtagcactgatagtgtactggccatagtttcagtaccattctacatagaaaagctgtgttaccctatctcccacaactttctagattcccttctttaagggaagatttggattttacatttgtggtagaactgcataagtaaacagagggtggaatgtagaagatagtctaaaaatagttttattagtatatccttctaggtagttagcaaccacttggggcaattttttttwaaatttttttttagtgccaactgtgtctaagctcaccaaccctgtaatcagagaacaactctttatagtaaagtgtggctttgaatcagttttctgaccccactgccaagtgaagccaaaaaattttggttatttgattagcttttaatatgtcttcagctgggcacggtggctcacgcctgtaatcccagcactttgggaggccgaggcaggtggatcatgaggtcaggagatcgagaccatcctggctaacacagtgaaaccccatctctactaaaaatacaaaaaattagccgggcg

SEQ ID NO: 115104 - DNA, 601 bp, Human
cgcctccccccttattttttggctattggcttgctgttgatgattcttacctctcatgtaaggaaggctaccattgtattctcaggcatccattcctttgtgttaccacatgcttatctgttaatattatctaatagttctctatgcttctctgtctgcagtttgctgcagaaacatttttgcaatatgctgatcttttcagttatttgctcttaaatcttctattctgtttttccccacactccatatggcattaaagacagaaaaatagtttgtgttttaaaactttttttttttttttagacggaatctcgctttgtagcccaggctggagtgcagtggtgccatctcagctcactgcaagctccaccttccagattcatgccattctcctgcctcagcctcccgagtagctgggactacaggcacccaccaccacgcccggctaatttttgtatttttagtagagacggggtttcaccgtgttagccagattggtcttgatctcctgacctcgtgatccacccgcctcggcctcccaaagtgctggaattacaggcgtgagccaccatgcccagcctaaaacttatttttaaaacat

SEQ ID NO: 115105 - DNA, 601 bp, Human
tattttttggctattggcttgctgttgatgattcttacctctcatgtaaggaaggctaccattgtattctcaggcatccattcctttgtgttaccacatgcttatctgttaatattatctaatagttctctatgcttctctgtctgcagtttgctgcagaaacatttttgcaatatgctgatcttttcagttatttgctcttaaatcttctattctgtttttccccacactccatatggcattaaagacagaaaaatagtttgtgttttaaaactttttttttttttttagacggaatctygctttgtagcccaggctggagtgcagtggtgccatctcagctcactgcaagctccaccttccagattcatgccattctcctgcctcagcctcccgagtagctgggactacaggcacccaccaccacgcccggctaatttttgtatttttagtagagacggggtttcaccgtgttagccagattggtcttgatctcctgacctcgtgatccacccgcctcggcctcccaaagtgctggaattacaggcgtgagccaccatgcccagcctaaaacttatttttaaaacatttcttaatggtg

SEQ ID NO: 115106 - DNA, 601 bp, Human
taccattgtattctcaggcatccattcctttgtgttaccacatgcttatctgttaatattatctaatagttctctatgcttctctgtctgcagtttgctgcagaaacatttttgcaatatgctgatcttttcagttatttgctcttaaatcttctattctgtttttccccacactccatatggcattaaagacagaaaaatagtttgtgttttaaaactttttttttttttttagacggaatctcgctttgtagcccaggctggagtgcagtggtgccatctcagctcactgcaagctccrccttccagattcatgccattctcctgcctcagcctcccgagtagctgggactacaggcacccaccaccacgcccggctaatttttgtatttttagtagagacggggtttcaccgtgttagccagattggtcttgatctcctgacctcgtgatccacccgcctcggcctcccaaagtgctggaattacaggcgtgagccaccatgcccagcctaaaacttatttttaaaacatttcttaatggtggtggtcactgcgatttgtgaatcagaggtaaaagtgatgtggcgagtgaaatcaaa

SEQ ID NO: 115107 - DNA, 601 bp, Human
tagctgtatttttcaaatgtttgttggtaacgagtgaggaacctgatgcatccagctccagagtaaggtttatttgccatggtaacactggataagtacattgttgcctgtatttccaagtaatttatcatttctgtattttagtaaacatacatatatacagaaaagtgcacaaataagtggacggcttagagaatttttataaacccagaggccctcttagtctcctttaagtcattatcatcgatgccctgatgcttgcgtagtgagtcttctgatttctagaactgtagactaattytgcctgatttggattttgtgtaaatggaatcatacactgtgtattcttgcgtatctggtttctttgactcagtgttgtttgtgagactttgtgttgttgtgtacagttgtaactggagtttccattgctcagtagtattatgtgatatatcataatgtatttaagtaaaaagactgagttttagggtatgtgtctgtattcatttgctagggctgccgtaacaagtatcacagatagagtggcttaaacagaaatttattttctcaattctgaaggttagaaatctgaggtcaagctgtc

SEQ ID NO: 115108 - DNA, 601 bp, Human
agttttagggtatgtgtctgtattcatttgctagggctgccgtaacaagtatcacagatagagtggcttaaacagaaatttattttctcaattctgaaggttagaaatctgaggtcaagctgtcgggaggattagtttcttctgaagcctctccttggtttgtaaatgactgtcttctcttccctgtatcttcacaggatctttcctctgtattggctgtgtcctattctccttttcttttaggacaccagtcgtattggattgaggcccacccttatgacctcacttaacctcagttacytctttaaaggccctgtctgcaaataagtcacattctgatatattggggattagaatttcaacttaaaaattttaggtggacacagttcacttcataagagtatctattctgctctagtagatatggccagttttcaaaagttgtaccagcgtattcttccaccagcagtatataagaagtccaaatattccacatccttgctagcacttgtaactttttctctctaattttagttccctctggtagaaagccatttctttatggcaccatggtacagcttgtttactcaccagtgtaggg

SEQ ID NO: 115109 - DNA, 601 bp, Human
gtgtctgtattcatttgctagggctgccgtaacaagtatcacagatagagtggcttaaacagaaatttattttctcaattctgaaggttagaaatctgaggtcaagctgtcgggaggattagtttcttctgaagcctctccttggtttgtaaatgactgtcttctcttccctgtatcttcacaggatctttcctctgtattggctgtgtcctattctccttttcttttaggacaccagtcgtattggattgaggcccacccttatgacctcacttaacctcagttacttctttaaaggccytgtctgcaaataagtcacattctgatatattggggattagaatttcaacttaaaaattttaggtggacacagttcacttcataagagtatctattctgctctagtagatatggccagttttcaaaagttgtaccagcgtattcttccaccagcagtatataagaagtccaaatattccacatccttgctagcacttgtaactttttctctctaattttagttccctctggtagaaagccatttctttatggcaccatggtacagcttgtttactcaccagtgtaggggaacctcaaggga

SEQ ID NO: 115110 - DNA, 601 bp, Human
tattctccttttcttttaggacaccagtcgtattggattgaggcccacccttatgacctcacttaacctcagttacttctttaaaggccctgtctgcaaataagtcacattctgatatattggggattagaatttcaacttaaaaattttaggtggacacagttcacttcataagagtatctattctgctctagtagatatggccagttttcaaaagttgtaccagcgtattcttccaccagcagtatataagaagtccaaatattccacatccttgctagcacttgtaactttttctctytaattttagttccctctggtagaaagccatttctttatggcaccatggtacagcttgtttactcaccagtgtaggggaacctcaagggactggggaaggttatcctggagtaaaacgtgtcagtttgagactacctcttgtaaatgctacttaaatccattggggttaaaagcagaggttcggccaggcacagtggctcatgcctgtaatcccagcactttgggagaccgaggtgggcggatcacttgaggccaggagttcaagaccagcctggccaacatagcgaaaccctgtgtctac

SEQ ID NO: 115111 - DNA, 601 bp, Human
ttggaggcagttaaattccagcacgtacagtttaaatccagcacatacagataaatttaaatactgttaaataaagttatttaacagtatttaaatttaaaaaaatttaaatacagttgaatacagttaaattccagcacaggaatgacacattatttcatgtcacttctgcttagggttcattggccaaaatgagtcacaccacacaaggaatcaagtgtgatcctacatgtgtggacttggaaggcacggagttggaaatatttgggaaatagcactagtatcatacttggcttataayatgtaatagctattgggggaaatagctctcatttgcagaatctctttctacaaatcagctggtaatttaaatgctaaaaagagcttagttatagatactgtgttgcccgtctttactcactaatcaccttccgatcctaagaaatttatttatttatttattttttgagatgaagtctccctctgtcacccaggctggagtgcagtggcgcgatcttggctcactgcaagctccaccttccgggttcacgcccttctcctgcctcagcttcccgagtagctaggactacaggcgcccgcc

SEQ ID NO: 115112 - DNA, 601 bp, Human
tcaagtgtgatcctacatgtgtggacttggaaggcacggagttggaaatatttgggaaatagcactagtatcatacttggcttataatatgtaatagctattgggggaaatagctctcatttgcagaatctctttctacaaatcagctggtaatttaaatgctaaaaagagcttagttatagatactgtgttgcccgtctttactcactaatcaccttccgatcctaagaaatttatttatttatttattttttgagatgaagtctccctctgtcacccaggctggagtgcagtggcgcgrtcttggctcactgcaagctccaccttccgggttcacgcccttctcctgcctcagcttcccgagtagctaggactacaggcgcccgccaccacacacctggctaattttttgtatatttagtagagacggggtgtcactgtgttagccaggatggtctcgatctcctgaccttgtgatccgcctccctcagcctcccaaagtgctgagattacaggcgtgagccaccgctcccggccttttttttttttttttttttgagatggagtctcgctctgtcacccaggctggagtacagtgaca

SEQ ID NO: 115113 - DNA, 601 bp, Human
cctcctattttggcctcccaaagtgctaggattacaggaatgaatcaccatgcccagctctgccctgtctttagaaaccccactccccttttttttaaggatttgttcttgtttttattttatattttaatgttttgagacaaggtctcactgttgcccaggctggagtatagtggcctgaacacagctcactgcagccttgacctcttgagctcaagtcatcctcctacctcagcctcctgagtagctgggcttacagttgtgtgccactacgcccagttaattttgtttttttgatagygacagggtcttggccatattgcccagctggtcccaaacttctgggctcaagtagctcgcccaccctggcttcccaaggtgctaggattacagatgtgagccactactcgtcaagaaccctatgtttttccattattcttgtttgaggctctccacaaatggtctccagcttgccttcctggctttgttttttttgataaagacacatattcctctgagttgctttattcaccttttccttaccacactttgttccctacttcctttatcttgattcctgtcaattccccttcatctctgt

SEQ ID NO: 115114 - DNA, 601 bp, Human
catggtggcacatgcctgtaatcccagctacttgggaggctgaggcaggagaattgcttgaacctggtaggcagaggttgcagtgagccgagattgtgccattgcactccagcctagacaacaagagcgaaactccatctcaaaaaaaacaaaaacaaagaaaagggctgggcacggtggctcccgcctgcaatcaatcccatcactttgggaggccgccgagatgggtggatcacgaggtcaggagatcaagaccatcctgaccaacatggtgaaatcccgtctctactaaaacaaatamaacaattagctgggtgtggtggcgtgcacttgtaatcccagctactctggaggctgaggcaggagaatcgcttgaacctgggaggcagagatggccgtgagccgagatggcgccactgcactccagcctggcaacagagaaagaaaagtatttaatatttatattttcctacttatctaatcatttccttaagatttagtgagtatacatacttaaaatttggttttcattgccatatagccttcaggaaggttgtatactttacattttgtagtttgagaatttcatttatatacttgt

SEQ ID NO: 115115 - DNA, 601 bp, Human
ggtgggtcactcatgcctgtaatgccagcattttaggaggccaaggtgggaggatcggttgagcccaggagttcaagaccagcctaggcaacatggtaagaccctgtctttacaaaaagttaaaaaaaaaaaaaatagctgggtgtggtggcacatacttgtagtcacacctacttgggagattcaggggaggatcacttgagcccaggaggttgaggctacaggaagccatgataattccactgtactccagcctaggtgacagagggagatgtctcaaaaaaaaaaaaaaaaaaaaaaagacttgtgtttctttgtttgatagattaaactagaaaaatactaactacttttttatattcacttaaattttgtagaaatttaagtatatataattgtataataaatgtagaaaaaatattaactacatttttttatatatacttaaaattttttttaactttcactttctgcttttgtatatttatagtcttttgtgaattggcttttgttctctaaagcccatgtgaggttcttgtacctcacctctctcccagtttataaactttatatggcaagaattttgatccttttcgtgttg

SEQ ID NO: 115116 - DNA, 601 bp, Human
agaaattttttttatcacacagtatatttcctacttccatgtctttttttatttttattttaaatagatttatttacgaaatagagatggtgtctcactatgttgcctaggctggtctcgaactcctgcactcaagcaatcctcccacctccacttcccaaagtgctgggattacaggcatgagccaccatgcctggctgtgtcttttgttttttaactcttctgtttcattctttgtctgtgggacagtactgctgtcttatttgcgtctgttttgttttatacgtatatacacagatayatacacgcatacatatacatacacacaaacattttttttttccttggagacagggcattgctctgtcacccaggctggagtatagtagtgcgatcatgactcatcgactcattgcagccttggcctcccaggctcaggcgatcctcccacctcagccttctgagtagctagtatgtccggaattggtgggttcttggtctcactgacttcaagaatgaagccgcagaccctagcggtgagtgttacagttcttaaagatagcgtgtccagagtttcttccttctgatgttcggacatgtt

SEQ ID NO: 115117 - DNA, 601 bp, Human
gtttattccttctggtgggttcgtggtctcgctggcttcaggagtgaagctgcagacctccacggtgagtgttacagctcttaaggtggcacgtctggagttgttcgttcctcccgtctagagttgtttattccccccggtgggttcgtgatctcgctggcttcaggagtgaagctgcagaccttctcagtgagtgttatagctcataaaggcagtgcagacccaaagagtgagcagcagcaagatttactgcaaagagcgaaagaacaaagcttccacagtgtggaaggggacccgagcrggttgcccatgctggctcgggcagcctgcttttattcccttatctgatcccagccacatcctgctgattggcccattttacagagagctgattggtctgttttgacaggatgctgattggtgtgtttataatccctgatctagacacagagtgctgattggtgtgtttacaatcctctagctagacgtaaaagttctccaagtccccactagattagctagacacagagcactgattggtgcatttagaaaccttgagctagacacagagtgctgattggtgcgtttacaaaccttgagc

SEQ ID NO: 115118 - DNA, 601 bp, Human
ctcgaattcctgacctcaagtgatccacatgcctcagcctcccaaagtgctgggattaccggcctgagccaccaggcccgggtgagcaccatcttattaagaaaagacacagaagagcagggaaggggagaagtgttccaggaaacacagtccaggctctgacattgctccaggtgggatggagggactcaccccttactttgaataggatgcttttgaaggccacaggggtgccagttgtcctcttgacttgaatcccatgcagagactttgttggcagtttgcacacatccatcctctsctggttgagtcctctgagctgagtgtgctggtcacacagcaatgtgggcttcttgaccagcgccccctggcacctatttaagtccatgcttggctgacctgccatgctgtattgtcaggatccatggagctcgggatcttgttgctttctattctaaatgcaaggagacatttgaaatagactcggatattctgaaatgtccaaatatttattattgactgtagtcaccctgctgtgcagtagattagaaagttattcctcctgtccgaaacattgtaccctttgataaacaaccctcca

SEQ ID NO: 115119 - DNA, 601 bp, Human
aagacacagaagagcagggaaggggagaagtgttccaggaaacacagtccaggctctgacattgctccaggtgggatggagggactcaccccttactttgaataggatgcttttgaaggccacaggggtgccagttgtcctcttgacttgaatcccatgcagagactttgttggcagtttgcacacatccatcctctgctggttgagtcctctgagctgagtgtgctggtcacacagcaatgtgggcttcttgaccagcgccccctggcacctatttaagtccatgcttggctgacctgcyatgctgtattgtcaggatccatggagctcgggatcttgttgctttctattctaaatgcaaggagacatttgaaatagactcggatattctgaaatgtccaaatatttattattgactgtagtcaccctgctgtgcagtagattagaaagttattcctcctgtccgaaacattgtaccctttgataaacaaccctccattatttctctctcccaccaccccagcctctgttcaccatcagtctactctctacttctgtgggttcaactgtttatttttagcttttaaatttttctttgatt

SEQ ID NO: 115120 - DNA, 601 bp, Human
attagaaagttattcctcctgtccgaaacattgtaccctttgataaacaaccctccattatttctctctcccaccaccccagcctctgttcaccatcagtctactctctacttctgtgggttcaactgtttatttttagcttttaaatttttctttgatttttagagacagagtcttgctgtgttacccaggctagagtgcagtggctcaatcatagctcactgcagccttggactcctgggttcaagtgatccttctgcctcagcctctcaatgagctgggacaataggcctacactgtyacacctgtttacttttattttttgtagagatgcggtctcactgtattgaccgggttggggttcaacatttttatttattttttttatttttttattttttattttttattttgtttttggagatggagtctcgctctgtctcccaggctggagtgcagtggcgcaatcttggctcactgcaagctccgcctcccaggttcatgccatactcctgcctcagcctcccgagtagctgggactacaggcacatgccaccacgcccagctaattttttgtattttttagtagagacggggtttc

SEQ ID NO: 115121 - DNA, 601 bp, Human
tattttttgtagagatgcggtctcactgtattgaccgggttggggttcaacatttttatttattttttttatttttttattttttattttttattttgtttttggagatggagtctcgctctgtctcccaggctggagtgcagtggcgcaatcttggctcactgcaagctccgcctcccaggttcatgccatactcctgcctcagcctcccgagtagctgggactacaggcacatgccaccacgcccagctaattttttgtattttttagtagagacggggtttcaccatgttagccaggrtggtctcgatctcttaacctcgtgatccacccgccttggcctcccgaagtgctgggattacaggtgtgagccacccggcccggccggggttcaactttttaagattcaacacattggtgatatcacgtggtaattgtttttctgaggtgatagatatatgttagttagcttaacttaatcattccatattgtatacatatatctaaacatcacatggtacccataaatgtatacaattatgatttggtaattaaaaatcatattaactgaaacataataggctgggtgcggtggttcaca

SEQ ID NO: 115122 - DNA, 601 bp, Human
cagtggtgtgatcttggctcactgcaacctccgcctcatgggctcaagcaattctcctgcctcagcctcccaagtagttgggattgcaggcacgtgccaccacgcccagctaatttttgtatttttagtagagacgaggtttcaccatgttggccaggctggttttgaactcctgacctcaaatgatccacccacctctgcctcccaaagtgctgggattacaggcatgagccactgtgcccggccagcaaagtgttcttaagatgaagtttgacaaacatcctagaggccccctactggmcctggcacttgccatagggatgaggctcaggtcacatcatctggtcgctcagcatggagggatttggttcctaagattatcgttggggacaggtgactccttctgggtttcctccactgctgctggtacattgagtggagggggttatgttaatattggtctcattttcaggtcgagtaagggactggcaggcatggtggcttttctggtggtcttctgccctaacacttgttcttctcagctggctgacttttagaagtaaccaaggtaaaggtgggaaaggcaggctagcttagactc

SEQ ID NO: 115123 - DNA, 601 bp, Human
tggtgtagtcatatttgttttcccaacaaggactcctggatgtggtctgccttgaaccccatggacaccatgagctgtgtctttccgtggacttggtaatgagggagtggctcctggtgtggccttagtatcccctggtcgttattgactcatggatgccccataatctagcctattgtgttcctcttcctggggttgagggtaagcagtttgttcatgaggctttctagttctgaggaaatgaagaatgggattttgtaattcccgtaacatatctcgtcttgcagttccacaaaggtcwgtctgacaaatggcaagaccttgtcaccatggtgtagagaaggtctcccaggctccacaaatccactggggcagggagaagggtggtcataattttgtccctggaagatttctgaggcagcataagggggactcccacaaaatgtgcccagattctggctaacagtgaacctgctgccaaagccagagtctgctgtttttatgttgtaattggtatccagaaggaagttctctggcttcaggtccctgtggacaattttcttctggtggcaatactgcacagtagatactgtttgcagga

SEQ ID NO: 115124 - DNA, 601 bp, Human
tcttcctggggttgagggtaagcagtttgttcatgaggctttctagttctgaggaaatgaagaatgggattttgtaattcccgtaacatatctcgtcttgcagttccacaaaggtcagtctgacaaatggcaagaccttgtcaccatggtgtagagaaggtctcccaggctccacaaatccactggggcagggagaagggtggtcataattttgtccctggaagatttctgaggcagcataagggggactcccacaaaatgtgcccagattctggctaacagtgaacctgctgccaaagcyagagtctgctgtttttatgttgtaattggtatccagaaggaagttctctggcttcaggtccctgtggacaattttcttctggtggcaatactgcacagtagatactgtttgcaggaactggcctcaggtctctttctcctttctgtggccatactctaggatgtagtcaaatagctctgctctgctggcacattccaggactaaatataatgtttctgttgtcttggttgcttgagagagtttgctgatattggagtgattcaggaccttcattatactgaatatatatatactttggta

SEQ ID NO: 115125 - DNA, 601 bp, Human
tctcctcaccagacaaggtgagaccctgctacatggtgactgatatggtttggctgtgtccccacccagatctcatcttgaattcctatttgttgtgggagggacccggtgggaggtaattgaatcatgggggcaggtctttcctgtgctgttctcatgatagtggataaatctcatgagatctgatggctattgagagtttccctgcacaagcgctcctctctttgcctgccgccatccatgtgagatgtgacttgctcctccttgccttctgccgtgattgtgaggcttccccagccaygtggaactataaatccagttaaacctcttggttttgtaaattgcccagtcatgggtatgtctttatcagcagcatgaaaaaggactaatatggtaaatgggtaccagtagagtggggtgctgctgaaaagataaccaataatgtggaagccactttggaactgggtaacaggcagagatttgaagggtttggagggttcagaagaggacaggaaaatgtgggaaagtttggaacttcctagagacttgttgaatggctctgaccaaaagcctgatagcaatatggacaataaggcccagg

SEQ ID NO: 115126 - DNA, 601 bp, Human
tgattcacctgcctcagcctcccaaagtgctggggttacaggtgtgagccaccgagcctggccagccaaagaaatttctaagcagcaaagcattcaagaggtgatttgggtactattaaaggcattcagttttataagggaagcagagcataaaagttaggaaaatttgcagcctgacattgaaatagaaagtaaaaacttattttctgaggagaaattcaagcccttacagaaattacaagtagctgaatgttaactcccaagacaatggggaaaatgtctccagggcatgtcagaggtyctcatggcagcccttcccatcacaggcctggaggcctaggagaagatggtttcatgggccgggcctagggtccccgtggtttgtgcaaactggggacttggtgccctgcgtctcagcagctccagccgtggctgaaaggagccaatgtagagctcaggctgtggcttcagaggatgcaagccccaagctgtggcagcttccacgtggtgctgagtctgcgagtgcacagaagtcaagaattgaggtttgggaacctctgcctagatttcagaggatgcattgaaatgcctggatgtccag

SEQ ID NO: 115127 - DNA, 601 bp, Human
agaaaaatgaggacaaagacaaagtagagaaaaaagaaataaaatagaaaaaaacactacacatgaggaaacaacataattgtggtctctgtttgtcaggtcaccaaaaatcagcttactgggctgtgcagaccaaaaacctacatccagccaagtgcttatttaggtgtttgtaattccagaacaatggctccttataatatccagagcaagaaatgggccagttgtagctaggaataatccatagtggttttctcacttttggtctcaagaagcttttcctctttttttttttttttttaaagtgtttattctttaggtgggttatagaggttgatatttattttttttgaaacctgaagtatgctacaacagccttttttatttccaggttcaaaatctctaacaccttttggcttttaaacatgtcataatgtgtacactcaaaatattcaatacctttttctgaattaaactctgaatgtttggtctcaaaatgatgctacaaattaactgacatcatgataccctaaggaaatgttctgttgcataagacacaattgggtacattattaacatctgtagaatggagaggaggata

SEQ ID NO: 115128 - DNA, 601 bp, Human
ggacattagacaggaaatcaaatctgtatgaagatataatcatgtctgataaaggtaaatacatgaaaaattataaaagctagtagtgtttctgttttctacatgatttaagagacttatgtatcaagaagttattagtctgtgttttggacacacaacacattgagatgtagttttgtggcattaatggctgaaaggtgatggggttggagctgtataggagcagtttttatatgttattgaagttaacttggtatacattcacatcagagtagtataacttcagggtgttaaatatcasccccatggtaaccaaaaagaaaataactgtaggatatacacaaaaggaaatgaaaaggggattaaaatgtttttctacaaagatcaactaaacacaaaataagataataatgcaggaaataggggacaaaacaactgtgaggcatatatacaaaacaaacagcaaaatgacaaaagttctgccttatcagtgtttaaatgtaaatagcttaaaccctgcagtccaaagacagattggcagaatggatagaaaaacatccagcttctagccataagagacccactttagatgaaagacaaa

SEQ ID NO: 115129 - DNA, 601 bp, Human
agaaaacagagacaaggtcttgctgtgttgcccaggctggtctccaactcctgggcttaagcagtcttcctgcctcagcctcccaaagtgctggagttacacttgtgagccactgcgcccagcctattttattttttttatttttagagtcagggtcttgctctgtcacccaggctggagtacagtggtgcgattgtagctcactctaacttcaaagttctgggctcaagcagtcttctgtccttggcttcgcaaatcactgggattacaggtgtgagccaccacacctggctaatttttmaatttttttgtagaggcagcctctcactatattggttaggctggatttgaatttccggcctcaaatgatcttcctgccctagcctgtcaaattgctggggttacaggtgtgagccaccaccccagtgtttgtttttttgttttttttttttttttgagacagagtctggctctgtcgcccaggctggagtgcagtggcgctatctcggctcactgcaagctccgccttccaggttcacgccattctccagcgtcagactcccgagtaggtgggactacaggcgcccgccactacgcccag

SEQ ID NO: 115130 - DNA, 601 bp, Human
tcttgctctgtcacccaggctggagtacagtggtgcgattgtagctcactctaacttcaaagttctgggctcaagcagtcttctgtccttggcttcgcaaatcactgggattacaggtgtgagccaccacacctggctaatttttaaatttttttgtagaggcagcctctcactatattggttaggctggatttgaatttccggcctcaaatgatcttcctgccctagcctgtcaaattgctggggttacaggtgtgagccaccaccccagtgtttgtttttttgttttttttttttttttgagacagagtctggctctgtcgcccaggctggagtgcagtggcgctatctcggctcactgcaagctccgccttccaggttcacgccattctccagcgtcagactcccgagtaggtgggactacaggcgcccgccactacgcccagctaatttttttttgtatttttagtagagacggggtttcatcgtgttagccaggatggtctcggtctcctgacctcgtgatccgcccgcctcggcctcccaaagtgctgggaattacaggcgtgagccactggcccagcctcctgcgtttggtttt

SEQ ID NO: 115131 - DNA, 601 bp, Human
gaggcagcctctcactatattggttaggctggatttgaatttccggcctcaaatgatcttcctgccctagcctgtcaaattgctggggttacaggtgtgagccaccaccccagtgtttgtttttttgttttttttttttttttgagacagagtctggctctgtcgcccaggctggagtgcagtggcgctatctcggctcactgcaagctccgccttccaggttcacgccattctccagcgtcagactcccgagtaggtgggactacaggcgcccgccactacgcccagctaatttttttttgtatttttagtagagacggggtttcatcgtgttagccaggatggtctcggtctcctgacctcgtgatccgcccgcctcggcctcccaaagtgctgggaattacaggcgtgagccactggcccagcctcctgcgtttggttttttaattctgcttgtttgtagtgacattcatcaagaatgaatgactttaaaacaacaacgaaaaatctttagggatttttactcttgggcaagcatgcttctgtctctgagcattagttttctcatatatcagataaaagggtttggagtatatcaatg

SEQ ID NO: 115132 - DNA, 601 bp, Human
tctggttgtggacagaactcttgagggttccttgaacatgatcctttggtagcattggattgctctcggccatcccacgaatagctgtgttttatctgttttttgcttaagatttaacatatgagttcatttgaaatgtttctgttgccacaaagaaacaaaatccctggctcagagttttaaggggacttactgttctaatgctactcactcaggctttggttgagtagtaaacagactacagcttgtttttaagttcagtgatcttcaacttacagcccctgtgttttacaaatgagttaaattaagatcagtatcttctgttcaaattctttttccaaagaaatccaaatgtgccataagctgataggtctctggccatgaaatatggtttcatagttacattgagattgttgagtagctacagggaaactgagaatttacattctgaggcaaatggtttaacctaagaggaataagattaagtaaactgtgtattagctcctcataatgtggcaggaattcagtgttagcggtggaaaagccacaggagcttaatgtggtaggtaaggaaggtttatgttagttcctttccccgatt

SEQ ID NO: 115133 - DNA, 601 bp, Human
gactacctaaaagttgtctgagggaggctgtgcactgggtgatcttgtgaggcaggtggacgtctattctgccaagatcttgtgggcccagtttgagaatgggttttaagttttagtccttttacacttcctttgcaggaatgtagcttttgaaatagaagcaaagtgttgtgaaacctttgacattctgttctttaacacttcctcctcagcctgaagatctcagcttttgcttgggcgttacaacaccccatggtacctgaacctcaagtaagctctgttaggttttcatatctgcccrtgtatgatggtgactttttttttttctgagacggagtttcgctcttgttacccaggctggagtgcagtggcgcaatcttggctcactgcaacctccgcttcctgggttctagcgacttctcctgtctcagcctcccaagtagctggaattacaggcatgcaccaccacgcccggctaattttgtatttttagtagagacggggtttctccatattggtcaggctggtctctaactcccgacctcaggtgatctgcctgcctcggcctcccaaagtgctgggattataggcgtgaaccacc

SEQ ID NO: 115134 - DNA, 601 bp, Human
tgcctgtggaatcctccctacaaccctaagaggtggagaggaagcctttcttacagataaggatggaaattgtacagatgcacgaatttgtttctaaagctaagtagaaacaagagtaccaagaggtcagatttttccagcccccaaatccttggcgtaagtgtataaaaagtaagcacagctgttcttgaggtttctcagcctgttgcctcctccccatgttaaaattctggcctgtattcttctaagataatctctgtacccagttgaggattcaacatctaggtatcctctttgggargcgttcttaaagccctcatataatgggttagattcctgatcacctctaaccccttttgtgttgagagtttcttttgattacgaagtcatacatagtcattgttttaaaacttaaaatatggcaaaccatagtcaaagtcctctatacccccccatcccactcggaggaagaagtcttgactattcttatgacatcatacatttattgccattttcctgtctgcttatccagggtctccttaaaccaagcttgaggtagggagactatcttggtcatctttgcatctctagcagttgggct

SEQ ID NO: 115135 - DNA, 601 bp, Human
gcccccaaatccttggcgtaagtgtataaaaagtaagcacagctgttcttgaggtttctcagcctgttgcctcctccccatgttaaaattctggcctgtattcttctaagataatctctgtacccagttgaggattcaacatctaggtatcctctttgggaagcgttcttaaagccctcatataatgggttagattcctgatcacctctaaccccttttgtgttgagagtttcttttgattacgaagtcatacatagtcattgttttaaaacttaaaatatggcaaaccatagtcaaagtmctctatacccccccatcccactcggaggaagaagtcttgactattcttatgacatcatacatttattgccattttcctgtctgcttatccagggtctccttaaaccaagcttgaggtagggagactatcttggtcatctttgcatctctagcagttgggctggtgcaggtgcttgggaaatgaatctgtgttaagatcaccagcctctgaacaggccttatgtaccaaggtctgtgtccagattggcatgacctctgagttaacagtcctttatttagatctttaagactgagttctctg

SEQ ID NO: 115136 - DNA, 601 bp, Human
ttaagggttcctgctaactcttcccaaggaattggaaggagtgtttactaagtgttccattcccgtttaagctctcttctcccaacacagttaaccaagcaaactgttacttattctttataataaaattcctccccgtcacagtttttcttaacctcctcaagtcttatcacccccctacttcccaccgtgaccctcaaaatggaagtgattatatgaagacctgaaggattacttaaatctcagtgagtattgagtgccttctgggagtggggagtgagatggggtgagagttactggkcagacaaacttggagtactttggaaggtttgctttggggcatttcttattgttgaagttacctggaccccacttcagtgggagagcctgagggtggagattagaagcagaatctgtttagctagattaggatccagtgagagcttctgcctcaactgtcctgttcagaaagccactcctcctctaatgtggaatagcttcacagtttattatgaaaaaatgtcagacatatacaaagcaaagagactcagtgtaaaagatacactctcctacctactttcaacagttagcattttctgta

SEQ ID NO: 115137 - DNA, 601 bp, Human
ttgcagcttcatcagtttctcggcatgttccctctcctcatgagattggtgaagaaagtatgtggcaaagttcctcaaagccacatcatcgcggtcaaagttgtaagacacggacaggtaaacgtaggaggcgtagagctccaggttgatctggccgttgatggcggcctctgagtcctggtggtagttctggcgcacctgcgaggtggacgcagttgtcatggcagcaactaaggagaggtggcggcggtggctgcgcggcgctggagcggcggcgggggccttgggatggtccgagggygcagtgaagaggggacagagggctggctacgggcggccggccggggtgggggacgagcgctgggttccgtccaagcactgttgaagcaggaaaccccgacgactctcggcgaagaatgtctctgctacccacaactttctcactgtgccaaaatcagtgcctgtccagtaccctcgccttttctacctctcctctgctagcgatactgtgtttaagtcgagtgaccttcctctccttcctcaccatccctgcttctcacacttacccatactcttactaaatcagcttaccattactctt

SEQ ID NO: 115138 - DNA, 601 bp, Human
acgactctcggcgaagaatgtctctgctacccacaactttctcactgtgccaaaatcagtgcctgtccagtaccctcgccttttctacctctcctctgctagcgatactgtgtttaagtcgagtgaccttcctctccttcctcaccatccctgcttctcacacttacccatactcttactaaatcagcttaccattactcttgctaattcaactcaagtaatacaattaaacacctcctaaaatgaagaaatcccttacatcttcagttaacctctgtcttagttcctttgggctattgtygcaagatatcttagactggataatttataaacaacagaagtttattgcccacagtttggaggctgaggaagtccattatcagggctccaatagattcactgtctagtgagggtcacacttctggatggtgtcttttatgtgtcctcacatggtggaaggggcgaggtggctcgctgcagccactttcctaagggccctagtcccattcacaaggtccctgcccttcctgacttaatcactcccccaaaggctctacctctacttttttttttttttttccccgagacagagtttctctct

SEQ ID NO: 115139 - DNA, 601 bp, Human
ttagttcctttgggctattgttgcaagatatcttagactggataatttataaacaacagaagtttattgcccacagtttggaggctgaggaagtccattatcagggctccaatagattcactgtctagtgagggtcacacttctggatggtgtcttttatgtgtcctcacatggtggaaggggcgaggtggctcgctgcagccactttcctaagggccctagtcccattcacaaggtccctgcccttcctgacttaatcactcccccaaaggctctacctctacttttttttttttttttycccgagacagagtttctctcttgtcgcccaagttggagtacaatggctcagtctcggctcactgcaacctccgcctcccaggttcaagtgattttcctacctcagcctcccaagtagctgggattacaggtgcatgccaccactctgggctaatttttatatttttagtagagacggagtttcaccatgttggccaggctggtcttgaactcctgacctcaggtgatccacccacctcagcctcccagagtgctgtgattacaggcatgagccaccacacccagccaggccccacgtctt

SEQ ID NO: 115140 - DNA, 601 bp, Human
gaatggtcatacattttggttggttggtttgtttgtttattttttgtagagatggcagagcagatcccataggaatggtcatgtgtgtgtgtttggtttttttctttattttttatagagatggggttttaccatgttaaccaggctggttttgaactcctgaactcaagcaatccacccacctcagcctcccaaagtgctgggattacaggcatgagccatcgtgcctggcctgggtcatatgtttaactctttgaggaactgccagactgttttccaaaatggctgcaccactttacaytcccaccagcggtgtagaagagttctaatttctccacatgctcgtcaaaactcgttttctgtttttttttttaattctagtggtcctagttggtatgaagtggattcttctttcttttgaccatcactggggtctgatttgccctgataccatctcttgctgcagccttcatgcctagtgcctgatcctgcctcaccctgctgcgcgttggcattcagatttgacttaaaatccgagtggctcagcctctgctctgaattgtcccttcagtcaggtgtttgcaactagtctcctgaggag

SEQ ID NO: 115141 - DNA, 601 bp, Human
cctgataccatctcttgctgcagccttcatgcctagtgcctgatcctgcctcaccctgctgcgcgttggcattcagatttgacttaaaatccgagtggctcagcctctgctctgaattgtcccttcagtcaggtgtttgcaactagtctcctgaggagttgctgggtttgagtcacagaatacaagagggatgccccttccaggatctgggggttgggaaagtgtggcaaggcaggtttaagatagaagaggaagtcagctgtagcaagcaaacacatagacctgggctgtgggaccctcrgaagggatatggagccaagctcttggagtgcctgaggaattagcccaaggagctttggctttcagtagctgctcctgtgtgtagcaaagcaggctggagtagagtgaagggagcctggggtaaggaaataaattaggagtcaagaagtaatgatgcaactaggattgtggaaatgtaaagaggttagggaaagatttgtatggctggggctaaaccagatgtgatggttggggtaaagggacataggaagtggttttgggtatgagaacaagagaaagtgttcctcttgggaaggacaga

SEQ ID NO: 115142 - DNA, 601 bp, Human
taagggcacatgccaccacacctggctaatttttttttttttttttggtagagacaatgtctcactttgttgtctaggctgctctcaaactcccagcttcagcctttccaccttagcttcccaaagtactgggattacaggcgtgagacactgcgcccagcctaaagtgtgtgcagttcaaatattcacaaggttgtacaaccgtcaccatctaattacagaaccgtttcttttctcttttcctttcctttccttttttctttctttctttccctttttttttttttttttttttttttttaaggaaacagggtctcactctcatggagctgggaccacaggtgtacaccaccacacccagctgatttttgtaattttttgtagagacagggtcttgccatgttgcccaggatttcttcaaactcctgggctcaagtgatttgcctgtctctgcttcccagagtgctgggattacaggcatgagccaccacacccggcccagaacattttcatcaccccaaagtatatatctaacttttaaaatggtttttccctttcacattcttaccagcagtgtacaggagttccatctgctccatat

SEQ ID NO: 115143 - DNA, 601 bp, Human
tggtgaagcatctattagatcttttgcccacttattttattgggttggtttttttcttactgtgtttgagagttctttgtatattctgattacaagtctttttgtcagatatgtgatttccaaatattttctctcagtctgtgtctttccattctattaatagtgtttttggaagagcagaagctcttagtgttgatgaagtccaatttgtcaatccttctagggattgtgcttttgatgtgctatctgttaaaagacaaaattacaacacatttaaagatcttagttggcttttatttgyaattcgtgaatgagggcagcttccattctacaaaataggatgaaaactcccaatgggcagtagcagaagaatgggctttgtaaggtgggaacagtgaaacagtaattgaaagataactgattggttaacatcaggttacttttttgtaaggattaaagcagagggtagttccttatcatgcctgctaaaactggcttgtttgggtattctgtctctcttgattttttagaaggtcagataaacaacttacttttcttttttccttttttctttttttttttttttgagacggagtctcgc

SEQ ID NO: 115144 - DNA, 601 bp, Human
cagctaatttttgtatttctggtagagacggggttttcatcatgttagccagggaggtctcaaatttctgacctcaagtgatccggccgcctcagcctcccaaagtgctgggattacaggcgtgagccactgggcccagcctacaattttaagttctataattggtagaaaatttcctcagtttggggggctcatcttcaagagtggagactaaagtaggttctgtaattgcgctggctaaagaacaaagaattctatagcactgtgagctggagaatgttgtagcaggttaataaggggyttactccattttgtcagtaaccagcattggttccaggaattcaagaggtggtgagatattatgcttaatggtaataagataccacttattggtaatgtaccaggcattggtctctggcatcttaccatctttgtactcatatcttcacaggagcacaagaaaattaaaccatccaccttttacagatttagggatttagtagaaggctgaaggaggccagataactgaacttttacttgtacagctaatattaagtcggtgcaatagtaattgcggtttttgcaattacttttaaagttt

SEQ ID NO: 115145 - DNA, 601 bp, Human
cgcctaactggttttcatatttttttggtggagacggggtttcgctgtgttggccgggctggtctccagctcctaaccgcgagtgatctgccagcctcggccccccgaggtgccaggattgcagacggagtctcgttcactcagtgctcagtgttgcccaggctggagtgcagtggcgtgatctcggctcgctacaacctccacctcccagccgcctgccttggcctcccaaagtgccgagattgcagcctctgcccggccaccaccccgtctgggaagtgaggagcgtctctgcctggcygcccatcgtctgggatgcgaggagcccctctgcccggctgcccagtctgggaagtgaggagcgcctcttcccggccgccatcccatctaggaagtaaggagcgtctctgcccggctgcccattgtctgagatgtggggagcgcctctgcccggccgcgaccccgtctgggatatgaggagcccctccgcccggcagccgccccatctgagaagtgaggagcccctccacccagcagccgccccatctgagaagtgaggagcccctccgcccggcagccgccccatctgagaagtgaggag

SEQ ID NO: 115146 - DNA, 601 bp, Human
tgaggagcccctccgcccggcagccgccccatctgagaagtgaggagcccctccacccagcagccgccccatctgagaagtgaggagcccctccgcccggcagccgccccatctgagaagtgaggagcccctccacccggcagccgccccgtctgagaagtgaggcgcccctctgcccggcagccaccccgtccgggagggaggtggggggcagcccccgcccggccagccgccccgtccgggagggaggtgggggtcagcccccgcccagcaagccgacccgtccgggaggtggggggcrcctctgcccggccgccccttctgggaagtgaggagcccctctgcccggccaccaccccgtctgggaggtgtacccaacagctcattgagaacgggccatgatgacgatggcggttttgcagaatagaaaagggggaaaggtggggaaaagatagcgaaatcagattgttgctgtgtctgtgtagaaagaagtagacatcactttgttctgtactaagaaaaattcttctgccttgggatgctgttgatctatgaccttacctccaaccatgtgctctctgaaacatgtgctgtgtccact

SEQ ID NO: 115147 - DNA, 601 bp, Human
cgcccggcagccgccccatctgagaagtgaggagcccctccacccggcagccgccccgtctgagaagtgaggcgcccctctgcccggcagccaccccgtccgggagggaggtggggggcagcccccgcccggccagccgccccgtccgggagggaggtgggggtcagcccccgcccagcaagccgacccgtccgggaggtggggggcgcctctgcccggccgccccttctgggaagtgaggagcccctctgcccggccaccaccccgtctgggaggtgtacccaacagctcattgagaacrggccatgatgacgatggcggttttgcagaatagaaaagggggaaaggtggggaaaagatagcgaaatcagattgttgctgtgtctgtgtagaaagaagtagacatcactttgttctgtactaagaaaaattcttctgccttgggatgctgttgatctatgaccttacctccaaccatgtgctctctgaaacatgtgctgtgtccactcagggttaaatggattaagggcggtgcaagatgtgctttgttaaacagatgcttgaaggcagcatgctccttaagagtcatcaccactcccta

SEQ ID NO: 115148 - DNA, 601 bp, Human
aggctggagtgcagtggcacggtcttggctcactgcaagctccgctcccgggttcacgccattctcctgcctcagcctcccgagtagctgggaccacaggcgcccgccaccacgcccagctaattttttgtatttttagtagagacagggtttcaccgtgttagccaggatggtctcgatctcctgccctcgtgatccgcccacctcggcctcccaaagtgctgggattacaggcttgagccaccgcacctggccttgggttcaagtgattcttgtgcctcagcctcccgtatggctgggwttacaggtgtgagtcactacacctggctaatttttgtatttttagtagagacggggtttcaccgttgttggccaggttggtctcaaactcccaacctcagatgatccacccaccttggcctcccaaagtgttgggattacaggcgtgagccactgcgcccggccgacatcccttcttaatgtccttttcttaaatgtatgaggagtgggccactgagcagggagagccctggttggggtcctttgattggagaatagcagtaataatggggaggagaggtagaaatgcaacctggacatt

SEQ ID NO: 115149 - DNA, 601 bp, Human
ttctgtcttggcctcccaaagttgcaggattacaggtgtgtgccactatgcctgaccaactacgttttcttgatccattcgtccatggatggatacttaagttgattccatatttcagttactgtgaataatactgcagtgaacatgtgagtgcagatctcttccacgtactgattccatatcctttggctatatcattggatcaaatgggagttctatttttaatactttcagcagcctccatactgttttccataatggctgtactgatttacattcccaccaacagtgtgcaagggtkccattgctccacatcctaacaccaatctttgtctttttggtagtagccattctaacgggtgtgaggtggtatctcagtgtggctttagtttgcatttccctgatgattagttgagctacacacacacacacacacacacacacacacacacacacccctattagtcatttgtctattttcttctgagaaatgtctttttaggtcctttgcccattttaaaaattagattatttgttttcttgcaattgagttgcttgagttccttatatgtttagggtattaagcccttatcagatatat

SEQ ID NO: 115150 - DNA, 601 bp, Human
cgctacagccttgacatcctgggctcaagtgatcttcccacttcagcctcccaagtagctgggactacaggcgcatgccaccacacttggctaaggttttctttcttttgttttctgtagagatggggtctccctatgtggcccaggctgttcttaaactcctgggttcaagcagtcctcgcaatgtattgggattacaggcaagagccactgcacccagcctctattgttcttataatacttgataataaaacacatgtgactgccttgcaaaactccttagaactcctcaggaggactrtctccaatctgatgaaactaaactatcactagcagattttcacacctaatcagagaaaactttgtgttacacagaattgtaaaaatttgcattgaagttttaaaactttaccctgctcagccaaggactctataaaagctgctccagtcaatcattgtgatcaatttctgtttagtttttgagatggagtcttactctgtctcctgtgcagtggcgcgatcttggctcattgcaacctctgcctcccgggttcaagcgattctcccacttcatcctcccaagtagctgggattacaggtg

SEQ ID NO: 115151 - DNA, 601 bp, Human
gggtcttcaaactggttgctggaattggggtctgatatacatcttaagcaatccttaaataaaagccttatgattctaatgtcagagatgctgtctataggaacagtggggacacaaatcaattttcacacaattttatgaccctgatgttagaaatcctatctctaggaacagtggggatgcaaaaagtcagacttgtagcaacaaggaaaggggccaaagtacagtctgattaatgctttgttgtaactatatttctatccagaaccagcaggccatttttttcaactctgtggaggcrgtttcagaattgtgtagatgcccttgtccaggaaggagttgtgaagtagctagttgaatatagccactgaggtttccagtttaacacttacaaagctacaggacacaatcttgtacttaccagcttatagagaactgagatggcccctttttgaagtaagaaagtgtttacagttttgtctgcaggtcatccccagcacctagctcagtaatggacacttcatggcactcagcaagtgtttgaactggatttggtgtgtttaccccctagctcatggtcagtgactactgcttctgaatt

SEQ ID NO: 115152 - DNA, 601 bp, Human
cagtatttctgctggtagtgctctctcctttgctgtactttgccatgattatgtcatctgggccaccagacagcagacctctagatggcaggtccagccatctcttctcttttgctttccgtgtctggtgaatgcacgtaacattcccaatttagcacaggcgtctagatagacttcagccataaaatcctagcacaaactagtattccctcagttaacagtgaagcttaaatataactaaataccactgtatctttaaaaatagatttggttgagaatcacctcaaacttagcatgtctraaatcaaacacaattcctccccaagaaacacgttactgtttttcagacttccctgatctaagaaatcctcttggtcccatgagacataaacacaggtgacttccttggcgttttccctcatttcccatacccatcccaatccaatccatcactagatgccatccacctttactttctccccattctcttctgctttcacactggtctagtgcagtcctctcttgcctgaaggtggcgcagcatcctcactgtccaccgcagggtctcctaccctccccactgcaggcaggcagggcgctg

SEQ ID NO: 115153 - DNA, 601 bp, Human
ctagaaacaagtgtcccattcttgatctgggagaacattaagtacaaaaatataccttttaacttttgccagtttaaagccatcaatgtcctggtgaaagaagatgtggaattcttagtatcagctgtttagtaccatttgcaacaactctgaaatgcttagccagccctgagtgaagatgaaaatctgcatttaaatgtaatttgtcttacatgatgagtggagatttttgtcatcagaaattgatttgaaaaaatcaacagattaacatttttctccaaagtggaggtggctgtttgaktgtaaaggtaatgtgctcctctaagagtcacagttaagtataaggaaacaaaaacatctgtaatcccaccacatggaacaacttgctaatatttgtgtatattcctttctgcttcatgtgtaaccatttttacatttaaatctttactcctttgggaatctcttggaagaggagatgtagagatcttaattctcaccaaaatttttctggctcttaccatttagtgaattgttcatctttttgccactgaattttataatgccatatttgtcaaaattgttcatttctggtgtctgtttc

SEQ ID NO: 115154 - DNA, 601 bp, Human
ttattcaaattctttttttctctgtaaaattatttttctcatttaggtcctgtactcgtgctaaccactgtaatagtgattgttgtataaatgggaaaaatctttcaggaaagtgaattagcaaaaatcatgaaaacttcttcatgttttgtttgtttttttttttaaagacaattttgctcttgttgcccaggctggagtgcggtggtgtgatctcagctcactgaaacctccgcctcctgagttcaagcgattctcctgcttcagcctttttggtagctgggattagttgcccaccacsacgaccagctaattttttgtatttttggtagagacagagttttcccatgttggccaggctggtctcgaactcctggcctcaggtgattcaccttccttggcctcccaaagtgctgggattataggcgtgagccaccgcgcctggccaaaactttgctctggactcagaaatcccatccctaaacagaatctgtgagttacagttgacaaaatcctttccttgcatgagaatttgacttttgtttaactttctagctctgtttccctgggagctagataaggcagaacataacatttgttt

SEQ ID NO: 115155 - DNA, 601 bp, Human
tctggactcagaaatcccatccctaaacagaatctgtgagttacagttgacaaaatcctttccttgcatgagaatttgacttttgtttaactttctagctctgtttccctgggagctagataaggcagaacataacatttgtttctgggcatggtccttgtggtaaaatgtcccctggttggtaaattacatttggatgggaaagagccatggataagtgatgggccacccaggcttttgtttcatggaacacagtgactctgctgggcatgtccttatggggagcctaaggagctgtcaraagagatacttgcacccccaggattgagcattctgagtcaaggtattgagtcggcacagtctccctgtgcctgagccatcttctgtatggactcttgcaagaactgctgctgctgatgacctgccactgccctgcctgccagctttgtctgtcccagtctttctcagtgggcttgtgccacatgtggcctgtgataatcttacgagtcagaatctagaaagatctacccacccatcaaccctcacacaggtgttgctgtatctcaaggaagtaatcccatagattacagcattttttcca

SEQ ID NO: 115156 - DNA, 601 bp, Human
gtgcagtggcgtgatctcggctcactgcaacctccgcctcccgggttcaaacgattctcctgcctcagcctcctgagtagctgggattacaggcgcgtgccaccatgcccagctaattttgttttgttttttgtttttttgagacggagtctcgctctgtcgcctaggctggagtgcagtggcgcaatctcggctcactgcaacctccacctcccgggttcaagccattctccagcctcagcctcctgagtagctgggactacaggcacatgccaccacgcccagctaatttttcatatttagtagagacggggtttcaccgtgttagccaggctggtctcgatctcctgatctcatgatccgcccgccttggcctcccaaagtgctaggattacaggtatgagccactgtgcccagcaatttttgtatttttagtagagacagggtttcatcatgttagccaggctggtcttgaactcctgaccttgtgatccacccacctcgggcctcccaaagtgccgttattacaagcatgagccaccgtgcccagccttttctatttttagtagagacggggtttcaccatgttggccaggctggt

SEQ ID NO: 115157 - DNA, 601 bp, Human
agcctcctgagtagctgggattacaggcgcgtgccaccatgcccagctaattttgttttgttttttgtttttttgagacggagtctcgctctgtcgcctaggctggagtgcagtggcgcaatctcggctcactgcaacctccacctcccgggttcaagccattctccagcctcagcctcctgagtagctgggactacaggcacatgccaccacgcccagctaatttttcatatttagtagagacggggtttcaccgtgttagccaggctggtctcgatctcctgatctcatgatccgcccrccttggcctcccaaagtgctaggattacaggtatgagccactgtgcccagcaatttttgtatttttagtagagacagggtttcatcatgttagccaggctggtcttgaactcctgaccttgtgatccacccacctcgggcctcccaaagtgccgttattacaagcatgagccaccgtgcccagccttttctatttttagtagagacggggtttcaccatgttggccaggctggtctcgaactcctgacctcatgatttgcctaccttggcctccccttctttctatttgaaacttgcccc

SEQ ID NO: 115158 - DNA, 601 bp, Human
tagctgggactacaggcacatgccaccacgcccagctaatttttcatatttagtagagacggggtttcaccgtgttagccaggctggtctcgatctcctgatctcatgatccgcccgccttggcctcccaaagtgctaggattacaggtatgagccactgtgcccagcaatttttgtatttttagtagagacagggtttcatcatgttagccaggctggtcttgaactcctgaccttgtgatccacccacctcgggcctcccaaagtgccgttattacaagcatgagccaccgtgcccagmcttttctatttttagtagagacggggtttcaccatgttggccaggctggtctcgaactcctgacctcatgatttgcctaccttggcctccccttctttctatttgaaacttgcccccattatcatcatctgatctctatcttgaaatatgataccagaccttagagtgtgacatttaaactttgaccagtcaaagcggtccctggggagaaaggtaggggaatagtggggctccacatataatggatagtttggggtatacctctcagtgctgattatgatggaagacagaactccaagt

SEQ ID NO: 115159 - DNA, 601 bp, Human
agtgcttttaggcctgccttccccaaacttgtgcaaaaagtctcaccaagcccttgttcgattccaggttttgccacctctcaccttgtagattctggcttagatggtctgggttggaaaacactgccttcggctgtctaggtacctccaggttctttaacacaaatatgaacatgttcctttgtggccaagaaaggtgatatcactggctatgggggggacggtttttgtattagctttaggttaccttaaccttatcacacaaaaatcacacattgtctcttgctgagttttcttactrgaaaacatatttggaggagcattctttgaggtggatttgttttggtgatatattggtgctttttctgcttcagattttaaactttaaagcagcaaattgtctgagtggtgtgtgtctgctgaaagccaaggtcttcctcctggtgttacttcatcaagctaaatagcagccactaaatggagaaacatctaagatagcagggatactgttggaatagcagaacagtcttaatagtgaagcttcttttagaaagcagtatatttgctggcatccttctagaatggaaaaaataatactagg

SEQ ID NO: 115160 - DNA, 601 bp, Human
tgcacacagccggcacacagcacatggttgggcctctctcagttctcatgagctgttggtgaattgaagttaactctacttgcatcttaagtgacttttccaactctgtggtctttttaagtcctttgaacatagggaaaaagtaattttttatttggttatgtcattttaagtttctatgtttcctgtgtctacctcagatttttctgtaattcagctggaatttgttttggcttatggcagaaaagagagacttgcctttcctctcaagagagctcagccagttgtttgaaatcattcrgctatgttacacaagccgtttccctccctgaatagaccgtggcctgtgctaaatgctcgtatgtgctgggatctgtttctggtctctccagtctgttctggtgatgtccatgccatgttcccttatctggactgtgttgatttgactgcctgatgaggcaagtttcctcttgccacagtccggttggtgtttgtaatgttttttttttttgagacggagtcttgctctgttccccaggctggaatgcaatggcgtgatctcgggctcactgcaacctccgcctcccaggttcaagcggtt

SEQ ID NO: 115161 - DNA, 601 bp, Human
gcctctctcagttctcatgagctgttggtgaattgaagttaactctacttgcatcttaagtgacttttccaactctgtggtctttttaagtcctttgaacatagggaaaaagtaattttttatttggttatgtcattttaagtttctatgtttcctgtgtctacctcagatttttctgtaattcagctggaatttgttttggcttatggcagaaaagagagacttgcctttcctctcaagagagctcagccagttgtttgaaatcattcagctatgttacacaagccgtttccctccctgratagaccgtggcctgtgctaaatgctcgtatgtgctgggatctgtttctggtctctccagtctgttctggtgatgtccatgccatgttcccttatctggactgtgttgatttgactgcctgatgaggcaagtttcctcttgccacagtccggttggtgtttgtaatgttttttttttttgagacggagtcttgctctgttccccaggctggaatgcaatggcgtgatctcgggctcactgcaacctccgcctcccaggttcaagcggttctcctgcctcagcctcctgagtagctgggat

SEQ ID NO: 115162 - DNA, 436 bp, Human
acactggctgagggttgccagatgtttgagaaaagctagtaaatccagaccattgttaaccattggcaactatagggaacatacagaaagcatctgaactggatgtggtagagctcccagatcatgatctgattgrgaatgtccatgaacttctgtcctgattgctcagtgcagactgctgcttcttctggcaagactcctctcttcacattgacctggagttgtcacaaaatctgtttttctcttgctactcccctgagcatggcaccttctgccagagcgctcccttaactgtgtgggcaggctctgcttcacagctccccgcccactctgcccaagcagaagtgagcccctcctgggcagaaagtgcccgcaatgagggctgaaatgtttctattccctgagtaaccaacctttctctgtttccttgtccagg

SEQ ID NO: 115163 - DNA, 601 bp, Human
cagtagagaccacatgagctaatcatagtcaatgccttatcaagcaagagagccctccataaatgggcacgtgtggtgcttcaaggcagaaaggccctctcatatctggtcctgtagtgcctgtccctagtttttttttgtttgtttttttttccgggggcgggggtgggtgtattttaatcacattgttggaggttgaggaccatggatggagaacgcattgtccctttaggagagcagccagaaactgctggggactctgagccatgcatatcctgtaggtgtaactgtaacctagtcrtgtgttatgtgttttatttttagttgacctagttgctaacacttagatgtgtaattctgcatttgtcacaggagaggaagatttggcagcagaggccctgtattccaacatatgtaagcccccacctggaatggaatagttgccacttagaagcaattttattaaaatagtagtagttcaggtcgtgagtcactttaggttttgcagaagtgcctcattgagttagatcttgaattctactttgctacacttttctacatttccacttctcaggctcctcagctggtttctttcctcgtg

SEQ ID NO: 115164 - DNA, 601 bp, Human
caataaaagtaccagtgatgtactaaatttctattcatatgtatgacaaatgtatctaacatgctttaccgttagggggaaacaaagggggaaagacacaatagatgggtggcaaatcttacaaactttacaaaacactgaaaagctgcatctggattgcagtcacaattataaaagcaaataaagctctgaaataaaggaaaagaaaaaaattctaagtgatcatcaagagtgaaaaaggtttattcaatactagtttttagtacagcaccatttaacactgactaattgaaaaaaaaaacaggataattcaccgtttgcaaggacacaggaaacaatttctacataccttctataagacagttacacttcttcacacttgcatggctcaaatcctttcaaacgtttccaaaaatacagtcttataataaacgaggttccccaatgacacacattttattctgtagacttagccataacacgttttaaaatacataaagaattcatcctcgacagaaacaaggagtcacaaaggctctctacttattcagaatcattacataaaacaccatctgtaactgcaaacagggtttgagaaaat

SEQ ID NO: 115165 - DNA, 601 bp, Human
tctcagtatgcacaatttcattcaaggatgaacattttaaactcaaaagtttatttccatggaaaataaagtttggatcagaattttctatacaaccttataagacccacgtctccatatagttataatagtcaacttttcttaaaattatttttggacaactcaactcaacttgaccagtatttttctactaggctaatatatttcaaccataagtgcattcttcattttctcccctcctccctactcacctcccacccaacaaattccctttgtatgtctgcaaggcaaggtactatayaatgcagtataattctaaggcagtttgaatatataattcttataacaggaatctagaattattaaccttactttttacaataaaagtaccagtgatgtactaaatttctattcatatgtatgacaaatgtatctaacatgctttaccgttagggggaaacaaagggggaaagacacaatagatgggtggcaaatcttacaaactttacaaaacactgaaaagctgcatctggattgcagtcacaattataaaagcaaataaagctctgaaataaaggaaaagaaaaaaattctaagtgat

SEQ ID NO: 115166 - DNA, 601 bp, Human
acattcacactatttccatgaaaaaccattcacttcataggcaatgtttcagcatactcaagtgtgcttcgttttcaaaaagctgttaggaataactaaccatattctacattaaagctacaaaaggggtaataaagaacagcatatgtatttttcagtattctcaatagaatctcagtatgcacaatttcattcaaggatgaacattttaaactcaaaagtttatttccatggaaaataaagtttggatcagaattttctatacaaccttataagacccacgtctccatatagttataayagtcaacttttcttaaaattatttttggacaactcaactcaacttgaccagtatttttctactaggctaatatatttcaaccataagtgcattcttcattttctcccctcctccctactcacctcccacccaacaaattccctttgtatgtctgcaaggcaaggtactatacaatgcagtataattctaaggcagtttgaatatataattcttataacaggaatctagaattattaaccttactttttacaataaaagtaccagtgatgtactaaatttctattcatatgtatgacaaat

SEQ ID NO: 115167 - DNA, 601 bp, Human
gaattgcatgagcctgggagatggaggttccagtgagctgagatcacgccactgcactccactctgggcaaaagagtgagaccctgtctcaaaaaaaaaaaaaaaccaaataagtcttctatgaagctggatagtaaagatgtcaatgccattcttcccactaactctttttgcttttagaaaatatagttattttttcatttagaaaaattatgctaacatgtttgccaggcatggtggcgcagagggatgctgaggcagaaggatcacttgagcccaggggttcaaggccagtctgggrcaacaaagcaagaccctgtctcaaaaaaaaaagccatatgtataatgctttattattttttaatgaattaaatatattttaatttctcagttatattctaatactacaaatatcaatagatataatccacttaaagagaagccctttgaggtcttctaattttttaagtctaaaaggggtactgagaccaaaaaaaattgagaaccacttttctagactttcctatattcatgttttgcaaaacaaaacttttcattttctaattatctaaggaagagacgttgctgccctaaagataat

SEQ ID NO: 115168 - DNA, 601 bp, Human
gcaggagaattgcatgagcctgggagatggaggttccagtgagctgagatcacgccactgcactccactctgggcaaaagagtgagaccctgtctcaaaaaaaaaaaaaaaccaaataagtcttctatgaagctggatagtaaagatgtcaatgccattcttcccactaactctttttgcttttagaaaatatagttattttttcatttagaaaaattatgctaacatgtttgccaggcatggtggcgcagagggatgctgaggcagaaggatcacttgagcccaggggttcaaggccagyctgggacaacaaagcaagaccctgtctcaaaaaaaaaagccatatgtataatgctttattattttttaatgaattaaatatattttaatttctcagttatattctaatactacaaatatcaatagatataatccacttaaagagaagccctttgaggtcttctaattttttaagtctaaaaggggtactgagaccaaaaaaaattgagaaccacttttctagactttcctatattcatgttttgcaaaacaaaacttttcattttctaattatctaaggaagagacgttgctgccctaaa

SEQ ID NO: 115169 - DNA, 601 bp, Human
tcagctgggtgcagtggctcacacctgtaatcccagcactttgggaggccgaggcgggaagaccacctgaggttgggagttcgagaccagcctgaccaacatggagaaaccccatctctactaaaaatacaaaatcagctgggcgtggtggcacatgcctgtaatcccagctacttgggagcctgaggcaggagaatcgctggaacccaggaggcggaggttgcggtgagccgagctcgcaccattgcactccagcctgggcaataagggtgaaactctttttcaaaaaaaaaaaaaaaaaggccgggcgtggtggctcacacctgtaatcctagcactttgggaggccgaggcgggtggattgcctgaggtcaggagtttgagaccagtctggccaacatggtgaaaccccgtctctacttaaaatacgaaaaataagctgggtgtggtggtacacacctgtaatcccagctactcgggaggctgaggcaggagaattgcctgaacacaggagtcggagattgcagtgagcagaaatcatgccactgtactccagactgggggacaagagcgagactttgtctcaaaaaaaattttaaaa

SEQ ID NO: 115170 - DNA, 601 bp, Human
taaatatggcaatcataaacacgtcctatcttttctacattctaagaaaaatataaaagtattcatgatcagctgggtgcagtggctcacacctgtaatcccagcactttgggaggccgaggcgggaagaccacctgaggttgggagttcgagaccagcctgaccaacatggagaaaccccatctctactaaaaatacaaaatcagctgggcgtggtggcacatgcctgtaatcccagctacttgggagcctgaggcaggagaatcgctggaacccaggaggcggaggttgcggtgagccragctcgcaccattgcactccagcctgggcaataagggtgaaactctttttcaaaaaaaaaaaaaaaaaggccgggcgtggtggctcacacctgtaatcctagcactttgggaggccgaggcgggtggattgcctgaggtcaggagtttgagaccagtctggccaacatggtgaaaccccgtctctacttaaaatacgaaaaataagctgggtgtggtggtacacacctgtaatcccagctactcgggaggctgaggcaggagaattgcctgaacacaggagtcggagattgcagtgagca

SEQ ID NO: 115171 - DNA, 601 bp, Human
ctaatttttttatttttagtagagatagggtttcaccatgttggccaggctggtctcgaactcctgacctcaagtgatccacccacctcggcacctcaaagtgctgggattacaggtgtgagccaccgcgcccggcctattcatttctaattgttcaaagtttcaaacacaattttactcagagctatataaatcttgctaataacattaagtattgcattttttttcattattccctttgttacaataagtgcccagccaattatcttcataagtttagaggtcacatgctgataataartaatattaacattttaaagcttaagtcacaaaatgaagctagttggatccatgggcctaaaatttaacaaaatacttgggcactggatgtttagggaaaaaagatacaagctgggcatggtgacacatgactgtagtcccagttactcaggaggctaaggtgggaggatcacctgagcccaagagtttaggctgcagtgagccactgcacccctcagtgacaaaatgagaccctgtctcaaaaaaagaaaaaagaaaaaaagatatgaaggaaatacaacagcctgacctcaagaaactt

SEQ ID NO: 115172 - DNA, 601 bp, Human
tattgacaaagacaataacactgaagagagttatggttttccaaattactttcctagcatcaattctctccctcttcctctttaacagaatctctccccaatacaaccatatacctcagtagaagccaacaccattccagattgagaaacgtgattaacctaagggttatttactggtgactggttcaggaactagcctatgacccaattctggccaaaaagatgggaaagaagtttgctagaggtttttgtagaaagtttcctctatccaaaaacagtggcacaggaagagatacttttmctcttcttttggaagttgttatttatggatatgatatgatgcctggaatcaccgcaaccattttgctactagcctgaggatgaagccagtcccaaggatggcagaattgagcaatatatggctaagcaaaatatgggtttatactgacattgttgaactactgaaatcaactaactctattaaatgagaagataaaatttattatttttaaagccattttgaattagttctgttgcttgcagctgaaaacatatgaattaaacactttttataaaatacatcccagaactaatatcagaa

SEQ ID NO: 115173 - DNA, 601 bp, Human
gccaaaggacacatgttaagaagtggcagaggcacaatctgaactcaggcgttctgattccagagacccctctcttaactactccactatactgcctctagatttctaacatactgagaaaaatcaatacttaggcacatcatacattttaattgaaagatataatctacaggttactttaaagtagtattccatttttttgttttttttgagatagcctcactatgctgcccaggctgatctccaactcttggtctcaagcaaaactccaccttggccttgtaagtagctgagactacargtatgtgccattgtaaccaactcctaattttttttttttttttttttttgagacagggtctcgctctgtcacccaggctggagtacagtggtataatcacagctcagcgcagcctcgacttccagggctcaagtgatcctcccacctcagcctcccaagtagctgggactataagaatgcaccaccatgcacagctaatttttgtattttttgtaaagacgaggtttcttcatgttgcccagtctggacggctcctaatttttcaggctagctttcaaatcataaatcattccacaggtc

SEQ ID NO: 115174 - DNA, 601 bp, Human
tactcgggaggctgaggtaagaggattgcttgagcctaggaggttaaggctgtagtgaaccaagatcatgccactgcactccagcctgggcaacagagtgaaacctgtctcgaaagaaagaaagaaagaaagagaaagaaagagagaaaaataggtcaggcataatggctcaggcctgtaaccccagcacttgggaggccagggtaagggaattgcctgaggccaggagttcaaggccagtctggacaacacagcaagatcgtgtctctacaaaaataaatttgttttaattagccaggtrtggtagtgcacgcctgtagttggtcctagctactcagaaggctaaggtgggaggaccacttgagcccaggaggtcaaggctacagtgagctgttggtgacactgcactccagcctgggcaacacagcaagacccagtcacgcacacacaaaaaaacccacacagaaaaatacatcaaaatatatataaatagctttggcattactttaaaagttagacttattaattattaaagcatatatagcatatggagaaatacaaagctaagaaattagaaaataaagtgagtaagtcagtttgg

SEQ ID NO: 115175 - DNA, 601 bp, Human
aattatagtacaatctaaatttatcaactaatgtttatttaaaaagtaactcatgaacaagctttcatcaaacaactaaggccacatatactgttagttggcaactggatgtcagagatctgaatcacttaacacttcaaaaaagagaaaaattagctgggcatggtggcatgcacttgtagtcccagctactcgggaggctgaggtaagaggattgcttgagcctaggaggttaaggctgtagtgaaccaagatcatgccactgcactccagcctgggcaacagagtgaaacctgtctcraaagaaagaaagaaagaaagagaaagaaagagagaaaaataggtcaggcataatggctcaggcctgtaaccccagcacttgggaggccagggtaagggaattgcctgaggccaggagttcaaggccagtctggacaacacagcaagatcgtgtctctacaaaaataaatttgttttaattagccaggtgtggtagtgcacgcctgtagttggtcctagctactcagaaggctaaggtgggaggaccacttgagcccaggaggtcaaggctacagtgagctgttggtgacactgcactcca

SEQ ID NO: 115176 - DNA, 601 bp, Human
aaaaatataggacacacagttaaatttgaatttcaaataaacaatgaataatactgcatggtccatactgcatatattttatctggcaatactaaatttcaagggctgaacactaggaaccagtcccagttagagagatatgatagcagctcttatatagtttatgactatctggagaaaaactaaattccaagtcccgaattaatgtcctgcaacaggtctgaaccacctcgttgtccttctaaaactaaacagactttttttccaaaagccaaaacatattatatcctctaccacagayaagtgtgacagaaacaaaaatgttgctatatttgagtattcatagcttcttttctttgctctcttggttcctggcccttattgtacagatcagaataatgacacgggcaaaggagagagtttaatgggagacaggtactcacggaatagaaacttaataggtttgagaagggttacaaaagaaacgcaaaaataagactgctcaagttgtcatgagttggtaagttttaagagagaagaaagtttgggattaaccatgccaaacatgaagaaataggattttaagtagtattgtagtttt

SEQ ID NO: 115177 - DNA, 601 bp, Human
tggttcttaaagtgtggtttgtgaccagcaaaatcagtaacatctgggaacgtgttacaaatataacttcttggaaccaagcctacggaacctactcaactagacattttgggggtaggacctagcaatttgtgtgttttgtttttgttttttgagatagcatcttctctgtcatctaggctggagtgcagtggcataatcacagctcagtgtagcctcgacctcccaggttcaagcaatcctcccatctcagcctcccaagtagccgagactacaggcatacaccaccaagcctcactawttttttttttttttttttttttggtagagacagagtttcaccatgttgcccaggctgatcttgaattcctggactcacgtaatcctcccgcctggtcctccaacagtgctgggattacaggcatgagccacagtgcctggctgcaatctgtaatttaacaagtcctccaggtagttctaatgcacactcaagtttaaaagccactggtctagacacagaaagctacccagattttaagacagtgatcctttggagcacaagatggttcaattagtgtcaagcttaggattttgcactgta

SEQ ID NO: 115178 - DNA, 601 bp, Human
cagtggttcttaaagtgtggtttgtgaccagcaaaatcagtaacatctgggaacgtgttacaaatataacttcttggaaccaagcctacggaacctactcaactagacattttgggggtaggacctagcaatttgtgtgttttgtttttgttttttgagatagcatcttctctgtcatctaggctggagtgcagtggcataatcacagctcagtgtagcctcgacctcccaggttcaagcaatcctcccatctcagcctcccaagtagccgagactacaggcatacaccaccaagcctcamtaattttttttttttttttttttttggtagagacagagtttcaccatgttgcccaggctgatcttgaattcctggactcacgtaatcctcccgcctggtcctccaacagtgctgggattacaggcatgagccacagtgcctggctgcaatctgtaatttaacaagtcctccaggtagttctaatgcacactcaagtttaaaagccactggtctagacacagaaagctacccagattttaagacagtgatcctttggagcacaagatggttcaattagtgtcaagcttaggattttgcact

SEQ ID NO: 115179 - DNA, 601 bp, Human
aactttatgcatttattcaggctgttacgtctcctactccaccagtaaaccaatcattccctatttcatttatatattcttctattgctatactttgacattcattcaatcaatatttactgaatactttgtatgtgccagagacagggctaggtattgaagatccagcaactaattatggactcagtccttatcctgatggaatttataatttaatgaggactaaagacactaaacgataataagtatggttaaggattataaaggtggtaggtagtacagtatctattaaaaatatatyttagatgacaggagaaagagaaggaattataaagaggagcgatgcatgggtatatttacagatatgtctttcataattacagtctgagcttcttgaggacagggattatgtaatcttcatatccctagccaggacagtaaacagcaacgtatagtaacgtacactgactaaactacaaagatcactgccctattcactcctgggctgatcactgtgactatgcaagtgctctcattgacgaggcctagatcacgtgcccacccttaaaccaatgggttaggccaaccacccaagccacat

SEQ ID NO: 115180 - DNA, 601 bp, Human
cctaaccagttttccttctttaatcttattctcctccaatctattttttaccttacagccactgtactctcttccctacttaaaaccaatcagtggcttcccaaatgcctgcaggataaaattcaacccctaaatatagccttcggggcctttcatgatctggaccgcacctagtggtccagattcatctaataccacttcctatctctcaattttttttttttttttttttgagacaaggttatgctctgttgcccaggctggagtgcaatgacccaatcatagttcactgcagcctcctgggctcaaggaatcctcccacttcagcctcccaagtagctgggactacagtcatgtgccaccacacccagccagattttttttaaagagatgggggtctcactatgttgcccaggctggtatcaaactcctcagctcaagagatcctcccaccacagcctcccaaagtgccagaattataggcatgagccaccatgcgcaggccacgtcctatctcatacattgtcttcaacaaaacttaaggtgttttaataactttatgcatttattcaggctgttacgtctcctactccaccagtaa

SEQ ID NO: 115181 - DNA, 601 bp, Human
tcctaaccagttttccttctttaatcttattctcctccaatctattttttaccttacagccactgtactctcttccctacttaaaaccaatcagtggcttcccaaatgcctgcaggataaaattcaacccctaaatatagccttcggggcctttcatgatctggaccgcacctagtggtccagattcatctaataccacttcctatctctcaattttttttttttttttttttgagacaaggttatgctctgttgcccaggctggagtgcaatgacccaatcatagttcactgcagcctcmtgggctcaaggaatcctcccacttcagcctcccaagtagctgggactacagtcatgtgccaccacacccagccagattttttttaaagagatgggggtctcactatgttgcccaggctggtatcaaactcctcagctcaagagatcctcccaccacagcctcccaaagtgccagaattataggcatgagccaccatgcgcaggccacgtcctatctcatacattgtcttcaacaaaacttaaggtgttttaataactttatgcatttattcaggctgttacgtctcctactccaccagta

SEQ ID NO: 115182 - DNA, 601 bp, Human
attcattctcactgctacaatcttagccttaggctttcataacatctttcttctgtactaaaatagcctcctaaccagttttccttctttaatcttattctcctccaatctattttttaccttacagccactgtactctcttccctacttaaaaccaatcagtggcttcccaaatgcctgcaggataaaattcaacccctaaatatagccttcggggcctttcatgatctggaccgcacctagtggtccagattcatctaataccacttcctatctctcaattttttttttttttttttttgagacaaggttatgctctgttgcccaggctggagtgcaatgacccaatcatagttcactgcagcctcctgggctcaaggaatcctcccacttcagcctcccaagtagctgggactacagtcatgtgccaccacacccagccagattttttttaaagagatgggggtctcactatgttgcccaggctggtatcaaactcctcagctcaagagatcctcccaccacagcctcccaaagtgccagaattataggcatgagccaccatgcgcaggccacgtcctatctcatacattgtcttcaa

SEQ ID NO: 115183 - DNA, 601 bp, Human
ggtgttatttcattacatatatatgtgaatatatatatatgggcacataaatattataattcttatttaaaaatccttgtgaattaagtattattacttccattttatatgacaaccattcaatgtcacatagttggtaagcagaccaaattcaaaccagtcttctaacaatacttcttcctctcaaggcagcatgtacacaaagcttctcagaaacccaaaacatgccccaccgctgccttcttacctctgggggtaagaaggggaatataattagaaaagggcatgttttaggctccaygcagtgctcatacctgtaaccccagcaccttgggagactgaggcgggcagatcacttgaggccaggaattcaagaccagcctggccaacatgataaaaccccatctctactaaaaatacaaaaattagccgcgtgtagctgtgtgcacctgtaatcccagctactcaggaggctgaggcatgagaattgcttgaacccagaggcagagattgcagtgagctgagatcacaccactgcacttcagcctgggtgacagagccagactctgtctcaaaaaaaagggtgggggggcatgttttg

SEQ ID NO: 115184 - DNA, 601 bp, Human
agcctgagccaccacgcccagcccagctactttttttttaagactcaaattatgcatgtttttttccatgaaactttccctcatattctcaggccttgttaagtaatacctcttctttgattctacagagctcttctcaaccttctaatctaaagtttagtgattatagtttagttgttgaaccctatctttgtactcaaagactatgagctcctttagggcacatattttcttacccatctttgtatctccagtgccaagtgtttcacacatagaagccattcaataaatatttgttgarttactgcttgagatggtcagcatttaggcttaccatagagaggaagtgaagatccaagaagtaattatgctgaacagcagtggaattttactgagacacaaaatgaaaaaaagcggaggggggagggtcagcctgggaacagaaaaagttggttttttttttttaattttcccatagaaaaagttgaaatgacccataaaaaaagaaagatggtcactcacacttgctacattgcttctcttgtcccaagattttacccatcctgatcttagagccaaacatactagagccaagtagcct

SEQ ID NO: 115185 - DNA, 601 bp, Human
tacaccaatacctgcagctcatccaaacacacaactctttctcatgcctttgcacatatcctgtacctcataaaatgcccatccctatctcttttaccaacctgcctcatccacttttttttttttctttttgagatggggtctcactctgttgcccaagctggagtgcagtggcacgatctcagctcactgcaacctctacctcgcaggttcaagtgattctcctggctcagcctcccgagtagctgagactacaggcacatgccaccaggcttggctttttttttttttttttttttttagtagtagagttgaggtttcaccatgttggccaggctggtctcgaactcctgacctcaagttatgcacccacctttgcctcccaaagtgccgagattacaggtgtgagccaccaggctcagcctgagccaccacgcccagcccagctactttttttttaagactcaaattatgcatgtttttttccatgaaactttccctcatattctcaggccttgttaagtaatacctcttctttgattctacagagctcttctcaaccttctaatctaaagtttagtgattatagtttagttgttga

SEQ ID NO: 115186 - DNA, 601 bp, Human
ccactacaaatttacagtttctaatcctaactgagattactatcctgttggtaattcatccacatgcctcaggatcagtgaccttttccatcccagacagtaatcaatgggtactctaaatctcaagccaaacactctatacatctcttctctcacaattgccctttaccagaaaaaataaatctgacctcaccccattttccagcctacactcttcgtcatacccatatccttcattctaaatgttaggcaaaggtttatctcctccttccctgagctagcacagtaatcccttcttgcytccacacccaccaccttcctgttccatcaaatcacacagccctaaatattcagtcttaactctattctactccaccaaaacataacacatgcttaactttcatcttcaaaaaaattatgtttctcggccaggcgcggtggctcacgcctgtaatcccagcactttgggaggccaaggcgggcggatcacgaggtcaggagatcgagactatcctggctaacacggtgaaaccgtgtctctactaaaaatacaaaaaattagccgggcatggtagtgagcgcctatagtcccagctactgg

SEQ ID NO: 115187 - DNA, 601 bp, Human
tcatgtgaataggtgtgaccaatacaatggttttgtatcttttcatcattatgccctaaacaatctcttgaatattacagttattactaaccctttgtacaatatacagcacttttattaccttaacattataaaataagtacttttataaactcttcataaacataaatgttaatagcagaaacacagctttttatatgaatgtatcatcatttacttaattattcacttaatgttgaacatcacccactctcttgccaggatctctccagctccctatggttcttttgccacactagcyagtaaatctctgaacgaggaggatcaatccaactgcctgcttcctctattcccataccacagctactgagtcctgctgaagaaaatcataacaggttaggaattcattccactacaaatttacagtttctaatcctaactgagattactatcctgttggtaattcatccacatgcctcaggatcagtgaccttttccatcccagacagtaatcaatgggtactctaaatctcaagccaaacactctatacatctcttctctcacaattgccctttaccagaaaaaataaatctgacctca

SEQ ID NO: 115188 - DNA, 601 bp, Human
tgatatccacagattgattgccttagtcttttttttctttttttgacagagtttcactcttgttgcccaggatggagtgcaatggcgtgatctcggctcactgcaacctctgccgcctgggttcaagcaattctcctgcctcagcctcccaagtagctgggattacaagcacgtgcaaccacgcctggctaattttgtattttcagtacaaacggggtcaggctggtctcaaactcctgacctcagatgatccacccgcctcagcctcccaaagtgctgggattacaggcgtgagccaccrtgcccggctgccttagtcttttaaaaacaataagcagctcatgcctgtaatctcaacactttgggaggccaaggcgagtggatcacttgaggtcaggaattccagaccggcctggccaacatggtgaaagcctactaaaaatacaaaaattagccaggcatggtggcaggtgcctgtaatcccagctactccggaggctgaggcatgagaattgcttgaacctgggaggttgcagtaagcctagattgcaccactgagatcatgccactgcactccagcctgggtgacagagtgagactc

SEQ ID NO: 115189 - DNA, 601 bp, Human
aagcaatcttaaatgataccccagggatcagcaaataatgttgagtcctttatgatatccacagattgattgccttagtcttttttttctttttttgacagagtttcactcttgttgcccaggatggagtgcaatggcgtgatctcggctcactgcaacctctgccgcctgggttcaagcaattctcctgcctcagcctcccaagtagctgggattacaagcacgtgcaaccacgcctggctaattttgtattttcagtacaaacggggtcaggctggtctcaaactcctgacctcagatratccacccgcctcagcctcccaaagtgctgggattacaggcgtgagccaccgtgcccggctgccttagtcttttaaaaacaataagcagctcatgcctgtaatctcaacactttgggaggccaaggcgagtggatcacttgaggtcaggaattccagaccggcctggccaacatggtgaaagcctactaaaaatacaaaaattagccaggcatggtggcaggtgcctgtaatcccagctactccggaggctgaggcatgagaattgcttgaacctgggaggttgcagtaagcctagattg

SEQ ID NO: 115190 - DNA, 601 bp, Human
taagtagctgggattacaggtgcctgccaccacgcccagctaattttttgtatttttagtacagatggggtttcaccatgttggccaggctggtctcaaactcctgaccttgtgatccacctgcctcggcctcccaaagtgctgggattacaggcatgaaccaccacgcccggccatgatggtatattttatattatgtgaaggtcttttttttgttgtttttttgagatggagtctcactcttttgcccaagctggggtgaagtgacgtgatctcagctcactgcaacctctgctccccrggttcaagcaattctcctgcctcagcctcctgcatagctgggattacaggatgcaccaccatgcctggctagttttttttgtatttttagtagaggcagagtttcactatgttggccaggttggtctcaaactcctgacctcaggtgatccactcgcctcggacttccaaagtgttgagattacaggcgtgagccaccacgcctggacatgaagttttttaaaactgcaatgataaaaaaaaggaaatcgtacgggcctagaattgttctggtagattttttaaatcactaattaaattt

SEQ ID NO: 115191 - DNA, 601 bp, Human
tagcagacctatgttcacaggagcaccattcacaatagctaagaggtggaagcaacccaaagtctatcaacagattaatggataaacaaaatgtggtatatacataaagggaatattattcagccttaaaaaggaagaaaatcctttcatatgctacaatataactgaaacttgaagacattatactgagtgaaataagccaaagacaaatattgcatgatcccacttacttatacgaggtaactgaagtagacaaaatcatagaaacaaagtaaaggttggttaccaggggttgcgtgayaggggaaacgacgagtcactgtttaatgggtacagagtttcagatgtgcaagatgaaatctggagatctgcttcaaaacaatgttaatatgcttagtatcacttaacaatacacttgaaaatggttatgatgggccaggcacggtgactcacacctgtaatcctagcactttgtgaaggcagactgcctgagctccagagttggagaccagcctgggaaacatggtgaaaccccgtctttactaaaatacaaaaaattggccaggcacagtggcaggtgcctgtaatcccagctactcag

SEQ ID NO: 115192 - DNA, 601 bp, Human
aatctatatgggccggattaagatggctactaaaagaaaaaagaaagaaaagaagagtgttggtaaggaagtggagtaactggaacccttgagcactgttggtgagattgtaaaatggtgcaactgctatggaaaacagtatggaggttcctcaaaaaaaatttttaaaataccatatgatccagcaatccttcttattctgggtatatatcttaaaaaaaaaaaaaaaaaaaaaaaaaaaacctgaaagcagagtctcaaagagacattatagtagcagacctatgttcacaggagcacyattcacaatagctaagaggtggaagcaacccaaagtctatcaacagattaatggataaacaaaatgtggtatatacataaagggaatattattcagccttaaaaaggaagaaaatcctttcatatgctacaatataactgaaacttgaagacattatactgagtgaaataagccaaagacaaatattgcatgatcccacttacttatacgaggtaactgaagtagacaaaatcatagaaacaaagtaaaggttggttaccaggggttgcgtgataggggaaacgacgagtcactgtttaa

SEQ ID NO: 115193 - DNA, 601 bp, Human
ataaacaaaatgtggtctatatgtacaatgcggtattattcagccataaaaatgagtaacgttctgatacatgccgcaatatggatgaacaccaacattatgctaaatgaaataagaagacacaaaaggacaaatattgtatgattcaatttacatgaaatatctagaataggcaaattcatacaggaagttgaacagaatttaccaggagctgaaagtgaagggagaatgagggagttattgcttaatggttatagagtttctatatggaagatgaatacagctgcacaacactgtaaawgtaattaatgccactgaattgtacacttcaaacagttaaaatgaaaaattttgtcattcgtattttataactttaaaaaattaacaatgtaatgtatcaaaacattgaattgtatacttttttttttttttttttttttttgagacggagtctcgtgccgcccaggctggagtgcagtggcgcaatctcggctcactgcaggctccgccccctggggttcacgccattcttctgcctcagcctcccgagtagctgggactacaggcgcccaccacctcgcccggctaattttttgtattt

SEQ ID NO: 115194 - DNA, 601 bp, Human
cattaacatctttaatcatcacatacattttttaatatggtaagtagaaatctcattttattttccatataaataaccaattgttccattatcatttactgtttagtcagtccatcatctccttactcatcttcaatgctcactgtcatgtattaagtttctttatattcgggggttctatttctgggctctttattcttcccagaggttggtctatcctgtgccaataccacattgccttaaatattaataatatggctttataaataatgctatgtgaaagactaagtgctccttcctratttttcttgacagtttactctcctacatacattttagagcttgtcaagttatatgaaataccctgtcattatattaaacagaagtgtattgaacttataaattaatttggaaagaactgacatgtttatgtcactgggtcttcctatcagttaatatggtatcccaattacatctcttctcatgtcttttaatggaaattgtatacttttcaacataaaaagtcatgtgcatcttttgctgattttgttcactggtacctttcaattgttgtcattgtagctgttgctgctataatgag

SEQ ID NO: 115195 - DNA, 601 bp, Human
gaagtcaaacacaaaaggccatataccatgtcattccatttacatgaaatgtccataataggcaaacttatagagacagaaagtagattaatagttgccacagactgaggctaagaagaatggggaatgactttttcttttttttgagacaggatcttacttatccacccaggctggagtgcagtggcactatcatagctgacaacctcaaactactgagttcaagtgatcctcccacattggccttccaagtaactgggactacaggcacacgacaccatgcttagctaattttttttttatttttgtagagacagggtctcgctaaattgcccaagctggtcttgaactcctggcttcaattgatcctcccacctcagtctcccagagctgggattatgggcatgagccaccccacccagcctagagtgactcttgatggttacaggacttcttttggggtgataagaatgttctggaataagatagttgtaatagttgcacaactatgtgactatattaaaaaccactgatgtggttaaaaacacttttaaaaggtggatatatggcatgtgaattatatcataacagaaaaagtagt

SEQ ID NO: 115196 - DNA, 601 bp, Human
tagccataaaaaggaatgaagtaatgatacataccacaattggataaaccttgaaaacattatgctaagtgaaagaagtcaaacacaaaaggccatataccatgtcattccatttacatgaaatgtccataataggcaaacttatagagacagaaagtagattaatagttgccacagactgaggctaagaagaatggggaatgactttttcttttttttgagacaggatcttacttatccacccaggctggagtgcagtggcactatcatagctgacaacctcaaactactgagttcaagygatcctcccacattggccttccaagtaactgggactacaggcacacgacaccatgcttagctaattttttttttatttttgtagagacagggtctcgctaaattgcccaagctggtcttgaactcctggcttcaattgatcctcccacctcagtctcccagagctgggattatgggcatgagccaccccacccagcctagagtgactcttgatggttacaggacttcttttggggtgataagaatgttctggaataagatagttgtaatagttgcacaactatgtgactatattaaaaac

SEQ ID NO: 115197 - DNA, 601 bp, Human
cagaaatactatttgacccagtaatctcactactgggtatataccaaaaagaatataaatcatcctattattaagatacatgcatgtgtatgttcattgcagcactatacacaatagcaaaggcacaaaatcaatctaaatgcccatcaatgatagactggataaagaaaatgtggtatatatacagcatggaatactatgcagccataaaaaggaacaagataatgtcctttgcagggacatggatggagttggaagccattatcctcagcaaactttgagaggccaaggcaggaggatygcaggaacagaaaaccaaacactgcttatcctcacttataagtgggaactaaatgatgagaacacatggacaacatggcagggaacaacacactctggggcctgtcgcggggtggtagggggagagagagcatcaggaggaatagctaatggatgctgggcttaatacctaggtgatgggatgatctgtgtagcaaatcaccatggcacatgtttacctatgtaacaaacgtgcacatcctgcacatgtacccctgaacttaaaagtagaaggaaaaaaacaattagaagggaacaatta

SEQ ID NO: 115198 - DNA, 601 bp, Human
caaatgctatttttccccagtggaatgatttctctgtagtgtgctcattagtaacactaaccccttcctataccccaacaaccaactgctttgtgagctaaatcccaatcccaaatcagacactgttggcaaaactaatctctgaatgaaaatggtacaacagccaatcacaacgtagaatttggatcgtatgttactgacgttgagagagaaaactgtgccatttccagcaggtagttttagttgagtttcttggctcagcaaaattaaacgatgattttatctttggagacacatatgrtattttcataaaattatactactatttctctctgaaaatacattttttaaaaactgtttcacaatcaaaataaacaattacttcaacaactagagtgtggcgattcctcaaagacctaaaggcagaaatactatttgacccagtaatctcactactgggtatataccaaaaagaatataaatcatcctattattaagatacatgcatgtgtatgttcattgcagcactatacacaatagcaaaggcacaaaatcaatctaaatgcccatcaatgatagactggataaagaaaatgtggta

SEQ ID NO: 115199 - DNA, 601 bp, Human
ccagcctaggcaaattagccatgcgtggtggcaggtgcctgtaatcccagctatttgggaggctgaggcaggagaatcgcttgaacccaggaggcagagtttgcagtgagccaagataatgccactgcactccagtctgggtgacagagtgagactccatctcaaaaaaaaaaaaaaaaacatcctaggcaacatatggagaaactgtctctacaaaaaatacagcaatcagccgggtatggtggtgtgtgcctgtagtcccagctgtttaggaggctgaggtgggaggatcacctgagcscaggatgtcgaggctacagtgagccaagattgcaccactgcactccagactgggcaacagagtgagaccctgtctcaaaaaaaaaaaaagtgtcgaagatgaacgatgttatcaaagacacaaaacaaacctaaaatattccatcagatattaaattctgactatctgttaaagaaccaagaaacaagaaaaaaatcccaaagatatctatttgtgataactagatattataaaaggttcaaaatacaaaataaaacaaaataatgtgataatatatacttcctaaaattcacaaatcta

SEQ ID NO: 115200 - DNA, 601 bp, Human
agctggtactggtagtttagtatcctagagatcataaactagtagatcagaatttgcctttaagtttcattaggaagaaataaagacactattactaattcatgtttctggtttgcagttaactcatttaagctatatttagttactcattttggtcaatctactgaaaagaaatactgtaagggatttgcaatgccccctaatttctccttctctgtcaacttctcacatttgctttctaaaaaattcttaatatttaccttccaaatagtaaatgcaatcttctacaaatatctttgayatgaaaatgctcagtttaagaaaaatgtttcagtcacataaatctttgctatatagtattgagggcatttaaatactaagaacataaattattatgttaaatgttgtcagccaagtgtggtggctcatgcatgtaatcctagcactttgggaggcctacgcgggcagatcacttgagtccaggagtttaagaccagcctaggcaaattagccatgcgtggtggcaggtgcctgtaatcccagctatttgggaggctgaggcaggagaatcgcttgaacccaggaggcagagtttgcagtg

SEQ ID NO: 115201 - DNA, 601 bp, Human
ctttactgtatgcaaattttgaagtattttttaatcagctgtataacatcttaaatgaaggcgccttagcccaactccctacagattctgattccattgatccagaatgagacctgggcaactatgtttttttaaaaaaggcaattggtaattctggtataaaactagaataagaatcacattcctaacctcacaaacgtactccttgacttctgttttgttttgttttgttttgtttttgagacggagtctcgctctgtcgcccaggctggagtgcagtggtgctatctcgactcactgmaacctccacctcccagattcaagcaattctcctgcctcagcctcccgagtagctggtactacaggcacgtgccaccacgcccggctaattttttgtatttttagtagagaaggggtttcatcatgttagccaggctggtctccatctcctgaactcgtgatccgcctgcctcggcctctcaaagtgctgggattacaggagtgagccaccgcgcttggccctctctctacatctttaccacttactccaataatcccagttctttcacctcaatgagacctccaatttacagcaatacta

SEQ ID NO: 115202 - DNA, 601 bp, Human
catttgtggcctgcaaagcctaaagtagttactatatggctctttacagaaaaaatgtcaattccagatctagacttaaggaaatggtagagaaaatattaattcattgtaataatctccactcttctgaattctatggctgtagctttagtgcaacgagcaaatttgagggtattcaaaaccaaacatatataatcatccctcagtatcctcataggattgcttccaggacccctgcagataccaaaatccaaggatgttcaaagtccattttataaaatgacgtaatatttgcatatakcttatgcacatcctcccatatactttaagtcatctctagattacttgtatctaatacaatgtaaaggctatgtaaataattgttatactatatttttatttgtattatttttgttgttgtattgttatttttattggtttttttcacacacaccctgaatatttctaatccacagttgtttgttatttcaatccgagaatgcagaatctgtgaatacagcgggcccaccatatttcctcacctgtcctatccaccctatcctgataaagggcaccactatgcatttgtcaaaactcaaag

SEQ ID NO: 115203 - DNA, 601 bp, Human
gttgttcacaatctggcaggtaaagctgaaatctcccaggaagtggaacaaagagagaaagtaatgaaaaaataggagaaagataagagaatcagaggatcaactcagaagatccagcatcaaactaatagaagttccagaaagcaggaagagaaacattaaaataaataagaaaaaattttcagaactgaaggacacacatttcctgaatgaaaatgcccacagagtatgccacacaatgaatgaaaaagatccatatcaagctacacccctgtggaatttcacaacactggggaaaaasagaaggtcctaaaatctatcacaaggggaaaaaaaaaaaaaaaggtcacaaaggactaaagaatgtctttgggttgctcaacaacactggagactagcaacactgaagataaaccttccaaatctgagggaaaatgatttttcaagctagaatgatatatcctgccaaattatcaattacatatgatggtagaatagatattttcagatatacaagatctcaaccaacttatctctcagcatcctttcttaggaagctcctgaatgatgtgctccaccaaaatgaagaaataaactagga

SEQ ID NO: 115204 - DNA, 601 bp, Human
tttaagttgttcacaatctggcaggtaaagctgaaatctcccaggaagtggaacaaagagagaaagtaatgaaaaaataggagaaagataagagaatcagaggatcaactcagaagatccagcatcaaactaatagaagttccagaaagcaggaagagaaacattaaaataaataagaaaaaattttcagaactgaaggacacacatttcctgaatgaaaatgcccacagagtatgccacacaatgaatgaaaaagatccatatcaagctacacccctgtggaatttcacaacactggggraaaagagaaggtcctaaaatctatcacaaggggaaaaaaaaaaaaaaaggtcacaaaggactaaagaatgtctttgggttgctcaacaacactggagactagcaacactgaagataaaccttccaaatctgagggaaaatgatttttcaagctagaatgatatatcctgccaaattatcaattacatatgatggtagaatagatattttcagatatacaagatctcaaccaacttatctctcagcatcctttcttaggaagctcctgaatgatgtgctccaccaaaatgaagaaataaac

SEQ ID NO: 115205 - DNA, 601 bp, Human
gctgttggccaagggctgagggaaggatggaatagaagttagtatttaatgggtatagagtttcaactggggaaaatgaaaaagttctggaggtggatggtggtgatggttgcacaacagtatgaatgtacttaatgccacagaatttaaacatttttaaatggttaaaaacagctgagtgtgatggctcatgcctctgatctcaacattctgggaggccaagacaggagtattgcttgagcccaagagtttgagaccagcctgggcaacagagcaagatcccatctctaaaataaataaataaatattttaaaagaaacagataaaatggttaaaatgataaattacatgttacatatatttaccacaacttaaaataaaaaaacaacagacatttgaggaaagccattacattaaaggtgaccaaaacaagaagaaacttgggagtaaccagagaattaaagggaaaaaaaacttcacagacacacaaagacagcataatatctcagatatataaaaggaaagactgcatctatgaaagacaaacaagatctatatcaaagtaacattcaaagaacaagagcccttatatattaaaatt

SEQ ID NO: 115206 - DNA, 601 bp, Human
cttggcctcccaaagtgctgggattatatgcatgggccactcacgcctggcctatattaacaagttttaaaatattagcaatacagaaagatattttcaattccgttttaattaatatgtagctatatgaagaaacatagagacatatagatgttttaagtgtgtgtatgtgtgcatatagatatgtgtgcatagaaacatatgaagagtacacaaactgttaatagtgaatacaatagggatggggaacagcagagaacactgtaggtatgtatgtatattgtatatgttttctttatatgttttaacaacaaaaatggtgccaggtgcagtggtgtgcacctatacccccagctactcgggaggctgagatgggaggattgcttgaagccagaagttcgaacccacagtgtgctatgattgcacatgtgaatagccactgcactccaacttgtaatccctgaactttgggaggtcgaggcaggtggatcacctgaggtaaggagtttgagaccagcctggccaacacggtgaaaccctgtctctactaaaaatacaaaaattagctgagagtggtggcaagcacctgtaatcccagcta

SEQ ID NO: 115207 - DNA, 601 bp, Human
gaagttggatccctgcctcacaccaaaattaactaaaaattgatcaaagacctaaatatcaagacctaaaactataaaattcttacaagaaaaaataggcttaaatctttgtgactttagattaggtaatggtttcttaaatatgacactgaaaataacaaacaagaaaaaaatagattaactgcatcaaaattaaaaacttctgtacttcaaaggacatcaccaagaaagtgaagagacaacctataggatgggagaacgtttttgtaagtagaaatgataaaatatatttttgtaaatrtttgtaaatgtatctataaatatatttttgtacttgtatctaaatacataaaagaatcctttcaattcaataaaagacaaatgacccaattaaatatggggaaaggatctgaatatatatttctccaaaagacaaacaagtggccaataagcacatgaaaagatactgaacataatcagccaacagagaaatgcacatcaaaaccacagtgaaataccacttcacacccactaggatgactataataaaaaagacagataataacaagtgttggtgaggatgtagagaaattggaatact

SEQ ID NO: 115208 - DNA, 601 bp, Human
ctttttaacaaattgttctggaacaagcagatatccacatgcaaaaagaatgaagttggatccctgcctcacaccaaaattaactaaaaattgatcaaagacctaaatatcaagacctaaaactataaaattcttacaagaaaaaataggcttaaatctttgtgactttagattaggtaatggtttcttaaatatgacactgaaaataacaaacaagaaaaaaatagattaactgcatcaaaattaaaaacttctgtacttcaaaggacatcaccaagaaagtgaagagacaacctatagsatgggagaacgtttttgtaagtagaaatgataaaatatatttttgtaaatgtttgtaaatgtatctataaatatatttttgtacttgtatctaaatacataaaagaatcctttcaattcaataaaagacaaatgacccaattaaatatggggaaaggatctgaatatatatttctccaaaagacaaacaagtggccaataagcacatgaaaagatactgaacataatcagccaacagagaaatgcacatcaaaaccacagtgaaataccacttcacacccactaggatgactataataaa

SEQ ID NO: 115209 - DNA, 601 bp, Human
tcaggagttcgaggtcaggagtttgagaccagcctggccaacatgattaaaccccatctctactaaaaatacaaatattagctgggcgtggtggtgcacacctgtaatcccagctactcgggaggctgaagcaggagaattgctagaacccgggaggcagaggttgcagtgagccgagattgcaccactgcactccagcctggagacagagtgagattttgtctcaaaaataaacaaataaagaaataaagtcccttagtcaactgattttcaacatggatgtcaaaataattcaatgagrgaaagaatattctttttaacaaattgttctggaacaagcagatatccacatgcaaaaagaatgaagttggatccctgcctcacaccaaaattaactaaaaattgatcaaagacctaaatatcaagacctaaaactataaaattcttacaagaaaaaataggcttaaatctttgtgactttagattaggtaatggtttcttaaatatgacactgaaaataacaaacaagaaaaaaatagattaactgcatcaaaattaaaaacttctgtacttcaaaggacatcaccaagaaagtgaagag

SEQ ID NO: 115210 - DNA, 601 bp, Human
tatgacatagtagtagtacagcagtgttagttttctgattttgatggttatattgtgcttctgtaggaaaatgttcttgtttgtgggaaatacacacaacatggtcatcatatggcatcacgttgacaatctactttcaaatgattcaaaaaaaattatgttctttgaactgtacttgtaacttttttgagattgtttcttttttcttaatttaaccaaaaaattgtaagcaatctttgggggaaggagaacaatgtgaatatttccccccaaagagaagtcccttagttggccgggtacrgtggctcacacctgtaatcccagcactttgagaggtggaggcggacagatcagctgaggtcaggagttcgaggtcaggagtttgagaccagcctggccaacatgattaaaccccatctctactaaaaatacaaatattagctgggcgtggtggtgcacacctgtaatcccagctactcgggaggctgaagcaggagaattgctagaacccgggaggcagaggttgcagtgagccgagattgcaccactgcactccagcctggagacagagtgagattttgtctcaaaaataaacaaataa

SEQ ID NO: 115211 - DNA, 601 bp, Human
tggatattttttgctattaaggacaacactgcgacaatgggcaaaacttgaatgggatctgagtatgacatagtagtagtacagcagtgttagttttctgattttgatggttatattgtgcttctgtaggaaaatgttcttgtttgtgggaaatacacacaacatggtcatcatatggcatcacgttgacaatctactttcaaatgattcaaaaaaaattatgttctttgaactgtacttgtaacttttttgagattgtttcttttttcttaatttaaccaaaaaattgtaagcaatcttkgggggaaggagaacaatgtgaatatttccccccaaagagaagtcccttagttggccgggtacggtggctcacacctgtaatcccagcactttgagaggtggaggcggacagatcagctgaggtcaggagttcgaggtcaggagtttgagaccagcctggccaacatgattaaaccccatctctactaaaaatacaaatattagctgggcgtggtggtgcacacctgtaatcccagctactcgggaggctgaagcaggagaattgctagaacccgggaggcagaggttgcagtgagccgag

SEQ ID NO: 115212 - DNA, 601 bp, Human
ggtcaaggaaagactgaggaaatgtttcagattgaagaagactaaagaatcctgacaattaaatgcaatgtgtaattctggactggatattttttgctattaaggacaacactgcgacaatgggcaaaacttgaatgggatctgagtatgacatagtagtagtacagcagtgttagttttctgattttgatggttatattgtgcttctgtaggaaaatgttcttgtttgtgggaaatacacacaacatggtcatcatatggcatcacgttgacaatctactttcaaatgattcaaaaaaaattatgttctttgaactgtacttgtaacttttttgagattgtttcttttttcttaatttaaccaaaaaattgtaagcaatctttgggggaaggagaacaatgtgaatatttccccccaaagagaagtcccttagttggccgggtacggtggctcacacctgtaatcccagcactttgagaggtggaggcggacagatcagctgaggtcaggagttcgaggtcaggagtttgagaccagcctggccaacatgattaaaccccatctctactaaaaatacaaatattagctgggcgtggtggt

SEQ ID NO: 115213 - DNA, 601 bp, Human
tacaatgcactaaaaaggatgtaacatcacttctgtgacattcctgccaaatatgtataaactgaatctaatcataaagaaacatcagacaaaccatgattgaggggtattctacaaaataacttacctgtaatcttcaacaatgtacaggtcatgagggtcaaggaaagactgaggaaatgtttcagattgaagaagactaaagaatcctgacaattaaatgcaatgtgtaattctggactggatattttttgctattaaggacaacactgcgacaatgggcaaaacttgaatgggatcygagtatgacatagtagtagtacagcagtgttagttttctgattttgatggttatattgtgcttctgtaggaaaatgttcttgtttgtgggaaatacacacaacatggtcatcatatggcatcacgttgacaatctactttcaaatgattcaaaaaaaattatgttctttgaactgtacttgtaacttttttgagattgtttcttttttcttaatttaaccaaaaaattgtaagcaatctttgggggaaggagaacaatgtgaatatttccccccaaagagaagtcccttagttggccggg

SEQ ID NO: 115214 - DNA, 601 bp, Human
caatgtacaacatgaggattatagttaataacattgtattatatactggtaatctgccaagtgagtaaattttaggtattcttactaccaaaaaaaagggtaactatgaaatgatgggtatgttattaataatttgctcaactgtaatagaatgaacccccttgtcttggactagaattagagctacagatatcaactcatgaatttcaacgtatataaacataaatatgtaaatgtctatacacagaatacatatattccctagctctgtcccgagacagagattccctaacccccgggstgcggactggcactggtccacggcctgttaggaaaagcgccacacagcaggaagtgagcagtgggcaagtgaacattactgcctgagcttcggcattagattctcatagaagcacaaaccctactgtgaactgcacatgtgagggatcgaggttgtgtgatccttatgaaaatctaactaatgcctgatgatctgaggtggtatagtttcatcctgaaaccaatacccccagcctaaccccaccccagcaatgaaactggtccctggtgccagaaaggttggggactgctgccctgagag

SEQ ID NO: 115215 - DNA, 601 bp, Human
ttctaagtctgtaaaacttcattcacatctctcaaaagacaacatgcaaccccttttccaaacaactcagtccaaaagccactaagtgaccaatgtacaacatgaggattatagttaataacattgtattatatactggtaatctgccaagtgagtaaattttaggtattcttactaccaaaaaaaagggtaactatgaaatgatgggtatgttattaataatttgctcaactgtaatagaatgaacccccttgtcttggactagaattagagctacagatatcaactcatgaatttcaaygtatataaacataaatatgtaaatgtctatacacagaatacatatattccctagctctgtcccgagacagagattccctaacccccggggtgcggactggcactggtccacggcctgttaggaaaagcgccacacagcaggaagtgagcagtgggcaagtgaacattactgcctgagcttcggcattagattctcatagaagcacaaaccctactgtgaactgcacatgtgagggatcgaggttgtgtgatccttatgaaaatctaactaatgcctgatgatctgaggtggtatagtttc

SEQ ID NO: 115216 - DNA, 601 bp, Human
tgttaaatgttagcaacagaaggaatccttttgattgcctaaaaagtgaaaacgtcaagatatttgtttttttccttcttatgaaacattgacttctaagtctgtaaaacttcattcacatctctcaaaagacaacatgcaaccccttttccaaacaactcagtccaaaagccactaagtgaccaatgtacaacatgaggattatagttaataacattgtattatatactggtaatctgccaagtgagtaaattttaggtattcttactaccaaaaaaaagggtaactatgaaatgatggktatgttattaataatttgctcaactgtaatagaatgaacccccttgtcttggactagaattagagctacagatatcaactcatgaatttcaacgtatataaacataaatatgtaaatgtctatacacagaatacatatattccctagctctgtcccgagacagagattccctaacccccggggtgcggactggcactggtccacggcctgttaggaaaagcgccacacagcaggaagtgagcagtgggcaagtgaacattactgcctgagcttcggcattagattctcatagaagcacaa

SEQ ID NO: 115217 - DNA, 601 bp, Human; identical to SEQ ID NO: 28105

SEQ ID NO: 115218 - DNA, 601 bp, Human; identical to SEQ ID NO: 28106

SEQ ID NO: 115219 - DNA, 601 bp, Human; identical to SEQ ID NO: 28107

SEQ ID NO: 115220 - DNA, 601 bp, Human; identical to SEQ ID NO: 28108

SEQ ID NO: 115221 - DNA, 601 bp, Human
cactccagcctaggagacagagcaataacctgtgttaaaaaaaaaaaaaattaccttcctctagaatcattcctggtaccaaatctgtgttaatcagagttctccagagagacagaaccaataggagagagacaaagataaatatgaggggatttatcaggggaattggctcacatgtttatggaggctgagaagtcccattacaggccatctgcaagctggcatgccagtagtgtggctcagtccaattcctaaagcctcagaacccaggaagccaatggtataactctcagtccaagaytgaaggccttgagaacccatagggggtgaggaggattggtataagtcctggagtccaaaggctggagttctgatttccaaggacagaataagagtgtgctccagctccaagacagagagataaaatttttttctttctttttgttctatcctcagccaattggatggtgctcacactgaggggcgatcttccttactcagtccactgactcaaatgctaatctgctctggaaacaccctcacagacacatccaaaataatgctttaccagttctctaggtaatccagccaaattgacact

SEQ ID NO: 115222 - DNA, 601 bp, Human
gggggatgctgttactgggggtgggaggccatttctgctggcaaacaagactcatcagaatttaggagctcaacgtccccagcctcatcagggtcttcccacacatccccatccaaacgtatagaattccatctttcccaaccaatgccctcattttaacagcagataccttacaaggctgatatttcacctttgattgtaattcagctaatcacatgatgagagtatgtgtttgattttgtgcaatttcagacctttggcaacagaagagaagattctgacttagggcatatttagaagytcttgggctatttatggcagagctggggccaggaaatcaaaaccctgagctcacccttttctttcatcacttcgtccagcaatattagaaaaccttggttttctacaaacgtttgacagtatcaaatacagggttgccaagttccttgcctcttataggtggtaaattagaagtatcaaatgcagatatttagcatatcgctatataaacagttcacagcatggactgtcagtgctctctgtactattagaagtagggtccttagcatttttaagtctcatcaaattaagagagccaatt

SEQ ID NO: 115223 - DNA, 601 bp, Human
ttgtactgctcaaggaaaacctctctgttcaggtgacatttgaacagagttctaagtgaagtgagggagctagtacagcagatatgtacgggaagtttcctagagagaggtgcggtaagggcatgcttggcatgttcgaggaacagcaagaaggccagtgatgctgggcctgaatgaccaaaagggagagtaataggagactaggtaagacatgtaaaaggagcttagattatgtaataacagtctgtaggttactgtaagggctttagcttttactgagtgagaaggggaggcacaaaarggttttcagtagaatcatataatctatcttgtggcttaaaagattcactctagctgctgagttgagaaaagactgttcaaaggaggcagcagtagaagtggaaagatcacttgtgaaacttttataataatctaggcaaggcatgatggtgtcttggatgagggtagcagtagtagaggtcatgagaaatagtgagattcttaacatattttgaagatagagctgacaggatttgctgatggcttggatacaaatatgacagagagacaagataaagatgatttcaaggtttttgtcata

SEQ ID NO: 115224 - DNA, 601 bp, Human
taaagcagagtaaagggaaaggagttcttgtgatggaggaattgtttgtactgctcaaggaaaacctctctgttcaggtgacatttgaacagagttctaagtgaagtgagggagctagtacagcagatatgtacgggaagtttcctagagagaggtgcggtaagggcatgcttggcatgttcgaggaacagcaagaaggccagtgatgctgggcctgaatgaccaaaagggagagtaataggagactaggtaagacatgtaaaaggagcttagattatgtaataacagtctgtaggttacygtaagggctttagcttttactgagtgagaaggggaggcacaaaagggttttcagtagaatcatataatctatcttgtggcttaaaagattcactctagctgctgagttgagaaaagactgttcaaaggaggcagcagtagaagtggaaagatcacttgtgaaacttttataataatctaggcaaggcatgatggtgtcttggatgagggtagcagtagtagaggtcatgagaaatagtgagattcttaacatattttgaagatagagctgacaggatttgctgatggcttggatacaaat

SEQ ID NO: 115225 - DNA, 601 bp, Human; identical to SEQ ID NO: 28109

SEQ ID NO: 115226 - DNA, 601 bp, Human; identical to SEQ ID NO: 28110

SEQ ID NO: 115227 - DNA, 601 bp, Human; identical to SEQ ID NO: 28111

SEQ ID NO: 115228 - DNA, 601 bp, Human; identical to SEQ ID NO: 28112

SEQ ID NO: 115229 - DNA, 601 bp, Human; identical to SEQ ID NO: 28113

SEQ ID NO: 115230 - DNA, 601 bp, Human; identical to SEQ ID NO: 28114

SEQ ID NO: 115231 - DNA, 601 bp, Human; identical to SEQ ID NO: 28115

SEQ ID NO: 115232 - DNA, 601 bp, Human; identical to SEQ ID NO: 28116

SEQ ID NO: 115233 - DNA, 601 bp, Human; identical to SEQ ID NO: 28117

SEQ ID NO: 115234 - DNA, 601 bp, Human; identical to SEQ ID NO: 28118

SEQ ID NO: 115235 - DNA, 601 bp, Human; identical to SEQ ID NO: 28119

SEQ ID NO: 115236 - DNA, 601 bp, Human; identical to SEQ ID NO: 28120

SEQ ID NO: 115237 - DNA, 601 bp, Human; identical to SEQ ID NO: 28121

SEQ ID NO: 115238 - DNA, 601 bp, Human; identical to SEQ ID NO: 28122

SEQ ID NO: 115239 - DNA, 601 bp, Human; identical to SEQ ID NO: 28123

SEQ ID NO: 115240 - DNA, 601 bp, Human
tcctctcctcagccagcccgcaacacaacctcaacctctcacgcgagacgctgggccctttaatgcgagtcaatggcagatgctaatcctccaaccccagcccaaatgactccggggtcgcacttgctcaacgccccaacgaccgacgcgtaccttaatgggcagggagaagagatagatctcctccagggacttgatcttcatgtccttgaccaagcggcccaacttggtgacgggcatccactaaagggagaaaaggcgccagtgaccaggaccgctctccggcgccgcccaggggccsgaccccgagcgtggctgatacctacctccttatcctcggccttgcctccgcgagctccgcggcctcggccccggccccgtccacggccgcgaccccggccccggatgccactgccgaaacctccgcggaagccaccgcggttccccatcccagggccaccagggcccccgggcccccccgctgcaccggcgtcatccgccatttgctgggaaaagcgacaagaaggaactagtcagtgtggcctacgcatctggcagccccccgcgagacccagacaagggctcccgcccaggagcgcgg

SEQ ID NO: 115241 - DNA, 601 bp, Human
accgtaccttgctagggcgaacgctcacatgacaaatatgccattagcctttccccactgcacccgctggatgcagatgacagctgtcccgtacacgcggactatgacagtttgctaacccttacagtgtcctcccacaacctgaacttcatcatcctctcggatggcatgaaccaagcgctgcttctctttcagttctttggaaatgaattcgctgcgaatgtgggaagatgcgctgaaatgccttttgtggctctggcttcgctcaggtatccatccaacctctaagtggaatcctctmctcagccagcccgcaacacaacctcaacctctcacgcgagacgctgggccctttaatgcgagtcaatggcagatgctaatcctccaaccccagcccaaatgactccggggtcgcacttgctcaacgccccaacgaccgacgcgtaccttaatgggcagggagaagagatagatctcctccagggacttgatcttcatgtccttgaccaagcggcccaacttggtgacgggcatccactaaagggagaaaaggcgccagtgaccaggaccgctctccggcgccgcccaggggcccgacccc

SEQ ID NO: 115242 - DNA, 601 bp, Human
tccaggacagccgggtaccttgaacctggtgcgctggccggcacgggtctgcttctgcactggcataatcttcaaaacctcatccttgagagaggcccccaggaagaaatcaatgatctctgattcctgaaacaaacaagaaaattgtagggagagcattaaaaaaaaacttaataccattacgatattcaagaaccaaagtcacggccgggggcggtggctcaagcctgtaatcccagcactttgggagactgaggtgggcggatcacaaggtcaggagtccgataccagcctggccacrtggtgaaaccccacctctattaaagacacaaaaaattagccgggcatggtggagtgcgcctgtaaccccagctattcaggaggctgaggcaggagaatcgcttgaacctgggaggtggaggttgcagtgagccgagatcacgccagcctaggcgatagggcgaaactgtgtaaccgcccaccccgcccaaaaaaaaccgaagaagtcatgaaccccctcacctggcttccccccgatctgtccccttcgtttcgtttttggaagcttgtatgtaaggttaccctatttctgcatctcaat

SEQ ID NO: 115243 - DNA, 601 bp, Human
tcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagagggtgagtctgggcgaggggcagcacctgcgaggccacctgcagggtcccaggacacaggaagaccccgagggtagatcctggaccctggaaagtcagtagcctaagggaagtgaagatgcagaaaactgagagtgcagatatggggaacgcatctggaaatyagctggcacagaggaggaagcctgagagccagggtgggctgtggagttctgggtacacgtgctgacagctggaaacatggggctgaggctgcatggggcagtgggagctcaagacacaaatctggccaggtgtggtggctcacgcctgtcatcctagcactttgggaggccgaggctggagaattgcttgtggccaggtgttcgagaccagtctgggcaacatgatgaaatctcgaaacctcgtctctacaaaaaatacaaaaaagttagccaggggtggtggtgcatacctatagtccc

SEQ ID NO: 115244 - DNA, 601 bp, Human
gaaacatggggctgaggctgcatggggcagtgggagctcaagacacaaatctggccaggtgtggtggctcacgcctgtcatcctagcactttgggaggccgaggctggagaattgcttgtggccaggtgttcgagaccagtctgggcaacatgatgaaatctcgaaacctcgtctctacaaaaaatacaaaaaagttagccaggggtggtggtgcatacctatagtcccagctactcaggaggctgcggtgggaggatcgcttgagcctgggaggttgagcttgcaatgagccgtgactaagccaatgcactccagcctgggtgacagagcaagaccctgtttccctttaaaaaaaaaaaaaaaaaaagactgaaatctgggagtggccctctgcaggggagggagggccagacagcagggccatgggcatgggacccaaagacagacaagggagtggtggcccccgggcagttctctgtgctggaaatcacacttctttctcctttttttaaagactcacaaagcatccatattgcactgcttgggcagagtgctgagtctgttcgaggtgagtcaagttgttctctgcactgggacttt

SEQ ID NO: 115245 - DNA, 601 bp, Human
tggccaatgtgttgaaaccacgtctttactaaaaaacacaaaaattagccgggcgtggtggtgggcacctgtaatcctagctacttgggaggctgaggcatgagagttgcttgaacccgggaagctgaggttttagttagccaagatcgtgccactatactttggcctgggtgacagagggagactctgcctcaacaacaacaaaaaaaccagccaggcacagtggctcatgcctgtaatcccagcactttgggagactgaggtgggtggatcacctgaggccaggattttgagaccagcytggccaacatggtgaaaccccgtctctactaaaaatacaaaaattagccgggcatgatggtgggctcctgtaatcccagctactcaggaggctgaggcaggagaattggttgaacccaggaggcggaggttgcagtgagccaggatggcgccattgcactccaacctgggcgacgagtgaaactgtctcaaaaaataaaaatgaaaaagaataagggaacaatgaactctgctgggatttattctaggatgaggagaagcagcagcaggcccatgacctgtttgaggaggctgctcatca

SEQ ID NO: 115246 - DNA, 601 bp, Human
aggttgcagtgagccaggatggcgccattgcactccaacctgggcgacgagtgaaactgtctcaaaaaataaaaatgaaaaagaataagggaacaatgaactctgctgggatttattctaggatgaggagaagcagcagcaggcccatgacctgtttgaggaggctgctcatcagggatgtctgaccagctcctacctcctctgggaaagcgacaggaggacagatgtgagtggtgcctgctctgggtcggggggagttatgctggacaaaggcgtagttgatgctggtccttggatgcgkttctgtccacaaaagggaggtggctcttgctgctcccggtctctcagcctccgggaaccactggtcagtcggctattcttggtacccccaaaaatgactccaccatttgagagagaagaggtgggaagttagcgtagtgtcggcccttctgggtcttggttctgagttcctcccaagacacagttgtacaaaggctcggtgatctcccattgacaggtgtcagatcctgggcgatgcctccacagcttccgaaaactcagggactacgctgccaaaggctgctgggaagcgcaggtgagg

SEQ ID NO: 115247 - DNA, 601 bp, Human
ctcccaaagtgctgggattacaggcgtgagccaccgcgcccagccttgggtgttttttaaaaccagtaatgccaaagttatcgtggactttttggaagaaaatatcctactctgctttcttcagttacttttttttttttttttgagacggagtcttgctctgtcacccaggctggagtgcagtggcgtgatctcggctcactgcaagctccacctcccgggttcacaccattctcctgcctcagcctcctcaggagctgggactacaggtgcctgccaccacgcccagctaatttttttstatttttagtagagatggggtttcatcgtattagccaggatggtctcaatctcctgacctcgtgatccgcctgcctccgcctcccaaagtgctgggattacaggcgtgagccaccacgcccagccaccttttttttttttgagacagggtctggctctgtcacccaggccagagtgcagtggcatgatttcagctcactgcagcctccgcctcccaagctcaagagatcctcccaccttaccctcctgagtagctgggactacagatgcacaccaccatgcacagctaattgttgtattt

SEQ ID NO: 115248 - DNA, 601 bp, Human
ccaccgcgcccagccttgggtgttttttaaaaccagtaatgccaaagttatcgtggactttttggaagaaaatatcctactctgctttcttcagttacttttttttttttttttgagacggagtcttgctctgtcacccaggctggagtgcagtggcgtgatctcggctcactgcaagctccacctcccgggttcacaccattctcctgcctcagcctcctcaggagctgggactacaggtgcctgccaccacgcccagctaatttttttgtatttttagtagagatggggtttcatcgtrttagccaggatggtctcaatctcctgacctcgtgatccgcctgcctccgcctcccaaagtgctgggattacaggcgtgagccaccacgcccagccaccttttttttttttgagacagggtctggctctgtcacccaggccagagtgcagtggcatgatttcagctcactgcagcctccgcctcccaagctcaagagatcctcccaccttaccctcctgagtagctgggactacagatgcacaccaccatgcacagctaattgttgtatttttagtagagacagggtatcactatgttgcc

SEQ ID NO: 115249 - DNA, 601 bp, Human
ccttttttttttttgagacagggtctggctctgtcacccaggccagagtgcagtggcatgatttcagctcactgcagcctccgcctcccaagctcaagagatcctcccaccttaccctcctgagtagctgggactacagatgcacaccaccatgcacagctaattgttgtatttttagtagagacagggtatcactatgttgcccaggctagtcttgaactcctgggctcaagcgaacctcctgccccagcctcccacagtgcagtgatcttttttaagccacagaacacattgaacatcttttttttttttttgaggcaggctgtctgtcacccagggtggagtgcagtggtgtgttctcggcttgctgtaacctctgcctcgggctcaagcctttctcctgcctcagtcccccaagtaggactacaagtgtctccactctattcagaaaggcatttaccatattggggcatcatttaccgtattggggcattcccttgcgactgtccaccttctcccgctccctgcacgccccgagggtcagggttcatccactgtgggcagaccaacggctgtgggctgacttttcactttgcgtcag

SEQ ID NO: 115250 - DNA, 601 bp, Human
cctcccaagctcaagagatcctcccaccttaccctcctgagtagctgggactacagatgcacaccaccatgcacagctaattgttgtatttttagtagagacagggtatcactatgttgcccaggctagtcttgaactcctgggctcaagcgaacctcctgccccagcctcccacagtgcagtgatcttttttaagccacagaacacattgaacatcttttttttttttttgaggcaggctgtctgtcacccagggtggagtgcagtggtgtgttctcggcttgctgtaacctctgcctctggctcaagcctttctcctgcctcagtcccccaagtaggactacaagtgtctccactctattcagaaaggcatttaccatattggggcatcatttaccgtattggggcattcccttgcgactgtccaccttctcccgctccctgcacgccccgagggtcagggttcatccactgtgggcagaccaacggctgtgggctgacttttcactttgcgtcaggtcgaggtctcaaagcgcttgtgtttgggagcaccaggaacacagtcgaaggatgtggggcctgctttggggctgggacccac

SEQ ID NO: 115251 - DNA, 601 bp, Human
caccagttcccacgtgcttctctttccgcaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtgagaagcccccttggcccagctggcagggacgtgctggcctttcccgggttcagggtcacctgcccttcatgtgctcctcactggtttggttttgttttgtgttgtttttttttttttcccgagaccaagtctcgctctgtcacccaggctggagtgcagtggtgcgatcttggctcaccgcaacctctgcctcccaggttcaagtgattcttctgcctcagcctccagagtagctgggactgcaggcgtgcgccaccatgcccgactaatttttttgtatttttagtagagacggggtttcatcatgttggtcaggctggtctcaaactcttgatttcaaatgatccgcccgcctcaacctcccaaaatgctgggattacaggcacaagccactgcgcctgg

SEQ ID NO: 115252 - DNA, 601 bp, Human
ccagttcccacgtgcttctctttccgcaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtgagaagcccccttggcccagctggcagggacgtgctggcctttcccgggttcagggtcacctgcccttcatgtgctcctcactggtttggttttgttttgtgttktttttttttttttcccgagaccaagtctcgctctgtcacccaggctggagtgcagtggtgcgatcttggctcaccgcaacctctgcctcccaggttcaagtgattcttctgcctcagcctccagagtagctgggactgcaggcgtgcgccaccatgcccgactaatttttttgtatttttagtagagacggggtttcatcatgttggtcaggctggtctcaaactcttgatttcaaatgatccgcccgcctcaacctcccaaaatgctgggattacaggcacaagccactgcgcctggcc

SEQ ID NO: 115253 - DNA, 601 bp, Human
aagcccccttggcccagctggcagggacgtgctggcctttcccgggttcagggtcacctgcccttcatgtgctcctcactggtttggttttgttttgtgttgtttttttttttttcccgagaccaagtctcgctctgtcacccaggctggagtgcagtggtgcgatcttggctcaccgcaacctctgcctcccaggttcaagtgattcttctgcctcagcctccagagtagctgggactgcaggcgtgcgccaccatgcccgactaatttttttgtatttttagtagagacggggtttcaycatgttggtcaggctggtctcaaactcttgatttcaaatgatccgcccgcctcaacctcccaaaatgctgggattacaggcacaagccactgcgcctggccctcactggttcttgactcatgagccacgagtgtcccacctggtcagacatggagtgccacgctgagggccttttgcaggcaggggtggcagaacagccttcagcgtgtgggggccgctgtgtggggtgcctgcatccaggcaattcatcctggcatgcagtctcaggacccaaagtgtggcctcgctctggcaggcaca

SEQ ID NO: 115254 - DNA, 601 bp, Human
tggagtgcagtggtgcgatcttggctcaccgcaacctctgcctcccaggttcaagtgattcttctgcctcagcctccagagtagctgggactgcaggcgtgcgccaccatgcccgactaatttttttgtatttttagtagagacggggtttcatcatgttggtcaggctggtctcaaactcttgatttcaaatgatccgcccgcctcaacctcccaaaatgctgggattacaggcacaagccactgcgcctggccctcactggttcttgactcatgagccacgagtgtcccacctggtcaracatggagtgccacgctgagggccttttgcaggcaggggtggcagaacagccttcagcgtgtgggggccgctgtgtggggtgcctgcatccaggcaattcatcctggcatgcagtctcaggacccaaagtgtggcctcgctctggcaggcacaggctggactgccctgtcccctggctcctgagggcagcaggatgactgatcagggagggtggcagttggctgcccttctctgaagttgggttctaaagtctgttgccagagtttcctacactcttggagttagagagtttttcgtccc

SEQ ID NO: 115255 - DNA, 601 bp, Human
tcagcctccagagtagctgggactgcaggcgtgcgccaccatgcccgactaatttttttgtatttttagtagagacggggtttcatcatgttggtcaggctggtctcaaactcttgatttcaaatgatccgcccgcctcaacctcccaaaatgctgggattacaggcacaagccactgcgcctggccctcactggttcttgactcatgagccacgagtgtcccacctggtcagacatggagtgccacgctgagggccttttgcaggcaggggtggcagaacagccttcagcgtgtgggggmcgctgtgtggggtgcctgcatccaggcaattcatcctggcatgcagtctcaggacccaaagtgtggcctcgctctggcaggcacaggctggactgccctgtcccctggctcctgagggcagcaggatgactgatcagggagggtggcagttggctgcccttctctgaagttgggttctaaagtctgttgccagagtttcctacactcttggagttagagagtttttcgtcccccactggtgccctgcagagcccactccagccacgtgggtgtctctcaggagcagcgtgcgtccttaca

SEQ ID NO: 115256 - DNA, 601 bp, Human
agccttcagcgtgtgggggccgctgtgtggggtgcctgcatccaggcaattcatcctggcatgcagtctcaggacccaaagtgtggcctcgctctggcaggcacaggctggactgccctgtcccctggctcctgagggcagcaggatgactgatcagggagggtggcagttggctgcccttctctgaagttgggttctaaagtctgttgccagagtttcctacactcttggagttagagagtttttcgtcccccactggtgccctgcagagcccactccagccacgtgggtgtctctcagsagcagcgtgcgtccttacacggcagcctgtccttttcaaatcagaccactgctttcctttaactaatgctggatcccctagttccgcctttggaaataacgtggaaatgattctcacaatacgatttgcatttcctaaaccagctgtccccagcatggtctacatttcccgaggaagtgctttccagaccgactcctctgtagagcctggtgggtgaggataggcttggctgcacacagcatatgtgtaagctacagagacttgtttctttcttgcacaggtaacccagaggcagagggt

SEQ ID NO: 115257 - DNA, 601 bp, Human
ggtcgggcggccgcctccctggatctgactgcacatccatcactgcaacctacgacaaagctcctgggccacaaccggctggcagtgagagaataactgctaaaaacgtttcagggagctgagtccaatttcttccccaaccacaagacctgattgcagtggtccatataactatcaccacagctccctcaaatcaactctgccttattatcttttttttttttttttttaaatccggggaccaggcacggtggctcacgcctgtaatcccagcactttgggaggctgatgtgggcggatygtgaggtcaggagttcaagaccagcctggccaacatggtgaaaccctgtctctactaaagatacaaaaaattagctgggcgtggtggtgcatgcctgtaatcccagctactcaggaggctgaggcaggagaattgcttgaacccgagaggcagaggttgcagtgagccaagattacaccattgcactgcagcctgggcaatggcgcaagactctgtctcaaaaaaatacaaacaaaattagccagacgtggtagtgggcgcctgtagtcccatctacttgggaggctgaggcatgagaat

SEQ ID NO: 115258 - DNA, 601 bp, Human
agaccagcctggccaacatggtgaaaccctgtctctactaaagatacaaaaaattagctgggcgtggtggtgcatgcctgtaatcccagctactcaggaggctgaggcaggagaattgcttgaacccgagaggcagaggttgcagtgagccaagattacaccattgcactgcagcctgggcaatggcgcaagactctgtctcaaaaaaatacaaacaaaattagccagacgtggtagtgggcgcctgtagtcccatctacttgggaggctgaggcatgagaatcacttgaacctgggaggyggaggttgcagtgagctgagatagcgccactgcactaatccagcctgggtgacagagggaaactctgtctcaaaaaaaaaaagattttaaaggctgagctgccccccacctctgctctcagaggtgccctgcccccaccagccatctcacaccccacgctgggctctcattggccactgacatcttgtctttttggcgtctgcagcccccacgctggcaggtgtagtccctgcgcctcttgtcctcttggtcaagtgaatgacgcatgcaacctgcagagtccccaggacagagcagcca

SEQ ID NO: 115259 - DNA, 601 bp, Human
gtcccaagtaactgagactataggcacgtgccaccatgctctgctaattttttattttttaactttttgaagagatagggtcttgctttgttgcccagggtggtctcgaactcctggctgagctgtcctcctgcctgggcctccccttttttaaatgccccttgtcagccacaggcagctggctccattatgaagcctctgtttgtcaccaaagcccaacgccatggctccctccctaccttgaggcctcctaaagccttgggtccctccgccccacccctgccccaggaagtgggctccrccctgagaccccttctcggcattgcaggtttatcagtaaagagatcctgaccatccgggaggccgtatggctcacggacaacacttacaagtacgaggacctggtgagaatgatgggcgagatcgtctccgccttggaagggaagattcgagtaagcagcggttccattttccttattaatcttcgttgtcgctgtgctggagggtgggggtgggcattcagctttcctgctgtgggagggcctcatggactcagagagcagctgtctctgctgtgcccaaagccatggagcaggaggcc

SEQ ID NO: 115260 - DNA, 601 bp, Human
aggcacgtgccaccatgctctgctaattttttattttttaactttttgaagagatagggtcttgctttgttgcccagggtggtctcgaactcctggctgagctgtcctcctgcctgggcctccccttttttaaatgccccttgtcagccacaggcagctggctccattatgaagcctctgtttgtcaccaaagcccaacgccatggctccctccctaccttgaggcctcctaaagccttgggtccctccgccccacccctgccccaggaagtgggctccgccctgagaccccttctcggcrttgcaggtttatcagtaaagagatcctgaccatccgggaggccgtatggctcacggacaacacttacaagtacgaggacctggtgagaatgatgggcgagatcgtctccgccttggaagggaagattcgagtaagcagcggttccattttccttattaatcttcgttgtcgctgtgctggagggtgggggtgggcattcagctttcctgctgtgggagggcctcatggactcagagagcagctgtctctgctgtgcccaaagccatggagcaggaggccacggttgcaccacgtcgccat

SEQ ID NO: 115261 - DNA, 601 bp, Human
tacctggcccggcgtggtggctcatgcctgtaatcccaacactttgggaggctgaggcgggcggatgcctgagctcaggagttagagacaggcctgtccaacacggggcaaccccctttctactaagaatataaaaaattagccgggtgtggtggcgtgggcctgtagtcccagctactcaggagtttgaggcatgagaattgcttgaactcgggaggcagaggttgcagtgagcctctctgcagagactgcataggctggagtgaagtagatcgcgctactcttcactccagcctgggcracagagcgacactctgtctccaaaaaaaaagaaaaaaagaaaatcctgcactacttaccattcttctttgttttatctctctccatgccactcaaccttctaatgcacaatattttattttgcttattgtctgtcttcctacacaagagagataatattaagctccataatattttttgtatgttctgctcactgctatatacccagattctggtacatagtcggaattcaataaataactgctaaatggaattaacagtcaacaggaaaacattctagtcagacatattttgagaacaa

SEQ ID NO: 115262 - DNA, 601 bp, Human
ctggttcccattctgatgtatagcttctaagcctcaagacctttgcacttgcagttccttctgcccgtacccctattctcccagttgtatgcatggctgtgatctctcacctccctaaagtcttcgctcatatgtcaccttccttatgactaacaatgacatttaaaactgcactacctggcccggcgtggtggctcatgcctgtaatcccaacactttgggaggctgaggcgggcggatgcctgagctcaggagttagagacaggcctgtccaacacggggcaaccccctttctactaaraatataaaaaattagccgggtgtggtggcgtgggcctgtagtcccagctactcaggagtttgaggcatgagaattgcttgaactcgggaggcagaggttgcagtgagcctctctgcagagactgcataggctggagtgaagtagatcgcgctactcttcactccagcctgggcgacagagcgacactctgtctccaaaaaaaaagaaaaaaagaaaatcctgcactacttaccattcttctttgttttatctctctccatgccactcaaccttctaatgcacaatattttattttgctta

SEQ ID NO: 115263 - DNA, 601 bp, Human
agattaggctgggtgcagtggctcacgcttgtaatctcagcacttttcggaggccaaggaggatggatcacttgaggtcaggagttcgagataagcctggccaacatggtgaaaccttgtctctactaaaaatacaaaaattagccaggcatggtggcgggcacctgtagtaccagctgctcgggaggctgaggcaggagaatcacctcaacctgggaggtggaggttgcaatgagccaagatcacgccattgcactccagcctgagcaacagagactctgtctcaacaaattaaaaaaawaaataaataaagtgcccagattataggtgtgagctaccctgctcagcctaaagtattttttaatcaaggtatgtaagttgttttttaagacataatggtattgcacacttactagactatggtataatgtaaaaataacttttttgccccataggatctgcaggaaaacatacttttacatgcaacggaaaaccaaaaaaaaaataattgtgtgacttgctttactgcagtggtctgtaactgaacccacaagagctccaaggtatccccagatctagaatccaactacttctcaccatc

SEQ ID NO: 115264 - DNA, 601 bp, Human
ctcatcattttttatggaatgcagaattgaattttctgcaaagttggagaatggttttaaattaacactcttgtagcttgaaatatgatctatatggtgtcaacacccaaatttatagctccagccacaaatctcccctgaaagtagactaatagctaaaagcctattcaatatctctacctgacacaaatatattccaactttaattcctggacttccttccaaatctgctccatccacattcttacctatctcagttaatagcaactccatccttccaattgtttggcaaaaaaactttaaattatccttctctcctctttatcttgcatcccatatatcctatctttcagtaaatcatgcagtccccacctttaaggtataaaagcacatctcatttcactgcacttcgttttacacagctttttgcaagctaagggtctgcggcaaccctacatcaagcaggtctatcagcaccatttttccaacaacaatgtgctgtctttgtgtcacattttggtgattctcgaaatatttcaaactttttcatttttattacgtctgttatactgatctgtgatcagtgatctttgatgctact

SEQ ID NO: 115265 - DNA, 601 bp, Human
ctgaggcaggagaattgcttgaacccaggaggcggaggttgcagtgagccaagatcgtaccactgcactccagcctgggcgacagagtgaaactccatctaaaaaaaaataaggtaaaataaaagtatcaaatatatatctatttctaaaaccacagaaaagaaacaaaaatttagttatgtattatttttgaatcccaatttgctatattcatgtttaacataaaacataaaacatgtttaaccataaaattcctttttatagcaaggctccactgtgtcaataatggaagcaaaacacygaagacagttatgacagaaatgcaagatatgaaacagtaacatagggaccaaggggtcaaattcaagaacatctttcaaataccttttttttctgttttctactgggaggtaagctgaagtctgtgaattttgcatcatactttcgtggataataagaatttttaactaaaaaaaaaaagatccataaatgtttgcaacaatgtaattatttaaattataattaaattttatctactacagcatgttacaaatatttcagtaaaaacactagtaaactacccttctaggaagaatactag

SEQ ID NO: 115266 - DNA, 601 bp, Human
ctctctgcagaggcccaaggcagcagaggggcaagggggctcacaggagacaggcaaattgatctttataattgactcactctgatgataacaagcccactcccttgacaattcactactcctttaatccattaatccaccaatccatgaatgaattaatccatttatgagggttctgccttcatgacccatcacctcccaaaggttcccacctctcaacactgccacactggggaccaagtttccaacaaatgaacttttgggggacacatttaaaccacagcatggtccacactccttcaacttctaagtttgaccttgcaattggctaaggctcccttatcactgccaaggttaagtattcccacactacactgtttaagtacttcagtcaacaaatatgtatttctcacatactaaattctaggcactgtgcaaagcacagcagaattaaagatgtataagaccagggccaactacaatgtaatgtgacaaatgtactatggttgtataaataagctatgtatttgcaaaggaggtagtaaataatgctttagggtagtgtgtttcagggactggcaaccagccaatccacacacac

SEQ ID NO: 115267 - DNA, 601 bp, Human
gaggaggaggaggcgaaggtgaaggtgaggaggaggaggagaaggaagaggaagaagagaagaggaggaggaggaagaggaagaggaggaagaggaagaagaaaaagaagaataacaacaacaagaggaggaggaagaagaaacaaccaatagatagaaaagaaacaagcagaacaaacaaaacattttttaaaaagtccagctacttggggagtggtgtcatgaggagaaaaccttgtatctataaagaagctacctacagaagccaaggaacttcagataccgtgcttcaaaattcctrtgtcaaactacttcatggtctcagtccattttatgttgctataactgaatacatcataagattggataatttataaagaaaagaagtttatttcttacagttttggtggctgggtgggaactctctgcagaggcccaaggcagcagaggggcaagggggctcacaggagacaggcaaattgatctttataattgactcactctgatgataacaagcccactcccttgacaattcactactcctttaatccattaatccaccaatccatgaatgaattaatccatttatgagggttctgcc

SEQ ID NO: 115268 - DNA, 601 bp, Human
ggtaaaagttggttcttacatttcagagctcacacttaattcaagaataaaagacacatatgcaaagaagttcaccaacagggtcataataaaggatatctgtgctaaagaggcagaaaggagataccatattcaaagaagggcaagacatttctctaggcagatgagaaaaaatatacccaaaagtggatggatttcagatgagctaagagcaatgagcagaactttaaagatggagtaggtaagatcttctagaagcagcagcacgaacaaaactaaaagggcgaaagttcacaaaccmtgtatgagatatgataaataacaagtttgactgagacaaaaagcccctataagcaaataatatggaaataatcagaaaagacaagttaagcccacattataggattctggtttccagttctatggagttttattctcataggcatttcagctgattaaaaataaaatcagtttaacaaacttttaaattttacactacacagtcatctacataactaagaaacatatgcatattgaacatctaattttgcaccacaaaacaacaaatacaaagaaaataccctaaacttctctttggtca

SEQ ID NO: 115269 - DNA, 601 bp, Human
tcgtgtagggaaaagccattaatactttaaaatacggatgaatttggtttgtcccagtgatggtctaccctaccctatgtagtgagaatttaatgttcaaaaccacagcagtttaagtactattagttacactataatttccaagcataattattaatcatatcaaaatatttctgcccaatttctctaaaaacaacaaagatacagctcaaacatgatttataaatacaagtctcagtaagacttctccaaccacttacttgtgtgtaccaaaacagaattatacccataagaaaaatawcttcaagcaccatttacacacactaacatttataagcattccctataactatggcactatgggatagaagcagccaggtaaaagttggttcttacatttcagagctcacacttaattcaagaataaaagacacatatgcaaagaagttcaccaacagggtcataataaaggatatctgtgctaaagaggcagaaaggagataccatattcaaagaagggcaagacatttctctaggcagatgagaaaaaatatacccaaaagtggatggatttcagatgagctaagagcaatgagcagaa

SEQ ID NO: 115270 - DNA, 601 bp, Human
acactacagtgagaaccttaaaggcaagaagttactagtgtttgttttggtgaactcagccacatatagcaaaatctttgtcctttcaaatactgaatgtttacctctaattttcaaactaaactattgtcaagaagttatgcaaagataagcaaaatgtctgttaacatatattcaaaggttgctgagatttcttgctaacattagaaaatcaaactagtcttctatcaggaactttaaataaatacatgctgcctatgctagttttcatcttcaaatattaatgtttccaaagtttctstagccagtggaaattttttcctttaatcatttattcacgaaaccacaagggggcatagttcacattcgtgtagggaaaagccattaatactttaaaatacggatgaatttggtttgtcccagtgatggtctaccctaccctatgtagtgagaatttaatgttcaaaaccacagcagtttaagtactattagttacactataatttccaagcataattattaatcatatcaaaatatttctgcccaatttctctaaaaacaacaaagatacagctcaaacatgatttataaatacaagtct

SEQ ID NO: 115271 - DNA, 601 bp, Human
cacaactgcttccacacaagctacactattgtacttttctttctgaacatcaaaaagatacagcattctttagagcagatctcctgtgttggaattctgcatgaaccagggaaacaaaaggatttcctcagagccacagtaagcgttgaaataaattgtaaaactactccacctagtggactcccagtctgctgtgaaaaatgttccactgtttctataataaaagcaaggttttggaaacaaacctctaccactcattttccctaaagccaaatcatacagcattggtactacataggayaggaattaagaaagaataactttttttggtggcttttttggggaggtaggggaaaggctattaatggaaagccttaaaagttattaaattaaatacactcggtacccctgagtctgactaacctgaaaaatacagagatgtagaagtaaggacaaagatgtacttttgtcaaagataaggaagccatatgccaagcaaaccttcagttttctttaagctttaaaattcttactctgtgaaatctttcacaagcttttcctaacagagcaactacataaagaccttatttttcctgcatgt

SEQ ID NO: 115272 - DNA, 601 bp, Human
atatatatccagtcaagaaaaatagactccataaaaaaagatgattaatgtacaaactataaataaacataaaaggaaaagatcaaggtcataggagataaaaatctgacagtcagcaatacatgactacatttttcgaaagcaaacataatctaaggttataagaagtagactctggcacttgtacgagtgtgaaatcttcctccaggatactcaaaagcagtcagataatctcagggcactgtgtccagttctgtacttctaaactaaaggaacactgagaagaaaaaaaaaaaaaaaagacttggaagggattcagaagagactcaaagatgattaataggatgaaaaataaaacctccaaagaaagatgaaaggaactatttgcaacctttaaaagaagatgagaagcgacaataaaaatagttttacagagaggatggtccagttgttctcaaactgaagagaatatgcagaagtagaaatgagaaaaacagtaatgatttttacaggcctcacagtggcgagacatgtaactcacagctactcaacaccctccacaattctcaaatttacttattacttaagtttcttcaacatt

SEQ ID NO: 115273 - DNA, 601 bp, Human
cagcacattacacttactgtgtactttatattactattacattgtaatatataaaataattgtacaatgcaccataatgtagaatcagtaggagccctgagctgttttcctgcaactagacagtcccatcttgggatgatgggagacagtgacagataatcaggcattagattctcataagaagcacacaacctaaatccctcacgtgcacagttcacaatagggttcacgctcctatgagaatctaatgctgctgctgatctgacaggaggcggagctcacaggtagtaaggcaggcaayagggaatgtgtaaatacagatgaagccatgcttgctcgctgctccccgcctccccatccccgctcccccctggggttcctaacaggctaaggaactgtaccaggtaccagtctgtgcccaggggttaagaacccctggtctaaaacagatttggaaaatgtcaaagtccagaggaaatcccaggtaaaggataaggtgaatttaaatgacagctttcctacaaacttaagctaccataatttgatcattggcattgtgatttccttggttataatacaatattataaaaattaataaatt

SEQ ID NO: 115274 - DNA, 601 bp, Human
tgggattacaggtgtgagccactgtgaccagcccactcaaagtttttattatttaaaacttctaagaacttaaataaacaaggcaaccatgagaatttaccaagcataatactaaagtgcctgccaaatataaagtgtttgatccaggcccagcaagcctagttgtagccccaggacaccacctattacatttctttttggcagctctaacaatctagtaactctattctagacaaccaataaaaataaggcctcactgaagacaataagtaatttgtctatttaattaaccaactcaacytaaaaccaatataaaatgtttcaagactaagcatttaatgttcaccaagtcagtctaggggaaaccaaagcatgccagtaggaaatgggaatatctttctatgtgaatgttcaactgccaccttctgctggatggagctaaatcctctctcctcactacacaccatcacacctataaaagtactccttgtcaattttaagctaagttacctttactccttgattaataaagggaaaggaaagtatgaagtttatgtgaattactagtagattaagcagaaatccaccacagtgttagtat

SEQ ID NO: 115275 - DNA, 601 bp, Human
ttcttaaaattaaaataggcaaccatctgttaaggaatactgtgataaagccaaagtagcttatatttcaaaattcaagtagctattaagaagctaccatagtaagccatggcccacttaaaaaagaaaaaacttcccatgttacagatacatgtaaacaccatttttcatattaaagcctaacggctccttattcaacatcttccaaatacataaacattgattatctctagcctagtcaacattaaaagtgctgccatctccatcaaactacatttcctttttttttttttttttttttgagccagagtctcactgtcacccgggctggagtacagtggcacaatctcacctcactgcaacctctgcctcttgggttcaagcaattctcctgcctcagcctcctgggtactgggactacaggcacgtgctgccatgcccggctaacttttgtattttttgtagagatggggtttcaccatgttggccaggctgctctcgaactcctgacctcaggtgatccaccctcctcagcctcccaaagtgttgggattacagatgtgagccaccgtgcctggcccatccaattacatttgaatct

SEQ ID NO: 115276 - DNA, 601 bp, Human
ctttgctatcacctgttatgaatacaactgataagcaggaaatgtaatatgtgtttaaagaataactccatcttcacaccaatgtatgagaaacaagagcacaaaaaaatgctatttttcttaaaattaaaataggcaaccatctgttaaggaatactgtgataaagccaaagtagcttatatttcaaaattcaagtagctattaagaagctaccatagtaagccatggcccacttaaaaaagaaaaaacttcccatgttacagatacatgtaaacaccatttttcatattaaagcctaayggctccttattcaacatcttccaaatacataaacattgattatctctagcctagtcaacattaaaagtgctgccatctccatcaaactacatttcctttttttttttttttttttttgagccagagtctcactgtcacccgggctggagtacagtggcacaatctcacctcactgcaacctctgcctcttgggttcaagcaattctcctgcctcagcctcctgggtactgggactacaggcacgtgctgccatgcccggctaacttttgtattttttgtagagatggggtttcaccatgt

SEQ ID NO: 115277 - DNA, 601 bp, Human
aacaacttaggtgaagcaaattcttttgaaaaacacaaatcatcaaaacccactcaagaagaaataggaaaatatgaatagtcctggacctattaatgaaatttaattcataatttaaaactttcccaaaaacaaaatgccaggttcagatggcttcactactgaattctacaaacaagaaacaaaaagaaaaactggtagaaatcctacacaaacccttaaaaaagaggaggaaatagatccctactcataccaaatctcttacaataaaagaaaaccatagactaatatccctcatgarcatgtatgcaaaactccttaataaaatattagatcaaatccatcaatgtattaaaagggtaatagaccatgaccaagtagattttatcctgggaatacaggctggtttgacatttgaaaatcaattgacatttcaccattattaacagaataaaggagaaaaaccatatgaacagttgaaaattcacaaattttaagctcagaatcttcacctctccccactccccaatagttatactatttacttactatgaatcagtgtgatatgatataaagaattctattctagaagttgggagac

SEQ ID NO: 115278 - DNA, 601 bp, Human
taaattacatgtgaagtagatatcatttgaaagtacacgatgaaaagttaagctgcatactataaactgcagaccaactcctaaaaagtaaaacaaagaagtcaaaaggatgaaagaagataccaagcatataccaatcacatgaacgccgaaagtctgtattaatgtcagacaaaaaagacttcagaacagtgaacatcaccagggatgaagtggaacagttcataatgctaaaggggtcaattcgtcaataagacaaagaataacacctaagaacagattttcaatatgcattgcagcraaaactgatagaactgagaagagaattagacaaatccattattatgattgaatattgaacgttccaatctcagtaattaaagaaaaattggacagaaaattcgtagggatacaaaatatcactaacgattaactcaaattgacaaagaacacccgacctaatacattttcttgtcaagttcatatgaacatttaccttgtgttgggccataaaataagtatcaataaattgaagaaattgaaagtatagagatatgttctctgactgtagcagaattaaactaaaatcattaacagaaaa

SEQ ID NO: 115279 - DNA, 601 bp, Human
aggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagggactgtcctcgggaggggcgtggccagacgggggtgctgggtgtcaggggcgtggccagcttctgggg

SEQ ID NO: 115280 - DNA, 601 bp, Human
gttgatctgtattactggtattgctctgagcacacttaaccaatatctcgatatatttttttcaatataatattatttgtttgcatctatttcagtttataactgtcaacatattatccatgggatagatctaggtaaaatacatttacaggtgtaactgcatgttatatttatatgcaatatccatagcgattttgcctagtttttctgtaacctgcatagttgtttaaagctatagatttttaaaaaaatgtgtgcattcaagtttgtttagagtacaaattagaaaagaagggtgctytcctttcccagataaaacctttgcggatgtcttgggggttgatactgacctctagtgaaaccagtctaggtcagtgctgtagctggaaatttaaaatcccactcaattgattggaatcagtgctaagagtaaattaagctaataacaactctctttcaatacagggaaaagaaacagaaaattctggacatccggaaaaatgttaaagatgctatcgtggtaaggacttttttaaatgattgtttactagaaaggtcaagtgctcttcattctaaaactgtgtagacagaaattacatat

SEQ ID NO: 115281 - DNA, 601 bp, Human
ctgagcacacttaaccaatatctcgatatatttttttcaatataatattatttgtttgcatctatttcagtttataactgtcaacatattatccatgggatagatctaggtaaaatacatttacaggtgtaactgcatgttatatttatatgcaatatccatagcgattttgcctagtttttctgtaacctgcatagttgtttaaagctatagatttttaaaaaaatgtgtgcattcaagtttgtttagagtacaaattagaaaagaagggtgctttcctttcccagataaaacctttgcrgatgtcttgggggttgatactgacctctagtgaaaccagtctaggtcagtgctgtagctggaaatttaaaatcccactcaattgattggaatcagtgctaagagtaaattaagctaataacaactctctttcaatacagggaaaagaaacagaaaattctggacatccggaaaaatgttaaagatgctatcgtggtaaggacttttttaaatgattgtttactagaaaggtcaagtgctcttcattctaaaactgtgtagacagaaattacatattgtagattatcatacatggagccta

SEQ ID NO: 115282 - DNA, 601 bp, Human
gtgcattcaagtttgtttagagtacaaattagaaaagaagggtgctttcctttcccagataaaacctttgcggatgtcttgggggttgatactgacctctagtgaaaccagtctaggtcagtgctgtagctggaaatttaaaatcccactcaattgattggaatcagtgctaagagtaaattaagctaataacaactctctttcaatacagggaaaagaaacagaaaattctggacatccggaaaaatgttaaagatgctatcgtggtaaggacttttttaaatgattgtttactagaaargtcaagtgctcttcattctaaaactgtgtagacagaaattacatattgtagattatcatacatggagcctaaatgtttatccatattttttttcttattccattttagacaattgtttcagcaatgagtactataatacctccagttccgctggccaaccctgaaaaccaatttcgatcagactacatcaagagcatagcccctatcactgactttgaatattcccaggtaagaaatgcttactgaaatattctaactagtgaaagatggaaccatttttaataaggtttcttattgaga

SEQ ID NO: 115283 - DNA, 601 bp, Human
cacttccgaattcataaagagaccaggctttgtatctgctgtggggatggtgctctgggaatttgtctgtcattggacaaagggcatttcctgtaccagaaacctgcttccaggtctcacatggcttatgtcatgatattaaggaggagggaaacccccactgagaataagtattgtattattctgcacatctgagatgctaataaaaggaatttttattattatagtaaaacatttcagttagatagattaaccgtattagagcttcaataaagatacttttcttaaattccatttttttctttgcaatattatcataagaggtactcctaatcaatgttagctttttattttgaagtgattttaatctttacctgaacaatacaaaagaagtaccgaatactgccatgtgtccttcacccagattcatcgatagctaatgtgtggccacattcatgctctcactctctctacactaacacacatttttgtgaacgatttgagagttggttgcagacatcatgcccccttgcctctaactacatcagtgtgtatttccttagaatgaggacatccacttcacttctgtaaccacagcaca

SEQ ID NO: 115284 - DNA, 601 bp, Human
tgaggacatccacttcacttctgtaaccacagcacaggtatcaaaattaggagatttaacattaatacgatatctttttttttttcttttttgaacagagtctcgctctgtctcccaggctggagtgcagtggtgcgatctcggctcactgcagcctcccaagtagctgggactacaggcatagcccaccaccatgcctggctaatttttgtatttttagtagagatgggatttcaccatgttggccaggctggtctcaaactcccagcttcaagtgatccacctccctcccaaagtgccragattacaggtgtgagccaccacatctgaccatcattttgtaatcaacaaaccttactcagattttaccaagagtctcaataatttaatgaaataatagcagtaacaataataataaataatgatattggtaactctggtcagtaatctaatccaggatcagccatgacatttaacttccatttctctctatgctagaacagttgctcagccgaccttttttgtcatgaccttggcctgacattgactttgtagaacacccacactcagagttcctttgaggttttgtatttggagcaac

SEQ ID NO: 115285 - DNA, 601 bp, Human
cacttcacttctgtaaccacagcacaggtatcaaaattaggagatttaacattaatacgatatctttttttttttcttttttgaacagagtctcgctctgtctcccaggctggagtgcagtggtgcgatctcggctcactgcagcctcccaagtagctgggactacaggcatagcccaccaccatgcctggctaatttttgtatttttagtagagatgggatttcaccatgttggccaggctggtctcaaactcccagcttcaagtgatccacctccctcccaaagtgccgagattacagrtgtgagccaccacatctgaccatcattttgtaatcaacaaaccttactcagattttaccaagagtctcaataatttaatgaaataatagcagtaacaataataataaataatgatattggtaactctggtcagtaatctaatccaggatcagccatgacatttaacttccatttctctctatgctagaacagttgctcagccgaccttttttgtcatgaccttggcctgacattgactttgtagaacacccacactcagagttcctttgaggttttgtatttggagcaacagcagagaag

SEQ ID NO: 115286 - DNA, 601 bp, Human
atgtataggccgggcaccgtggctcacacctgtaattccagcactttcagaggctgaggcaggaggatcacctgagggtcaggagttcgagaccagcctgaccaacatggagaaaccccgtctctactaaaaatacaaaattagctgggcgtggtggcacatgcctgtaatcccagctactcaggcagctgaggcaggagaatcgcttgaacccaggaggcagaggttgcggtgagctgagatcacgccactgcactccagcctgggcaacaagagcgaaactccatctcgaaaaaaaaaaggccaggcgcagtggctcacgcctgtaatcccaacactttgggaggccgaggcgggcggatcacgaggtcaggagatcaagaacatcctggctaacatggtgaaaccccgtctctactaaaaatacaaaaaattagccaggcctggtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaaaatata

SEQ ID NO: 115287 - DNA, 601 bp, Human
aaaaaaaaaaggccaggcgcagtggctcacgcctgtaatcccaacactttgggaggccgaggcgggcggatcacgaggtcaggagatcaagaacatcctggctaacatggtgaaaccccgtctctactaaaaatacaaaaaattagccaggcctggtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaawaaaaatatatatataacatattattatatatattatatatattactatatgttatatataatatattatatatattatatattctatattataatatagaatatatatattctatattataatatattatatataatatatataatatatattatatatatagattatataaattatatgtaatatatattataatatagattatataaattatatgtaatatatattataatatagattatataaattatatgtaatatatattataatatagattatataaattatatataatatata

SEQ ID NO: 115288 - DNA, 601 bp, Human
aaaaaaaaggccaggcgcagtggctcacgcctgtaatcccaacactttgggaggccgaggcgggcggatcacgaggtcaggagatcaagaacatcctggctaacatggtgaaaccccgtctctactaaaaatacaaaaaattagccaggcctggtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaawaaatatatatataacatattattatatatattatatatattactatatgttatatataatatattatatatattatatattctatattataatatagaatatatatattctatattataatatattatatataatatatataatatatattatatatatagattatataaattatatgtaatatatattataatatagattatataaattatatgtaatatatattataatatagattatataaattatatgtaatatatattataatatagattatataaattatatataatatatata

SEQ ID NO: 115289 - DNA, 601 bp, Human
aaaaaaggccaggcgcagtggctcacgcctgtaatcccaacactttgggaggccgaggcgggcggatcacgaggtcaggagatcaagaacatcctggctaacatggtgaaaccccgtctctactaaaaatacaaaaaattagccaggcctggtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaawatatatatataacatattattatatatattatatatattactatatgttatatataatatattatatatattatatattctatattataatatagaatatatatattctatattataatatattatatataatatatataatatatattatatatatagattatataaattatatgtaatatatattataatatagattatataaattatatgtaatatatattataatatagattatataaattatatgtaatatatattataatatagattatataaattatatataatatatataat

SEQ ID NO: 115290 - DNA, 601 bp, Human
ttagccaggcctggtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaaaatatatatataacatattattatatatattatatatattactatatgttatatataatatattatatatattatatattctatattataatatagaatatatatattctatattataatatattatatataatatatataatatatattatatatatagattatataaattatatgtaatatatattataatatagattatataaattatatgtaatatatattataatatagattatataaattatatgtaatatatattataatatagattatataaattatatataatatatataatgtgtaatataaaattaatgaaaaataaggcatgtagtttaatgctaactcatgtggtatagactagacattctgtagccattcagaaaagaagattaataaggactattgtgctcagacaaaagtcttcattgttgca

SEQ ID NO: 115291 - DNA, 601 bp, Human
agccaggcctggtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaaaatatatatataacatattattatatatattatatatattactatatgttatatataatatattatatatattatatattctatattataatatagaatatatatattctatattataatatattatatataatatatattatatatattatatatatagattatataaattatatgtaatatatattataatatagattatataaattatatgtaatatatattataatatagattatataaattatatgtaatatatattataatatagattatataaattatatataatatatataatgtgtaatataaaattaatgaaaaataaggcatgtagtttaatgctaactcatgtggtatagactagacattctgtagccattcagaaaagaagattaataaggactattgtgctcagacaaaagtcttcattgttgcact

SEQ ID NO: 115292 - DNA, 601 bp, Human
ggcctggtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaaaatatatatataacatattattatatatattatatatattactatatgttatatataatatattatatatattatatattctatattataatatagaatatatatattctatattataatatattatatataatatatataatatatattatatatatagattatataaattatatgtaatatatattataatatagattatataaattatatgtaatatatattataatatagattatataaattatatgtaatatatattataatatagattatataaattatatataatatatataatgtgtaatataaaattaatgaaaaataaggcatgtagtttaatgctaactcatgtggtatagactagacattctgtagccattcagaaaagaagattaataaggactattgtgctcagacaaaagtcttcattgttgcacttcgta

SEQ ID NO: 115293 - DNA, 601 bp, Human
ctggtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaaaatatatatataacatattattatatatattatatatattactatatgttatatataatatattatatatattatatattctatattataatatagaatatatatattctatattataatatattatatataatatatataatatataatatatatatagattatataaattatatgtaatatatattataatatagattatataaattatatgtaatatatattataatatagattatataaattatatgtaatatatattataatatagattatataaattatatataatatatataatgtgtaatataaaattaatgaaaaataaggcatgtagtttaatgctaactcatgtggtatagactagacattctgtagccattcagaaaagaagattaataaggactattgtgctcagacaaaagtcttcattgttgcacttcgtacag

SEQ ID NO: 115294 - DNA, 601 bp, Human
gtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaaaatatatatataacatattattatatatattatatatattactatatgttatatataatatattatatatattatatattctatattataatatagaatatatatattctatattataatatattatatataatatatataatatatattatatatatagattatataaattatatgtaatatatattataatatagattatataaattatatgtaatatatattataatatagattatataaattatatgtaatatatattataatatagattatataaattatatataatatatataatgtgtaatataaaattaatgaaaaataaggcatgtagtttaatgctaactcatgtggtatagactagacattctgtagccattcagaaaagaagattaataaggactattgtgctcagacaaaagtcttcattgttgcacttcgtacagtag

SEQ ID NO: 115295 - DNA, 601 bp, Human
ggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaaaatatatatataacatattattatatatattatatatattactatatgttatatataatatattatatatattatatattctatattataatatagaatatatatattctatattataatatattatatataatatatataatatatattatatatatagattatataaattatatgtaatatatattataatatagattatataaattatatgtaatatatattataatatagattatataaattatatgtaatatatattataatatagattatataaattatatataatatatataatgtgtaatataaaattaatgaaaaataaggcatgtagtttaatgctaactcatgtggtatagactagacattctgtagccattcagaaaagaagattaataaggactattgtgctcagacaaaagtcttcattgttgcacttcgtacagtaggg

SEQ ID NO: 115296 - DNA, 601 bp, Human
gcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaaaatatatatataacatattattatatatattatatatattactatatgttatatataatatattatatatattatatattctatattataatatagaatatatatattctatattataatatattatatataatatatataatatatattatatatatagattatataaattatatgtaatatatattataatatagattatataaattatatgtaatatatattataatatagattatataaattatatgtaatatatattataatatagattatataaattatatataatatatataatgtgtaatataaaattaatgaaaaataaggcatgtagtttaatgctaactcatgtggtatagactagacattctgtagccattcagaaaagaagattaataaggactattgtgctcagacaaaagtcttcattgttgcacttcgtacagtagggc

SEQ ID NO: 115297 - DNA, 601 bp, Human
tagggcttcctgggaaggtaaaattgtcatcagcagagcctagtcaggaagccatatccccatcacaaaatcaaggccactcctagcatagcagcatcagtttctcaggtctgggggacagtaagctttggctagagctcaagaatgagcccttggtctacaaacttgttccatgatgttcagaaaaatgaagagcatcatcttttagcttaaagtgaatccacagttgtgggagttagtttattacacatgcacgtaattacttagtgtttaaagaaacgttggtaaagaatatgttcaracaaattgaagtatatattttttatttcatgaagcacgtaagtttatggcaaaaagataaacaaatgttggttgcttcagtcatttccatttccattttctcatcccaagtggaggtaaaatgatccttactacaatcttgcttatcctacctatttacacacatgtctaaaatatacacacacacatgcacacacactggcacatgcagaggctgaatcatgcacaaaatacgtaaatgatgaacatttttttaaaaatattaccaaatattgatgggatatggcagtgttgtttttga

SEQ ID NO: 115298 - DNA, 601 bp, Human
ctagagtaaaagttccttaacattatggttaagagtgcagactttgcaattggtctcacctctgcctcttcctgtctatgtaaccttggttgagttaattagtatctctatgctcagtttcctcatctgtaaaatggggataataataataatgcctagcacatgaagctttttgggggaattaaatacaataatacatctgaagtgctgggccctgtgcctgacacaccttaaacattcagtaaatgtgagatgtcatcctggtcacccttcaccatgcgtaatgttatgtgtgtgtgcygccttttcagacgttgccgagtgctgaagccacgcacggggcccagtttgactcggcacgtcttggtgtggccgaagaacaagcctggctctgaattaagagtcaggctgtggtgttttcagggaactttctctgccttctgtcagttttcaaggcttggcattgcatgggaagagtcaacaaatactatattctgcagaaagtattgtggtctgaaatagtgtagactaaaatataaagaaaaaccaaattgggattttaaaatgcatgagcgcccatctaaaagagccacctacgcct

SEQ ID NO: 115299 - DNA, 601 bp, Human
gtttgactcggcacgtcttggtgtggccgaagaacaagcctggctctgaattaagagtcaggctgtggtgttttcagggaactttctctgccttctgtcagttttcaaggcttggcattgcatgggaagagtcaacaaatactatattctgcagaaagtattgtggtctgaaatagtgtagactaaaatataaagaaaaaccaaattgggattttaaaatgcatgagcgcccatctaaaagagccacctacgccttggttttcctcttttttggtgaagttgataaattggcttgataccratgaaaatggcgaccactgcttgaacagcacttcatgccaagaactgccctaagctgtataactgcagcaatcttatgggtggagaatggtggctcatttcatatgtgagaaaacagaagcccagagaacataattgacttgccccgagtcatagagctgggtagagaatggttcagaatttgagcccaggcagcctgaccccagagcctgtccccctgtgtactgtgaggtgacctttctgggtttaagaatcacgggtccaggttatacactgtatcagccttgttgcagctacaagc

SEQ ID NO: 115300 - DNA, 601 bp, Human
gaagagtcaacaaatactatattctgcagaaagtattgtggtctgaaatagtgtagactaaaatataaagaaaaaccaaattgggattttaaaatgcatgagcgcccatctaaaagagccacctacgccttggttttcctcttttttggtgaagttgataaattggcttgataccaatgaaaatggcgaccactgcttgaacagcacttcatgccaagaactgccctaagctgtataactgcagcaatcttatgggtggagaatggtggctcatttcatatgtgagaaaacagaagcccaragaacataattgacttgccccgagtcatagagctgggtagagaatggttcagaatttgagcccaggcagcctgaccccagagcctgtccccctgtgtactgtgaggtgacctttctgggtttaagaatcacgggtccaggttatacactgtatcagccttgttgcagctacaagcttggtgtggtcacttcaccatccctcattttgatttttgtttgcagagtttaggtcgatagacattgcgggtatatttctaagtcttattgaggaaataatcagtccatgagtgcctgtagctca

SEQ ID NO: 115301 - DNA, 601 bp, Human
ggagaatggtggctcatttcatatgtgagaaaacagaagcccagagaacataattgacttgccccgagtcatagagctgggtagagaatggttcagaatttgagcccaggcagcctgaccccagagcctgtccccctgtgtactgtgaggtgacctttctgggtttaagaatcacgggtccaggttatacactgtatcagccttgttgcagctacaagcttggtgtggtcacttcaccatccctcattttgatttttgtttgcagagtttaggtcgatagacattgcgggtatatttctamgtcttattgaggaaataatcagtccatgagtgcctgtagctcactacatgagccatctatctggagatgggcagggctcacacagcacaggccatctttcagttctgcacctgatggacagcacctcttcctgcggcagagcctgagtggccatcgctcggctcagcccagtgcgaggcagagagtcctgctgaatctccccttgactaatggcttctttctaattcctgatttactgaagacagcctttctgtcttgaaggaattactctgtggcatttcccagtcttagcaagtggtt

SEQ ID NO: 115302 - DNA, 601 bp, Human
tccatgagtgcctgtagctcactacatgagccatctatctggagatgggcagggctcacacagcacaggccatctttcagttctgcacctgatggacagcacctcttcctgcggcagagcctgagtggccatcgctcggctcagcccagtgcgaggcagagagtcctgctgaatctccccttgactaatggcttctttctaattcctgatttactgaagacagcctttctgtcttgaaggaattactctgtggcatttcccagtcttagcaagtggttctggggggccctgatgaaagcamtgtgttctggcgaactgagaaccaactgtggacccttgctttgtttgagggccaggggtggccaggagggtttctctgcagagtccacacctcacccatatgcacacactgggaggaaatatttttcaaccattggtttaaccattgaatagttagctttgtagtacttactcctctgagattttacgcagatgatctcacttaatccacacacatgcacgcccccgtgtagtagccaccatggcggtcccctgacggggtagatacgtggcccgtgtcacacagcatgtgcagcagggc

SEQ ID NO: 115303 - DNA, 601 bp, Human
aaatgtgaattattattgttattactgttgaccaagttcaaatactagaaccagaaaaggacttgaattacaatgaaaattagccagaaacacagaagactttgacttacacatttctgatcactccaaccctaggagtccattcgtaggcaagacttaagtcacactgaagtataaatgactgataacaggctactaatctgttactctatcaaatgcctttgcatttaactgactgagagccttgactacaggattgaaattctgcaagataaattttaaatatcaaccagtgaatgakgatagtgctgaccagaactaccagtgtttcttacggctatttcaaattaagactttaaatatagggaaaatttggttgttttaaatctacatttacacttacaggcattcttttcaacatgcattatctgtggtaactgcaaataaagcattccccaattcgtaaataaaaattggacttagaaacacctaaccattaaactacagctctgaacaactcttaaatttcctttgtattacccaaaccagaaagcccaaccttggattgagagagccttaatatacacctttgaaaatatag

SEQ ID NO: 115304 - DNA, 601 bp, Human
caggagaatcacttgatccagggaggcggagcttgcagtgagccaagatggcaccattgcactccagcctgggtgacagagctagactccgtctcaaaagaaaaaaagaaaaagaaaaagaatgaattacagccacatgcaatgacatggatggatctcagtatcataatgttgaatgaagaactcaagtgttaaaagattacatataatcctcttttgtttgtaaggttcaaaaaacaagcataactaagtactatattgtttaagcatgcatgtatttgtgataaaaatttttgaaagragacagaatgatagtcgtaacattcaggatagtaggagagaaggcaagggtggaagagagatggggtatggaagagatcatagtaaaatattggttattgatcctgtcttattaaggagatgggaggggctcatgggtgttccttttatgattaaacaaaaaaataagaaaatgaaaaagggccatgtaagagtcaatgatgactgtgtgtcattaaccagatctattcacctgtggtccacattaaaaagaaaattcgttttctagtttagaaacatgtatctttcttcgtgctgtgtt

SEQ ID NO: 115305 - DNA, 601 bp, Human
aagtgggaggaaatatatgattcatggtgtacaaagaattgagtttagaaaaggggaataaacaagaggaattactcagtcactactatttaaaactgagaatcagaagacaattagcacaatgttgttggaagaaagtttcagatagtgtaacatttttagtttctgcaaagtctggaattgctgtgattcatactttttcccagtcccacgctcagttttcgtcccctctcagccattggaaatgtgcacctgtctttcccctacctcaatccagtcaagtcttttagatggttttatrtaagatttcatcccagtggaatttggaaattagtctagaaagctgaaaatgagagggtacctgaaagttgggataaagatgaggtcattgctcctggattctgcactctttcccatgatatcatcctttagggaatccctggaaatgtggaatgggtgtccacaaggcagatggaagtatgggatgctccgtggtaagcctgtatgcctccaagcccccaataagtagaacaatgggaaatgcaaattgcagaaatctggaacaaggagaagaaaggaggacactggatgatgctgggat

SEQ ID NO: 115306 - DNA, 601 bp, Human
actcaggaggctgaggcaggataatggcatgaacccgagaggtggagcttgcagtgagccaagattgcaccactgcactccagcctgggagacagagccagactccatctcaaaaaaaaaaaaaaggaaatatctgcttaataggatcatgggcagccggcactggtttggccaatcccagagaaaaggaaaaaagtgtgtcttagcacccagtttcattgacattgccaacttcccatttccttctgcaaacttcccttttttatttcctgctgtccccagtaaatttatccttgaccayacctggagccattaaccgtaatcgggccttagatatcttacacacccctgagaatttctcctcagctgtggaataaacgtgttattcccaagttgtgctgtgcttcagaaccacctggggagctttcaaacaagatccctaagcctgtcctcagagattttgattcaggaattcttgggtgaagccttgaggaatctattttaatagctccccaaaggcttctaaggcaccaggaggtgtggcagtcacaacgcaacacctagtgtggctctcaaggcataaccagagttaagaggtggt

SEQ ID NO: 115307 - DNA, 601 bp, Human
ccagcctgggagacagagccagactccatctcaaaaaaaaaaaaaaggaaatatctgcttaataggatcatgggcagccggcactggtttggccaatcccagagaaaaggaaaaaagtgtgtcttagcacccagtttcattgacattgccaacttcccatttccttctgcaaacttcccttttttatttcctgctgtccccagtaaatttatccttgaccatacctggagccattaaccgtaatcgggccttagatatcttacacacccctgagaatttctcctcagctgtggaataaacrtgttattcccaagttgtgctgtgcttcagaaccacctggggagctttcaaacaagatccctaagcctgtcctcagagattttgattcaggaattcttgggtgaagccttgaggaatctattttaatagctccccaaaggcttctaaggcaccaggaggtgtggcagtcacaacgcaacacctagtgtggctctcaaggcataaccagagttaagaggtggtcagaaactgacagcgaacttgcagcaatgcccttgttctgtgaggagtggttccccatgcagatggcctcatttataag

SEQ ID NO: 115308 - DNA, 601 bp, Human
tttgtcagctcctcacgattcccccagcttccaacactctgacatcaatgtgtccttggggatgtgttgtttacaataatgtaacattcacactaagatggacttcatttttaatacagactcataaagcatttttaaccacttattttaattcagcaattcttaactgcaaaggaggtcagtgccaaggtggaaatcagtgttaacatgtttgatttttgcctctgaggcccctttgacacttatgtaaaattctctggcttccagcctggctgatggtttttcttttcttttcttttcytttttttttttttttttttttttgagacagtcttgctctgttgcccaggctggagtgcagtggcacgatctcgtctcactgcaagctctgcctcccgggttcacaccattctcctgcctcagcctcctgagtagctggaactacaggtgcccgccaccacgcccagctaatttttttgtatatttagtagagacggagtttcaccgtgttagccaggatggtcttgatctcctgacctcgtaatccgcctgcctcagcttccctaagttctgggattacaggcgtgagccaccgcgtcca

SEQ ID NO: 115309 - DNA, 601 bp, Human
gctctgttgcccaggctggagtgcagtggcacgatctcgtctcactgcaagctctgcctcccgggttcacaccattctcctgcctcagcctcctgagtagctggaactacaggtgcccgccaccacgcccagctaatttttttgtatatttagtagagacggagtttcaccgtgttagccaggatggtcttgatctcctgacctcgtaatccgcctgcctcagcttccctaagttctgggattacaggcgtgagccaccgcgtccagccagctgatggtttttcaatcaaaactattgatygaaattaatacttaatttaagaaaaaccagaaactactatttaggatttacagagcaagatatccagatttcaggaatgagaggtgactaattcccagagttgttttcaaattaaactgtcactttaaagctgtgaagggaaggccaaacaatttggttaagcatgtcctttcggcatggtggtggccatggctaaatggtttgtgtgggttcttaagccatggctaggatcctaatgaaggtttccatgaaagtaatgttgaaactctgaaggaagcaactagccacagttatttttaa

SEQ ID NO: 115310 - DNA, 601 bp, Human
aggccgaggcaggcagatcaggaatttgagaccagcctggccaacatagtgaaaccccatctctactaaaaatatgaaaaattagctgtgcacggtgacgcacgcctgtaatcccagcaacttgggaagctgaggcaggagaattgcttgaacctgggaggcggaggttgcaatgagtcgagatcaagccactgcactccagcctgggcaacagagcgagagtctgtctcaaaaaaaaaaaaaaagttaaatgaacacaccttttaacatctttggaaattaagcctcaaactaatgaacyccaggatcccaagcccatatccccatgtgtccccagccacagggacagtctgtccctctgaggctgcttttgaaagaaagtatcatgtctccagcccagaagcactgtgagtacttcaccactctgttgtcttagggaaagtgtaaagccatttttgaacgccttccatgatatctgttcattgctctgtcttaaacataaatgttctcttatttctacaatgagaaattattcaaatattttactagctttctacaatagcacaggggtataatagggtcactgtccagccctcagcaa

SEQ ID NO: 115311 - DNA, 601 bp, Human
ttttaagtggtgcttttaaattttcagcagtggactgacaatggcacagtttacaaaatgccccacttttccttgtcctcaggcaagtgtgcacctgtctgtctggtgctccctgaggccttctctctccctctctctcgcccctcactcttcactgtctttccctccccctgtacgtgtccctttttccctctccattccttttccctattttttgtcatatatctctaccctttactggccatgaaactaaaatgtcactgtcattattattatttgctttatttattaaattgaatcmtatggcacgtgctgttttttcccattaggtcaacaaccttcaacaatgaacaatgatgtatattcatgtcttcatacatttctttcacacatagtatacgtgatagatagatgataggcagtcagattggtggatgggtgagtggatggatggataatacaagtgatgatagatggaacatagatagatagatagataggattgattaaataagataagatgacgagcagcaggtgtccaatccacccctgcagtgagggcagatatttaagggtcttgtgggggtaacattgcaaactg

SEQ ID NO: 115312 - DNA, 601 bp, Human
cagtcctagcaactagggaggctgagacaggagaatcgcttgaacccgggaggcggaccttacaggtcattgtaggaactcttagtgaataaggtcccgttggaggattttgagtggaggaggggccctagctgacctacactgtgaaaacatcaccctggccactgtttcagaagatgccatagagaggcaaggagaccaggctgctgctataatctgggtgagaggtgcggatggttggaatcatggaagtagtgagattcaatttggatccagtttgaaagtagagccttgctgatgtgatggatgtggctcgtgatagcaagagaagcatcagggatgatgtcatggtttattctgagccattgggaagacaaacctgccttcccctgtggtctgaaggctgcaggtggagcaggtcccgggggtcaggagttcgagcctggccatgctgagtttaagatgtgcattagacacctgagtagggacctccttcaccatctgtaaggaactggtaatagcaataatcagtataataatcaagcataatcatggcaaaaatcactgcaatacatagctgtcatatttacagttttaactt

SEQ ID NO: 115313 - DNA, 601 bp, Human
aagtgcaggtgcagtttggatggaacacggagatactgtgtagcggtgaagtacaggtgcagtttggatggaacacggagatattgtgtagcggtgaaatacaggtgcagtttggatggaacacggagatactgtgtagtggtgaagtacaggtgcagtttggatggaacacggagatactgtgtagtggtgaagtacaggtgcagtttggatggaacacggagatactgtgtagtggtgaagtacaggtgcagtttgagtggaacatggagattctgtgtagtggtgaagtacaggtgcrgtttggatggaacacggagatactatgtagtggtgaagtacaggtgcggtttggatggaacacggagatactgtgtagtggtgaagtacaggagcggtttgagtgggacacggagatactgtgtagtggtgaagtacaggtgcagtttgagtggaacacggagatactgtgtagtggtgaagtacaggtgcagtttgagtggaacacggagatactgtgtagtggtgaagtacaggtgcagtttgggtggaacacggagatactgtgtagtggtgcagtacaggtgcagtttgggtggaa

SEQ ID NO: 115314 - DNA, 601 bp, Human
cacggagatactgtgtagcggtgaagtacaggtgcagtttggatggaacacggagatattgtgtagcggtgaaatacaggtgcagtttggatggaacacggagatactgtgtagtggtgaagtacaggtgcagtttggatggaacacggagatactgtgtagtggtgaagtacaggtgcagtttggatggaacacggagatactgtgtagtggtgaagtacaggtgcagtttgagtggaacatggagattctgtgtagtggtgaagtacaggtgcagtttggatggaacacggagatactrtgtagtggtgaagtacaggtgcggtttggatggaacacggagatactgtgtagtggtgaagtacaggagcggtttgagtgggacacggagatactgtgtagtggtgaagtacaggtgcagtttgagtggaacacggagatactgtgtagtggtgaagtacaggtgcagtttgagtggaacacggagatactgtgtagtggtgaagtacaggtgcagtttgggtggaacacggagatactgtgtagtggtgcagtacaggtgcagtttgggtggaacacggagatactgtgtagtggtgaa

SEQ ID NO: 115315 - DNA, 601 bp, Human
aagtacaggtgcagtttggatggaacacggagatattgtgtagcggtgaaatacaggtgcagtttggatggaacacggagatactgtgtagtggtgaagtacaggtgcagtttggatggaacacggagatactgtgtagtggtgaagtacaggtgcagtttggatggaacacggagatactgtgtagtggtgaagtacaggtgcagtttgagtggaacatggagattctgtgtagtggtgaagtacaggtgcagtttggatggaacacggagatactatgtagtggtgaagtacaggtgcrgtttggatggaacacggagatactgtgtagtggtgaagtacaggagcggtttgagtgggacacggagatactgtgtagtggtgaagtacaggtgcagtttgagtggaacacggagatactgtgtagtggtgaagtacaggtgcagtttgagtggaacacggagatactgtgtagtggtgaagtacaggtgcagtttgggtggaacacggagatactgtgtagtggtgcagtacaggtgcagtttgggtggaacacggagatactgtgtagtggtgaagtacaggtgcagtttgggtggaa

SEQ ID NO: 115316 - DNA, 601 bp, Human
tgaatcttttttccctgatgaaaatacctaattattttatttctgttcccacacaaataagtttctcttgtgagtctctttggcatgctgcaagtgcacagctttcttagagaattaggattttacagagagaatcttaggtctatgagtgggagtattgtgaaaagtcaaaagctaaaaaattaattttgtgggaaaaaaaatacttgaggaaaattctatgttccatcactggagactcgatttatttaattctgtactgtgggaactgattagtaaaagtttatactttccacagttkttttgtgagattataatttggaaataaaagatagcatccctagacaaatcttcaagtatctttgaaaaaatgagtaaaagcagtagaaatcctgcaactggccctggggggctatgaaggtcccttggcttcatcttcctgtacttgggaacctgcagggaattccgtttctgccccaggcctcaaggatcttgagagaattaatatgtgaaattagcaagcttgcaggacacaggaacaaatacagagatcaattgtatttctgggcactagaaatgaaaaaaatctgaaaaatgaaat

SEQ ID NO: 115317 - DNA, 601 bp, Human
tgggcatggggtggcacatgcctgtaataccagctacttgggaggctaaggcaggagaatcacttgaattcgggaaacagaggtttcagtgaaccgagatcacgccactgcactccatcctgggcaataagagtgaaactccatctcaaaaaaaaaaaaaaaaagttgatttcatagaagtagagagtagaagtggttaccagaggttggagaggggaaagtagaggagagggaattggaagaagctgatcaatgggtacagagttacagttagacatgaagaataagtttgggcattctrttacacagtagagtgactatagcaaataataatgtagtgtatatttcaagttagccagaagagcagacttggaatattatcgccccagagaaatgataaatatttaaagtgatagatatagtagttacccagatttgatcattatactatgtatatactcattgaagcaccacattataccccataaatatgaagttattatgtgtcaattatgtattagtccattctctatatatttctttatagtcactgctataaagaaatagctgagactgtgtaatttatgaagaaaagaggttt

SEQ ID NO: 115318 - DNA, 601 bp, Human
gtttcagtgaaccgagatcacgccactgcactccatcctgggcaataagagtgaaactccatctcaaaaaaaaaaaaaaaaagttgatttcatagaagtagagagtagaagtggttaccagaggttggagaggggaaagtagaggagagggaattggaagaagctgatcaatgggtacagagttacagttagacatgaagaataagtttgggcattctgttacacagtagagtgactatagcaaataataatgtagtgtatatttcaagttagccagaagagcagacttggaatattatcrccccagagaaatgataaatatttaaagtgatagatatagtagttacccagatttgatcattatactatgtatatactcattgaagcaccacattataccccataaatatgaagttattatgtgtcaattatgtattagtccattctctatatatttctttatagtcactgctataaagaaatagctgagactgtgtaatttatgaagaaaagaggtttaattgactcagttctgcaggctgtacaggaagcaaagcggcttctgcttctggggaggcctcgggaaacttagaatcatggc

SEQ ID NO: 115319 - DNA, 601 bp, Human
agagtgactatagcaaataataatgtagtgtatatttcaagttagccagaagagcagacttggaatattatcgccccagagaaatgataaatatttaaagtgatagatatagtagttacccagatttgatcattatactatgtatatactcattgaagcaccacattataccccataaatatgaagttattatgtgtcaattatgtattagtccattctctatatatttctttatagtcactgctataaagaaatagctgagactgtgtaatttatgaagaaaagaggtttaattgactctgttctgcaggctgtacaggaagcaaagcggcttctgcttctggggaggcctcgggaaacttagaatcatggcagaaggcaaaggagaagcagacatgtcttacctggccacagcaggagaaagagagaagcggggagatgctacacacttttaaacaagcagctctcacgagcactaagtcaccgagggggaagtctgcctccatgatccagtcacctcccaccaggccccacctccaacattggggattacaattcaacatgagatttaggctaagatacagttccaaaccatagcaga

SEQ ID NO: 115320 - DNA, 601 bp, Human
cttgagctcgggaggtcaaggctgcagtgaacccagattgcaccactgcactccagcctgtgagaaggggcagagtgagaccacgtctcaaaaaattaaagttaaaaattaaaaagatcaatttctcaaccctctcactgacctctagccacatgcctgttagctctggggtcagcaccgtgtgggctcacttccatggctggttgggtagtagggtgaccacacgaccgtaccccacacggtttggagccctttctgccctgcagggcctggagcaatattgtttttcttttttttttctttttcttttttttttgaccaaatttagattaattactccagtcttggtcgtttttaattccatttggaaacctattatagtgaataactcttatgtgaacttttataaaatctggtgtctgtggttcctgtgtttggataaatccagttaaatttgtttcaatgtagcatgagtctatagtttttatatatcatacgtctgtcgtgtccagagaaatcaggtgcccagagctggcaactggaagacccatcaccatgaggcagcgatgtcactctcttcatggccatcttgataacggca

SEQ ID NO: 115321 - DNA, 601 bp, Human
gctcgggaggtcaaggctgcagtgaacccagattgcaccactgcactccagcctgtgagaaggggcagagtgagaccacgtctcaaaaaattaaagttaaaaattaaaaagatcaatttctcaaccctctcactgacctctagccacatgcctgttagctctggggtcagcaccgtgtgggctcacttccatggctggttgggtagtagggtgaccacacgaccgtaccccacacggtttggagccctttctgccctgcagggcctggagcaatattgtttttcttttttttttctttttyttttttttttgaccaaatttagattaattactccagtcttggtcgtttttaattccatttggaaacctattatagtgaataactcttatgtgaacttttataaaatctggtgtctgtggttcctgtgtttggataaatccagttaaatttgtttcaatgtagcatgagtctatagtttttatatatcatacgtctgtcgtgtccagagaaatcaggtgcccagagctggcaactggaagacccatcaccatgaggcagcgatgtcactctcttcatggccatcttgataacggcataatg

SEQ ID NO: 115322 - DNA, 601 bp, Human
cttttgggtaatattaccaatatgaactcataagccgttcatttacttttgagatgaaaaatgttcttctttcagagcatcttgcttgccataataataggtgaagttgagcacagtgacctcatggctctggaatgaacgaaaaatcacaattcacacttaactcctagttttttttaaacgaaaaaataaataaattatcatcctcaaagtgtaatttttaaagttccttttttatgtacctaatatgtctgggccaaatttaatccatctactcaaccatgtccattcctaatcatawctcacatagaaaacgtaaaagacagaagctaagacaaaacttgtccttataatatgcatgtttttttcatggctgagatgggggttcaatgagttaagttactgaattctaaatactttagaattatgctgttaattgtatttatagctaacatatggtattaactttgacgtaatttgcattttgggggactttccagaatgataaaacgattttgggccaggcacggtggctcacgcttgtaatccaaacactttgggaggccgaggtgggaggatcacttgaggtcaggagttcgag

SEQ ID NO: 115323 - DNA, 601 bp, Human
gaggcggaggtggcagtgagccgagattgtacacctgcactccagcctgagtgacagagcaaggctcgtctcaaaaaaatgaaaattaaaaaattaaaaatgtcctgtttcctgccatgcacgacaagtccttcaagattttctttaaatagctgggtgtggtggctcacacctgtaatcccagcactttgggaggccgagatgggcagatcacgaggtcaggagatcgagaccatcctggctaacacagtgaaaccccgtctctactaaaaatacaaaaaattagccgggcgtggtggcyggcacctgtagtcccagctactctggaggctgaggcaggggaatggcgtgaacccgggaggcggagcttgcagtgagccgagatcgcgccactgcactccagcctgggcgacagagcgagactccgtctcaaggaaaaaaaaaaaaaaaaaagattttccttaaataatgtttgtaaattggccctgcccttgagtttacatttgtgaatacagttctgtggttgctctcatgttatttggttgctttcggtttggatgtgggagtttggaaaggctctcaggggaactccaatgcagtc

SEQ ID NO: 115324 - DNA, 601 bp, Human
ccactgcactccagcctgggcgacagagcgagactccgtctcaaggaaaaaaaaaaaaaaaaaagattttccttaaataatgtttgtaaattggccctgcccttgagtttacatttgtgaatacagttctgtggttgctctcatgttatttggttgctttcggtttggatgtgggagtttggaaaggctctcaggggaactccaatgcagtctgagcagccttgggaggcttgcaggtgctgaaaaggccttttatcttttcctcttactctcactcactctttctgcaatacttcaatcrttaagcagtcatttaaggcacaatagaagctgggcatggtggcacatgcctgtggtcccagctactcaggaggctgaggtgggaggatcccttgagcccaggagttggaggctgccgtgagctatcattgtgccacacactccagcctgggcgacagagtgagaccctgtctcaaaaataaaaagacacaatagaattatgttaaactcacgtgctttagaggtgggaagaatataccaggaaaatgctagcaactggaatttctaaagcagttcttaataatattaaaattcatacacc

SEQ ID NO: 115325 - DNA, 601 bp, Human
tcaataattggtttttgaattctctaaggagagacactatcccagaaaaaaagaaaagagcagcgaaaaaagtcaagtgatttttctgctgcagtcccagatctgttttctgtcatctttcaggagttttcttgaccccattggccctctttggcactgatttgatcctatggctgtcaagtcctggaatactcagctttcaggacaatctggaaattattagcacaaatgaaatttcaacttcaaagttaattttttgaaggtcattttaaaatgaaaggaattgacctggcgcggtggytcacacccgtaatcccagcactttgggaggccgaggtgggctaatcacctgaggtcaggagtttgagaccagcctggccaacgtggtgaaaccccatctctactaaaattgcagaaattagccgggcatggtggtgcacgcgcctttaatcccagctactcgggaggctgaggcaggagaattgcttgaacccgggaggcagaggtttcagtgagccgagaccacgccattgcactccagtctgggtgacaagagtgaaactccatctcaaaataaataaataaattaataaaaatttta

SEQ ID NO: 115326 - DNA, 601 bp, Human
ttttgtgtgtaaaacctgtttttaaaatatctcagaaaatctacttacttgggtggagaactgcagtggcttcccattccttatctaacgtaaccctcagacttcctatacagaaaggatgcctggaacaggatggccttcagggcctggcctctctgcccagcacatacatcacaggaatctccaatcatggcgtgaaaatcaggaccttcaaactataaaacaaaaatcacatttttgatgccttagagctggatttttcagtatttcttagaaatggaacgcttcgtcacacggaacygtatggaatgccactagcaaagagggagaagacaagtcccctggtgaggagccggagcccttgtattcgcttctgcctgctgctgtgtggcccctctgttgcctccaaatgtgaggctccccggggtgcggtttaaaaactagtgcccgttttcaaaattcataccagcagaaccaaatgcaatttatagccaatgccaaagcaaagtggtattttattaaaataaatatatgaaaccaaagtgaaaatttaataaagtaaaatttagtttacatattcacatttgtaacatttacttat

SEQ ID NO: 115327 - DNA, 601 bp, Human
gtgaaccaccacactcagcccaggatagcttttgatgtacatatagaggtccttatgattcaagaaagtgaaaaaacaagctcatagaagggggaaaatgtttataaatcatgcatctgataaaggacttgtatctagaatcataaagaactcttacaaatcaataataacataagtaaaccgatttttaaatcagcaaaggatctaaatagacatctcccaagtaagatagatgaatggctaatcagccacgaaaagatgctaaacatctttagctgttaggaaaatgcaaagcaaaacyacagtgacattccacttcataaccctagggtggctgtgcctaaaaagtcagataaaacaagtgttgctgaggatgtgaagaaattgggatcctcatatactgctggtgggaatgtaaaatagtccagccactttggaaaacaaactggtagttctaaaaaacgttaaacacagttgccatatggcccaccaattccactcccaagtgtatgtccaagagaattgaaaatatacatccatgcaaaaacttctaggcaaatactcatagcagcattattcataataatcaaaatgtgtaaac

SEQ ID NO: 115328 - DNA, 601 bp, Human
gtgtgcaggagagtgcacttttcttgaaaataaaaaaaaaaagtagcataataaagactgctaacaaataataagaacacagattggaaagaggaatatatcgtgtgtttcatagacctaacaatatttcacgtgtttggttccctgccatattgcttgagtttgtacgttagtttgtaggaacctgaccaaaggagtagattttcctcctacaaaatgctctccaactagaggagtcagagagaaatgggcccagttgaggcagaggtagcttgcgccactccgggtaacagagtgacaycctgaaggaaagaaataaaggaaggaagggagggagggagagagggaaggaaggaagagaaaagagagagagagagagagaaagagagagggagggagagggggagagagacagagagagaaggggcccagtcagccttctcagttttgctgtgtcagctctatatggtcttcacaatatttgcaaatatccaatacaaactgccaggaaaacgccacttaaataatacatttttttctcttagtaagtcttgtttcagggattttttaagttaagcggttttgagtggccctctctggt

SEQ ID NO: 115329 - DNA, 601 bp, Human
gtaagttgttcagtgtaaagaaggaggaggagaatcactgtgttgctaaatgagtgaatgccaacttcgactaacatggaagttaggtttctcataacagtattaactcaccacatcaccaagaggaataataaaccgtgcatttaaactgcagatggaggaatgcagaattctgtttacatgctgctgttctatttctttctctttcttatttttatttttaaatcgacatcatttttttatatataaatatataaatacatatataaatatataaatataaatatatatataaatatayacacacacacacacacacacacacacacacacacagactcactctgtcagccaggctggaatacagtggcatgattatagctcattgtagtctcgaactcctggacacagagatcctcccacctcagcatcccaagtagctgggactacaggcacatgctaccatgcccagctaatttttattttttattttttgtagagaccgggtcttgccatcttgtccaggctgttgttaacatattttgagggacagtgactttggttttgttttgttgttgttgtttttgagacaggatcttgt

SEQ ID NO: 115330 - DNA, 601 bp, Human
taagttgttcagtgtaaagaaggaggaggagaatcactgtgttgctaaatgagtgaatgccaacttcgactaacatggaagttaggtttctcataacagtattaactcaccacatcaccaagaggaataataaaccgtgcatttaaactgcagatggaggaatgcagaattctgtttacatgctgctgttctatttctttctctttcttatttttatttttaaatcgacatcatttttttatatataaatatataaatacatatataaatatataaatataaatatatatataaatatatacacacacacacacacacacacacacacacacacagactcactctgtcagccaggctggaatacagtggcatgattatagctcattgtagtctcgaactcctggacacagagatcctcccacctcagcatcccaagtagctgggactacaggcacatgctaccatgcccagctaatttttattttttattttttgtagagaccgggtcttgccatcttgtccaggctgttgttaacatattttgagggacagtgactttggttttgttttgttgttgttgtttttgagacaggatcttgtt

SEQ ID NO: 115331 - DNA, 601 bp, Human
cagggagaggaggagaacagccttctcttcagaattctagtcagccctggtctctctgggaagatggcttctggaactccacctataccttctctccagcacagaaagtagaggtgtcatcatccaaggaatgtagcttcaggtgatggcaacttcttttagcaaccatactttttctttttttttcttttctttttttttttttgagaaggagtctctctctgtcacccaggctgtagtgcactggcgtgatctcagctcactgcaacctccacctttccagttcaagcgattctcctgyctcagccttccaagtggctgggattacaggcatgcaccaccacacccagctaatttttgtatttttagtagagacgggctttccccatgttggccaggctggtcttgaacccctggcctcaagcgatccacccacctcagccccccaaagtgctaggattacattcctgagccaccatgcccagtcaacaaccacactttataaagttcatattaactttgcagtcaatgcaactctgtcttctcaaaaaaacagctggaaagtcaacttctttctttaggctacatgatgatcattatt

SEQ ID NO: 115332 - DNA, 601 bp, Human
tgggtaattttacacgcgggtctccacagatcctgtctacttcggtagatttattactaggaaagtgcgtgggggcactaatttttgtgaattgactaatgcgttagaattttaaaaaccgggtagaacgcagcgcaggaagcgagcgttccccgccgcagcgccggagcgtccagccagaatccccctgcatgcgcagcccctggcgtcttacgtcccacaggccccaccccggcgccttccgtcccgcaggctccgcctttggcgctgggctctgacgtcaccacctgcgccgctcacwgtagaaacaggaagtgggaccaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaacc

SEQ ID NO: 115333 - DNA, 601 bp, Human
tctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagataytataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctag

SEQ ID NO: 115334 - DNA, 601 bp, Human
aggcagatcatctgaggttggaagttcgagaccagcctgaccaacatgaagaaaccctgtctctactaaaaatacaaaattagccgggcatggtggcacatgcctgtaatcccagctacttgggaggctgaggcaggagaattgcttaaacccgggaggtggaggttgcggtgagccgagatcgcgccattgcactccagcctgggcaacaagagcgaaactccatctcaaaaaaaaaaaagtgctgaaaataagcaccagtctgataagagaaccttattaactgagcatagtatcagcrtcagctggccaagcacactataaagcagaagggagggacttcctctgcaaaaacacaacatcctcttggcaattctgtagccaaagtccaaagctcaagatctttatagcaaaaagctgcaagccagtggacactaaggaaactgatgagcagacccctgtttttgtttttgtgttgaatcaactgactggaattagcaaaatgctgtctggtttacctaggtttgtttttctacattagattgcaaattccatagggagcccgggccaggcaatgtctgtcatagtgtcagtctctggg

SEQ ID NO: 115335 - DNA, 601 bp, Human
ggtttgtacagatcagtttcagggtggactccgaacccctggtgataagaacattctcctcttcctggtacagggcaggcacgtttcttagggaagatttcatgacctgctttttgggacagagcgggaggtcagccagccagccagccttgcagctgaggcttctcaagtgccttcagctacaattagtcaacatgctgaagggctcattgtggggtggcgttttgtgttctgaaccgtttcgtctccctcttgcccacactgaggttcacaggcgcctgcagaggagctggtgtgggasgatggggagattgggaggcaacatcgcctcctctgcatgaaatgctcatgggcacatgtctgctgcctctacctaccaaaggacagaaccagccaactggcatggcaggcagggagccagcgcagcctccaggccgtccatcctctctcctcagtaccagggcctcccgtcaacgccagcgccaacagagagcctgggcccccccgacccctccctcctgctggctctccttcttccttctagggcccctgctgcccctctgtctccagaattgtcccctgcttgccatttaacccattc

SEQ ID NO: 115336 - DNA, 601 bp, Human
agcgggaggtcagccagccagccagccttgcagctgaggcttctcaagtgccttcagctacaattagtcaacatgctgaagggctcattgtggggtggcgttttgtgttctgaaccgtttcgtctccctcttgcccacactgaggttcacaggcgcctgcagaggagctggtgtgggacgatggggagattgggaggcaacatcgcctcctctgcatgaaatgctcatgggcacatgtctgctgcctctacctaccaaaggacagaaccagccaactggcatggcaggcagggagccagckcagcctccaggccgtccatcctctctcctcagtaccagggcctcccgtcaacgccagcgccaacagagagcctgggcccccccgacccctccctcctgctggctctccttcttccttctagggcccctgctgcccctctgtctccagaattgtcccctgcttgccatttaacccattcccagtgcttgttggtccccgagggacccagcctctcagccctcaatggtcacctgtcccagccgcggaaggagaaggggacagaggacactggttcattccaccatatttactggggccagg

SEQ ID NO: 115337 - DNA, 601 bp, Human
cctctacctaccaaaggacagaaccagccaactggcatggcaggcagggagccagcgcagcctccaggccgtccatcctctctcctcagtaccagggcctcccgtcaacgccagcgccaacagagagcctgggcccccccgacccctccctcctgctggctctccttcttccttctagggcccctgctgcccctctgtctccagaattgtcccctgcttgccatttaacccattcccagtgcttgttggtccccgagggacccagcctctcagccctcaatggtcacctgtcccagccgcrgaaggagaaggggacagaggacactggttcattccaccatatttactggggccaggcctgcactaggtgctggggactcccaggtggacaagacagagacctgccctgagggcctaacatgttagtggagaagataaataacaacagatcaaccaagagtcagtgggaaacgtgcagcctggatagatgccttggtaaagccaggctggcacagagagggcggtggaggcctgtgcaggggccgtggtcactcaggagagggagctcggcggcctcccagctccctctcggaagggtcat

SEQ ID NO: 115338 - DNA, 601 bp, Human
gaaccagccaactggcatggcaggcagggagccagcgcagcctccaggccgtccatcctctctcctcagtaccagggcctcccgtcaacgccagcgccaacagagagcctgggcccccccgacccctccctcctgctggctctccttcttccttctagggcccctgctgcccctctgtctccagaattgtcccctgcttgccatttaacccattcccagtgcttgttggtccccgagggacccagcctctcagccctcaatggtcacctgtcccagccgcggaaggagaaggggacagagracactggttcattccaccatatttactggggccaggcctgcactaggtgctggggactcccaggtggacaagacagagacctgccctgagggcctaacatgttagtggagaagataaataacaacagatcaaccaagagtcagtgggaaacgtgcagcctggatagatgccttggtaaagccaggctggcacagagagggcggtggaggcctgtgcaggggccgtggtcactcaggagagggagctcggcggcctcccagctccctctcggaagggtcatcacccaagagcggcgcacag

SEQ ID NO: 115339 - DNA, 601 bp, Human
cctggaaagaatcgacagcgtcagcttggttgactacacacccacagaccaggtatgtggaattagggtcccccaccacacaccagaaactttgagattcatttccaatatgatttaatgattatttcagaatgaattaaggaaaaatccttaagatacctactttttgcaaattgtttgtactgccctgtgtgtgtgcgtggattggtcatcaaaccttgtgccttgctcccctgactctagcacttagtgattatcaaaattgccagcatgcaaatgagtttatctgcagataaggaayatgccgttccttttcctcctggagctgtcctcaggaaagcgaagtctttacttcctggcttcataaactatgcccattctgtttgtggccctgggcctggggggtcccatatcacagtgaactttccaggtgtgacccagagcatcccctttgggttgagtcaaaaaaaaagcactccaccatttttttttttttttgaaatggagtcttgctctgtcgcccagactggagtgctatgttgcaatctctgctcactgcaacctctgcctcccaagttcaagcgattctcctgcctcagcc

SEQ ID NO: 115340 - DNA, 601 bp, Human
gcgtggattggtcatcaaaccttgtgccttgctcccctgactctagcacttagtgattatcaaaattgccagcatgcaaatgagtttatctgcagataaggaacatgccgttccttttcctcctggagctgtcctcaggaaagcgaagtctttacttcctggcttcataaactatgcccattctgtttgtggccctgggcctggggggtcccatatcacagtgaactttccaggtgtgacccagagcatcccctttgggttgagtcaaaaaaaaagcactccaccatttttttttttttttgaaatggagtcttgctctgtcgcccagactggagtgctatgttgcaatctctgctcactgcaacctctgcctcccaagttcaagcgattctcctgcctcagccttccaagtagctgggattacaggtgcttgccacctcgcccagctaatttttgtatttttagtggagacagggttttgccatgttggccagactggtctcaaactcctgacctcaagtgatacacctgccttggcctcccaaaatgctgggattacaggcgtgagccaccgtgcccagcccactccaccaattcttaa

SEQ ID NO: 115341 - DNA, 601 bp, Human
agtggaacaaattatttgaaaaatattgatgaggtatagttatacccgggctttaccttgaagaagaacagtaatgtaactcagcttgtttccctcttcttgttcccaggacctcctcagatgcagagttctgacatctgggatttttgagacacgattccaagtggacaaagtaaacttccagtgagtatgttgttaagagctgcatggcccagggccacatgatgtcccagagccgaagggctgtgaggtttaagggggcttcattcctgaatgtgcatggcggccctttcaggtaagrgcagctggggtgaaatttgaactctagcaagagttgaagtgttgattttactgcctactttaaagtagaaatgaggacacctgaaaggaaggcagtgtttgcatctgagttgttgatttgattggcccttttttttagatcaggagactcatgaaattttgatctttcagatgcacagtcacaggttgagaactgaaatgagcagtttatgtgtgtctccagcccatctcttgggttgcccaactgcaaactcggccaaatgagcttactttcttcatttttctccctcatgataagaca

SEQ ID NO: 115342 - DNA, 601 bp, Human
ttttctccctcatgataagacattaattctccctccacaaagctcttttccatcctcatagctatcaccctagtcctgctccatcacttcccccgcccctagactctctcggcacagccctggcttgtctcctgtcccctggcttacccatttcagtcgcccttctcagtgccacgaaatgaatcttcctacggcacggcctggatcgtgctgttcctctgctgaagaaggttcgggctcactactgcttgtgcaccgtatgacccaagccctctgcctatgaccagccccgtccccaggmctgctttgtcccctgccacctgcctcaccaggctgggctgttgtcaggacccttccagttctcccagcttttcctgccgtagcgcttctgttcatcttgtcctctgagcctcagatgccacctgtgctaagcaaaccccacaaatctatcaaagcttccttcaggccaggcatagtgattcacgcctgtaatctcagcactttgggaggcaaaggcagtaggattgcttgagaccgggtgttcaagaccagcctgggcaacatagcaagaccctgtctctaccaaaaaaaaaaaaaaaaa

SEQ ID NO: 115343 - DNA, 601 bp, Human
tgtctctaccaaaaaaaaaaaaaaaaattagccaagcttgatggcatacacctgtggtcctagctactcaggaggctgaggtgggaggatctcttaagcccaggaattcaaggctgcagtgggccatgattaggccatttcactccagcctgggtgacagagtaagaccctgtctctaaaaaaaaaaaaaaaaaaaaagcatccaagcatccctcaaatctcagcccatggtgaccccttagaattcccattgcatatctactatgcagccattgatggtatactgccctttaccttgccyagtcaccctcagcatgtctgactcgactctaagggacctcaagggtgaggtcccttaaagcaagagtttcatgatctccagtgtgttctgagactcctgcagtgcccagcgccctcctcagtgcacaggtgacagacccctacttccagatttcccaagaacccttcacatggccactgtcaggctggataaaagccagctacatctctctgctgggaggcgcacagtgcagtatggagttggcgtgacttgtggttttgcccacatcataaccaagtccctggcatagtggaattacta

SEQ ID NO: 115344 - DNA, 601 bp, Human
aatgaagctgtatctcacatttgtgattttgtttgaaaggattctgctcatcagctcatccattttcatcaagtatctcagcgtgccccacgtgtgctaatgtaaagcgtacggattaaattctaataggatcagcaacatacccgcccaggacaaaaaaatctagcccgtgtggtcctaaggcacatgcattatgtttagggaggggagaaatctcagaggcagggaagcctgcgaaggttggaaacatccagcagaatctgggtaggtagaaactctcccagggagaaacgccttatgygctgagcaggggctgtgagaagaggggcctgggccggcctgatgaagtgcagggtgcagctgagaaactctgagagaactggctgaggtcgccttggctgagcgagaccgggaagcagctcgggctgggcagagcagcctgcactgaatccaggcgtgatcaagacccagtgcaggtcaccaggcagaggtggctagagataagatgcatgtagtgtagacagatcagcaaggagcctttctcaattctccatgggagggaagacacagtgtcctgagagctggaacaaatcacaggaag

SEQ ID NO: 115345 - DNA, 601 bp, Human
gtgaacgctggaacctgctgatagcaaaagaggaaagcaagcacgtttgccattgtcccctgcttcccccaaataattgtgttcctcttgctcttccacagcatgtttgatgttggtggccagagggatgagaggagaaaatggatccagtgctttaacggtgatttttttatgctctctcaagaaaataggagtgaattctaacactcagcactgctgtgcttaactattcttgaattagataatctctaactaatatgtaaagtatagcatttatagattatgatgctccttccttagrtactaatctcattaaaaaaagcatttaagggcctgacacggtggctcacgcccgtaatcccagcaccttgggaggccaaggagggcggataacctgaagtcaggagttcgagaccagcctggccaacatgtcgaaactggggctctgttaaaaatacaaaaattaggccgggcgtggtggctcatacctgtaatcccagcactttgggaggccgaggcgggcagatcacgaggtcaggagatcgagaccatcctggctaacgaggtgaaaccccgtctgtactaaaaatacaaaaaatta

SEQ ID NO: 115346 - DNA, 601 bp, Human
taatctcattaaaaaaagcatttaagggcctgacacggtggctcacgcccgtaatcccagcaccttgggaggccaaggagggcggataacctgaagtcaggagttcgagaccagcctggccaacatgtcgaaactggggctctgttaaaaatacaaaaattaggccgggcgtggtggctcatacctgtaatcccagcactttgggaggccgaggcgggcagatcacgaggtcaggagatcgagaccatcctggctaacgaggtgaaaccccgtctgtactaaaaatacaaaaaattagccrggtgcggtggtgggtgcctgtagtcccagctactcaggaggctgaggcaggagaatggcgtgaacctgggaggcagagcttgcagtgagctgagatcgcaccactgcagcagtccggcctgggcaaaagagcgagactctgtcaaaaaaaaataataataataaaaaaattagccgggtgtggtggctcatgcctgtaatcccagcactttgggaggctggggtgggtggatcacctgaggtcaggagttcaagatcagcctgaccaacatagtgaaaccccgtctctactaaaaatgca

SEQ ID NO: 115347 - DNA, 601 bp, Human
ccgggcgtggtggctcatacctgtaatcccagcactttgggaggccgaggcgggcagatcacgaggtcaggagatcgagaccatcctggctaacgaggtgaaaccccgtctgtactaaaaatacaaaaaattagccgggtgcggtggtgggtgcctgtagtcccagctactcaggaggctgaggcaggagaatggcgtgaacctgggaggcagagcttgcagtgagctgagatcgcaccactgcagcagtccggcctgggcaaaagagcgagactctgtcaaaaaaaaataataataatamaaaaattagccgggtgtggtggctcatgcctgtaatcccagcactttgggaggctggggtgggtggatcacctgaggtcaggagttcaagatcagcctgaccaacatagtgaaaccccgtctctactaaaaatgcaaaaattagccgggtgttatggcgcacacctttaatcccagctactcgggaggctgaggcaggagaatcacctgaacccgggaggcagaggttgcagtgagccaagattgcgccattgcactccagcctgggcaacaagagtgaaactctgtctcggaagaaaat

SEQ ID NO: 115348 - DNA, 601 bp, Human
ttgtcaagaaaatttaagtctctgttttgaaaggctaagattatattcggccttccatatcttcaggttccacatctgcggattcaaccaaccacagattgaaaatattcaaaaataaatttaagatagcagtacaacaacaaaaaataatacaagattacagtggcatacgcctataatcccagcactttgggaggctgagacgggggaattgcttgagctcaggaattggagaccagtctgggcaacatgttgaaaccctgtctctacaaaaaatacaaaaattaggcatggtggggcrcgcttgtagtcccagctacttgggaagctgaggcaggaggatcacttgagcccaggaggcggaggttacagtaagctgcgattgcatcactgcacgtcagtctgggcgacagagggagactgtgtctcaaaaaacgtaattaattaaaataaaaaattgagcaaataaaaaaattgactaaaaataatacaaataaacaatacagtataacaactacttacctagcttttacatcgtgttaggtattttaggtaattggagatgatttaagcatacgggaggatgtgcatggtttatatg

SEQ ID NO: 115349 - DNA, 601 bp, Human
aaaataaaaaattgagcaaataaaaaaattgactaaaaataatacaaataaacaatacagtataacaactacttacctagcttttacatcgtgttaggtattttaggtaattggagatgatttaagcatacgggaggatgtgcatggtttatatgcaaatactacaccatttcatataagggagcctcctcaaattttggttttcacagggagtcctagaccaatcccccacgggtatcaagggatgactctatatctagggttcaaaataggttttgtttggtttttaaattttaggaartaccagtttaggggccgggaacagtggctcatgcctgtaatcccagcactttgggaggccaaggcaggaagatcacctgagatcaggagttcgagaccaacctggccaatatggcgaaaccccgtctctactaaaactacaaaaattagccaggagtggtggtgggcgcctgtaatcccagctactcgggaggctgaggcaggagaatcgcttgaacccgggaggtggaggttgcagcgagctgagatcgcaccactgaactccagcctgggcaacagagtgagactctgtctcaaaaag

SEQ ID NO: 115350 - DNA, 601 bp, Human
atgcaaatactacaccatttcatataagggagcctcctcaaattttggttttcacagggagtcctagaccaatcccccacgggtatcaagggatgactctatatctagggttcaaaataggttttgtttggtttttaaattttaggaagtaccagtttaggggccgggaacagtggctcatgcctgtaatcccagcactttgggaggccaaggcaggaagatcacctgagatcaggagttcgagaccaacctggccaatatggcgaaaccccgtctctactaaaactacaaaaattagccrggagtggtggtgggcgcctgtaatcccagctactcgggaggctgaggcaggagaatcgcttgaacccgggaggtggaggttgcagcgagctgagatcgcaccactgaactccagcctgggcaacagagtgagactctgtctcaaaaagtaaaaaaaaaaatttttttaattttgaaaataaataaagtaccagtttaggacatccactaataactagatgatctctaagatcccttacagctcacaatcaccacataatcatgtttgaaactactagcattgcagattggcagaagtgat

SEQ ID NO: 115351 - DNA, 601 bp, Human
gggccgggaacagtggctcatgcctgtaatcccagcactttgggaggccaaggcaggaagatcacctgagatcaggagttcgagaccaacctggccaatatggcgaaaccccgtctctactaaaactacaaaaattagccaggagtggtggtgggcgcctgtaatcccagctactcgggaggctgaggcaggagaatcgcttgaacccgggaggtggaggttgcagcgagctgagatcgcaccactgaactccagcctgggcaacagagtgagactctgtctcaaaaagtaaaaaaaaaawtttttttaattttgaaaataaataaagtaccagtttaggacatccactaataactagatgatctctaagatcccttacagctcacaatcaccacataatcatgtttgaaactactagcattgcagattggcagaagtgattatttcagaaaggaatatttagcgcgcacacacacaatacatacatatatagttagaaatcaaagtttcttctgaaatattttggaagaaatattaccaaggaggagaggaaacataagtttaccttataaaagttttggattatcagaaaagtgttttt

SEQ ID NO: 115352 - DNA, 601 bp, Human
gtttttctttctttttttttttttttgagacagagtctcgctctgtcccccaggctggagtgcagtggtgcaatctcagctcaccacaacctccacctccccagttcaagcgattctcctgcctcagcctcccgagtagctgggactgcaggcacgtgccaccacgcccagctactttttgtatttttagtagagacagggtttcacagtgttggtcaggctggtctcgaactcctgacctcgtgatctgcccacctctgccccacaaagtgctgggattacaggcgtgagccaccacacstggccaaattgtgttattaattgatagtaagattcctgtagactaatcagttagcttgattcctttgaagtgatggaggcggaagaagaaccaagccagctgcatgttaagctctgtgttattagctaatgagtcatatattactttgttgttgttaacactttcacttctaatgtgagttttccgaccttttattggtaaattacaccacagaaattcaagtgaactcattacataagtaaatcttagctttggttccaataaatctatatcccccatgggactgaattagaaagtgct

SEQ ID NO: 115353 - DNA, 601 bp, Human
tttctttttttttttttttgagacagagtctcgctctgtcccccaggctggagtgcagtggtgcaatctcagctcaccacaacctccacctccccagttcaagcgattctcctgcctcagcctcccgagtagctgggactgcaggcacgtgccaccacgcccagctactttttgtatttttagtagagacagggtttcacagtgttggtcaggctggtctcgaactcctgacctcgtgatctgcccacctctgccccacaaagtgctgggattacaggcgtgagccaccacacgtggccarattgtgttattaattgatagtaagattcctgtagactaatcagttagcttgattcctttgaagtgatggaggcggaagaagaaccaagccagctgcatgttaagctctgtgttattagctaatgagtcatatattactttgttgttgttaacactttcacttctaatgtgagttttccgaccttttattggtaaattacaccacagaaattcaagtgaactcattacataagtaaatcttagctttggttccaataaatctatatcccccatgggactgaattagaaagtgcttaactac

SEQ ID NO: 115354 - DNA, 601 bp, Human
ttaactacagattgagtatcccttatccgaaatgcttgggaccaaaagtgtttaagatttcttgttgttgttgttttttggaatagttgcattatacttactagtccagcatccctaatatgaaaatgcaaagtgtcaaatgctccgacaagcatttccttcgagcatcatgtcagtgctgaaaaagttttggattttgaagcattttggattttgtgtttttggattagggatgctcaacctgtacctatatttgtttatcattctttacagatggaatgaggatactggtgtactgaastttcttgaatcctatacatttttaggaagacgatggtattcttttaatttagcaacttctatgttagaggcactttcatgtactagtgtatgtgaaatttgtatgtttatttttccttttttaggtggttacggaccatttctatcatcttgttcttgaacaaacaagatatgctggcagaaaaagtcttggcagggaaatcaaaaattgaagactatttcccagaatatgcaaattatactgttcctgaagacggtaagatttcaaaacacattcttatgattgaggaatagaattgtt

SEQ ID NO: 115355 - DNA, 601 bp, Human
tttcatgtactagtgtatgtgaaatttgtatgtttatttttccttttttaggtggttacggaccatttctatcatcttgttcttgaacaaacaagatatgctggcagaaaaagtcttggcagggaaatcaaaaattgaagactatttcccagaatatgcaaattatactgttcctgaagacggtaagatttcaaaacacattcttatgattgaggaatagaattgttttattaatagtcctgtaactctaattcacatacctctgatgaatcaaagaaattcactttatttaaatcaattytctttctactgcccatatcctaaagtattagagtgttacaaggtcctatttgtaatcggatcccatttgtaaatgtttccgagtttgactttccattgaaaccgtgcagcagaagaaagagccattttgggatgtgactgtgtcatgctggtatgagctctccctctagtgcctttggctgggtgtgacatgacaggtgccttgttagtccttgatacagaccttctcacttcaccctcagatgaccctgcatggtagtttctattattttttcccgtggaaagagagtctgagagagga

SEQ ID NO: 115356 - DNA, 601 bp, Human
acggaccatttctatcatcttgttcttgaacaaacaagatatgctggcagaaaaagtcttggcagggaaatcaaaaattgaagactatttcccagaatatgcaaattatactgttcctgaagacggtaagatttcaaaacacattcttatgattgaggaatagaattgttttattaatagtcctgtaactctaattcacatacctctgatgaatcaaagaaattcactttatttaaatcaattttctttctactgcccatatcctaaagtattagagtgttacaaggtcctatttgtaatmggatcccatttgtaaatgtttccgagtttgactttccattgaaaccgtgcagcagaagaaagagccattttgggatgtgactgtgtcatgctggtatgagctctccctctagtgcctttggctgggtgtgacatgacaggtgccttgttagtccttgatacagaccttctcacttcaccctcagatgaccctgcatggtagtttctattattttttcccgtggaaagagagtctgagagaggagagatagcgtgttcaaagccacacgggtagagtcatgcaggcaaggcagtccttgca

SEQ ID NO: 115357 - DNA, 601 bp, Human
ctgcccatatcctaaagtattagagtgttacaaggtcctatttgtaatcggatcccatttgtaaatgtttccgagtttgactttccattgaaaccgtgcagcagaagaaagagccattttgggatgtgactgtgtcatgctggtatgagctctccctctagtgcctttggctgggtgtgacatgacaggtgccttgttagtccttgatacagaccttctcacttcaccctcagatgaccctgcatggtagtttctattattttttcccgtggaaagagagtctgagagaggagagatagcrtgttcaaagccacacgggtagagtcatgcaggcaaggcagtccttgcaccctttgtccccaagcccatgctggcagcagccgcgcttatctgctcctgtctctagccttgctgtggctgcagccttggggatttccagcagggccagcagccatcccaggccacctgagactgaggggtttccggggcacgggaccgtcagtgctaaagctgggaaggtagaccaggaagagttggtcactccgtttccagtcgcttacacttcagtttccagtgaacaccaggtctaccagaggctcat

SEQ ID NO: 115358 - DNA, 601 bp, Human
tttccgagtttgactttccattgaaaccgtgcagcagaagaaagagccattttgggatgtgactgtgtcatgctggtatgagctctccctctagtgcctttggctgggtgtgacatgacaggtgccttgttagtccttgatacagaccttctcacttcaccctcagatgaccctgcatggtagtttctattattttttcccgtggaaagagagtctgagagaggagagatagcgtgttcaaagccacacgggtagagtcatgcaggcaaggcagtccttgcaccctttgtccccaagcccrtgctggcagcagccgcgcttatctgctcctgtctctagccttgctgtggctgcagccttggggatttccagcagggccagcagccatcccaggccacctgagactgaggggtttccggggcacgggaccgtcagtgctaaagctgggaaggtagaccaggaagagttggtcactccgtttccagtcgcttacacttcagtttccagtgaacaccaggtctaccagaggctcataggagtgatttaaggtgaaataacaccgcttcttacatcttgaattccaaactagaaaacgcagaat

SEQ ID NO: 115359 - DNA, 601 bp, Human
ctcagcgtgaggtcaaggtccaggctcttcctgagaccaaatcaagtggaaatctcattgcagttcatcactgccttgctctacccgcagcctgatgatgtgctttccaggactgaggccgggtgccgcttgcccatggcacatcatcagagcatggcttctgctgcgctttctgtggctggcattgccagtttcccagcaagctgggtctttaattctcccgctaaccgcctcttgccacctcctgtcactcagctcaggcagtggctcggcggccggggggtccttccaacagggtctrcctccccaggcccttccctctttccctcctcatggctgtggtccaggccctcactcctctcgtctcagcagctgccacagcttcctgcctgacctcctgtagctggtcactcacctttccagaacattctgtgaactaccaaagtcacccttctgagacacaaccttacctgcttaggagcaccaaggagaagcaccaccactggctgacagccaaggccacctgcccagccgcgggtgctgaagggcttccgtccaggggctgaggggaccctggcttgctgcctcggtgccaggccca

SEQ ID NO: 115360 - DNA, 601 bp, Human
gcagttcatcactgccttgctctacccgcagcctgatgatgtgctttccaggactgaggccgggtgccgcttgcccatggcacatcatcagagcatggcttctgctgcgctttctgtggctggcattgccagtttcccagcaagctgggtctttaattctcccgctaaccgcctcttgccacctcctgtcactcagctcaggcagtggctcggcggccggggggtccttccaacagggtctgcctccccaggcccttccctctttccctcctcatggctgtggtccaggccctcactcctstcgtctcagcagctgccacagcttcctgcctgacctcctgtagctggtcactcacctttccagaacattctgtgaactaccaaagtcacccttctgagacacaaccttacctgcttaggagcaccaaggagaagcaccaccactggctgacagccaaggccacctgcccagccgcgggtgctgaagggcttccgtccaggggctgaggggaccctggcttgctgcctcggtgccaggcccagtgactgctcttcacccagcagcatgcgtcatctccatctgtgccctgcctctcccaag

SEQ ID NO: 115361 - DNA, 601 bp, Human
gttcatcactgccttgctctacccgcagcctgatgatgtgctttccaggactgaggccgggtgccgcttgcccatggcacatcatcagagcatggcttctgctgcgctttctgtggctggcattgccagtttcccagcaagctgggtctttaattctcccgctaaccgcctcttgccacctcctgtcactcagctcaggcagtggctcggcggccggggggtccttccaacagggtctgcctccccaggcccttccctctttccctcctcatggctgtggtccaggccctcactcctctcrtctcagcagctgccacagcttcctgcctgacctcctgtagctggtcactcacctttccagaacattctgtgaactaccaaagtcacccttctgagacacaaccttacctgcttaggagcaccaaggagaagcaccaccactggctgacagccaaggccacctgcccagccgcgggtgctgaagggcttccgtccaggggctgaggggaccctggcttgctgcctcggtgccaggcccagtgactgctcttcacccagcagcatgcgtcatctccatctgtgccctgcctctcccaagaga

SEQ ID NO: 115362 - DNA, 601 bp, Human
caacgtcaactctcacttagcaattaaaaggaactaacagttggtccatgtgacggcatgggttaaactcacagtaattgtgctgacagaaagaatcaaagcaaaaactacacaccatgtgaatgcatttgtgtaaatgtctaaaaagtaaattagctgggcgtggtggtgtgcgcctgtagtcccagctactcgggaggctgaggcaggagaatcacttgaacccaggaggcggaggttgcagtgagccaagatcgtgccactgcactccagcctggtgacagagcgagactccatctcaaaaaaaaaaaaaaaaagtgcagacttatgcatggtgacaggaagcacatcggtggttgcctcgggaaggagggctgcagagggaatgcaggcgctgtgggagggtccggctgtgctcattgtttccatgtagtgatgctggcatgacaacacacacgccagaactcctcagacgggccaggcgtggtggctcacacctataatcccaacactttgggagtctgaggcgtgcagatcacctgaggtcaggagttcaagaccagcgtggccaacacggtgaaaccccatctctactaaaaac

SEQ ID NO: 115363 - DNA, 601 bp, Human
gttaaactcacagtaattgtgctgacagaaagaatcaaagcaaaaactacacaccatgtgaatgcatttgtgtaaatgtctaaaaagtaaattagctgggcgtggtggtgtgcgcctgtagtcccagctactcgggaggctgaggcaggagaatcacttgaacccaggaggcggaggttgcagtgagccaagatcgtgccactgcactccagcctggtgacagagcgagactccatctcaaaaaaaaaaaaaaaaagtgcagacttatgcatggtgacaggaagcacatcggtggttgccycgggaaggagggctgcagagggaatgcaggcgctgtgggagggtccggctgtgctcattgtttccatgtagtgatgctggcatgacaacacacacgccagaactcctcagacgggccaggcgtggtggctcacacctataatcccaacactttgggagtctgaggcgtgcagatcacctgaggtcaggagttcaagaccagcgtggccaacacggtgaaaccccatctctactaaaaacacaaaaattagccaggcatggtggccagcacctataatcccagctactcgggaggctgagg

SEQ ID NO: 115364 - DNA, 601 bp, Human
agaatcaaagcaaaaactacacaccatgtgaatgcatttgtgtaaatgtctaaaaagtaaattagctgggcgtggtggtgtgcgcctgtagtcccagctactcgggaggctgaggcaggagaatcacttgaacccaggaggcggaggttgcagtgagccaagatcgtgccactgcactccagcctggtgacagagcgagactccatctcaaaaaaaaaaaaaaaaagtgcagacttatgcatggtgacaggaagcacatcggtggttgcctcgggaaggagggctgcagagggaatgcagrcgctgtgggagggtccggctgtgctcattgtttccatgtagtgatgctggcatgacaacacacacgccagaactcctcagacgggccaggcgtggtggctcacacctataatcccaacactttgggagtctgaggcgtgcagatcacctgaggtcaggagttcaagaccagcgtggccaacacggtgaaaccccatctctactaaaaacacaaaaattagccaggcatggtggccagcacctataatcccagctactcgggaggctgaggcaggagaatcgcttgaacccgggaggcaga

SEQ ID NO: 115365 - DNA, 601 bp, Human
cattgtttccatgtagtgatgctggcatgacaacacacacgccagaactcctcagacgggccaggcgtggtggctcacacctataatcccaacactttgggagtctgaggcgtgcagatcacctgaggtcaggagttcaagaccagcgtggccaacacggtgaaaccccatctctactaaaaacacaaaaattagccaggcatggtggccagcacctataatcccagctactcgggaggctgaggcaggagaatcgcttgaacccgggaggcagaagttgcagtgagccgagattgcaccmttgcactccagcctgggcgacagaacaaggctccgtctcaaaaaaacaaaaaaaaagcactccagcctgggtgacggagtgagacttagtctcaagaaaaaaaaaaagaactcctcagatggtacacggacactctgggcattccagagtatgtcagtgacccccacccccgccaagataaatgacatgggcgctccccagccactccagaacacagcccaggcagagacccacagcggttgctgcacccttccctccctcactggatgctgcacccacccaccccccacagcaggtgct

SEQ ID NO: 115366 - DNA, 601 bp, Human
caggcctcttacaaggatataatcccatccatgaaggcggagccctcgtgacctcatcacctctcaaaggctgcccctcttgatattgttgcattggagattagcagtcaacatatgaatttggaggagacaaaaacattgagaccatagcacccccagagaaaagttttatcagagcaataactattaaaatgatgtaggagaagagggcaatgaaaattacatgtttggctgggcgcagtgactcacgcttgtaatcccagcactttgggaggccaaggtggccctgaagtcaggagtytgagaccagactggccaacatggtgaaaccctgtctctacaaaaattagccagttgtgatggcgggtgcccgtaattccagctagtagggaggctgaggtgggagaatcacttgaaccggggaggtggaggttgcagtgagccgagatcatgccactgcactccagcctgggcaagagagtgagactccgtctcttaaaaaaaaaagtacatgtttgtttttgccttgctgtacatgtattttaatgctgggaatatacagcagtctaacgttgaaattccttctgtgttttcgtagagt

SEQ ID NO: 115367 - DNA, 601 bp, Human
ttagccagttgtgatggcgggtgcccgtaattccagctagtagggaggctgaggtgggagaatcacttgaaccggggaggtggaggttgcagtgagccgagatcatgccactgcactccagcctgggcaagagagtgagactccgtctcttaaaaaaaaaagtacatgtttgtttttgccttgctgtacatgtattttaatgctgggaatatacagcagtctaacgttgaaattccttctgtgttttcgtagagttgtatctttgtttcatgttgcttaaataaagttccatttgtcattkctacagcaacaccagatgcaggagaagatcccaaagttacaagagccaagttctttatccgggacctgtttttggtaagcaattttgttaacctttgtttttctacctcccttcttaatcttttgtttcttacaatatgcaaattactccttgatgatctcatttaatcttccttaacattacgagcgatgacaaagggtatgttactttaatttcacagctgagcacaccgaggttcagagaggttagatttctcacccaaggtcacacagcttccaaccagcagagcctgggtgagaa

SEQ ID NO: 115368 - DNA, 601 bp, Human
atgcaaattactccttgatgatctcatttaatcttccttaacattacgagcgatgacaaagggtatgttactttaatttcacagctgagcacaccgaggttcagagaggttagatttctcacccaaggtcacacagcttccaaccagcagagcctgggtgagaacacagcgttccagggaatggcacttggatgggctagacttcattcacttgttgtattttccaaaaaggacagcgtccttcagcagagtctaagcacccatactcttcctccatccaaaagcactaacaggctgatgrtttatgtaaaaatggatgtgctcaaattcagatatttacttttttttcttcagctttttgagattatttcaaacttacatatgaggcagaagatttgtacaaataactcccatatactcaggccgggtgcggtggctcatgcctgtcatcccagcactttgggaggctgaggcagatggatcacctgaggtcaggagttcgagactagcctggccaacatggtgaaaccccatctctactaaaaatacaaaaaattagctgggtgtggtggcatgcgcctgtaatcccagctactctgga

SEQ ID NO: 115369 - DNA, 601 bp, Human
agcgtgtagctagctgtgagtttttactcgcttcaaactattacatgccaaggcattcccaagggcgtgttcccggtagtactccaagtgcacttaacacgtgtggacaagatcttagtccaggtagcagtagggctgatcctcggctgtggggcctttccacggggaccggcactccagcctggcctttcaccacccttttcccggcacacccctgtgggatgactcttgaatcctacagtgagttagaaagtaacaatgaggagaaatcaaggccccagggtgagttcagaggacaagkgttcccccagaagtgcatggccgtaagtgcatggcaatacccagagagcttctgcgctgaataaatctgggacatgctatgttaaatacagcaagagagcctttacttaagccaattaatgtgcattgcaaatctcttcaataagggaatttagtttgtaatagctcaagggatcccttttttaaggagcattttgtaagaccatagcacataaagacacaagaaaatgctgttctaatgagaactaaatgttaattaagcatgcatatgttgggcatttaaatgaagattagaaacatc

SEQ ID NO: 115370 - DNA, 601 bp, Human
ttaccacatttgggtttttctaccaacttgcttaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacaggtatgcagtctgttggcggtcgcggtctgtagtgaaggtcatagggcgccaggggagatgatagtggatggcamggaggcaaaaactctaaattaatggacgttttcttagggtacagcactcctgtgcccttccagaagcttccatgatgggtagggcccggattgtggggagataggacggtggtgcgaaagcagtggctaaagggcgtttttcctccctaagacattacgaaacttcggctgctttccttcccagtgtagagcacgggaaacatggagtaaaaagccgtggcgcagtccgagttcggtacactgtaaccaggacccgaagctttattttcggtcatccacacgagttgggggagggtccta

SEQ ID NO: 115371 - DNA, 601 bp, Human
gtggttgggcgccgctgtcttttcagtcgggcgctgagtggtttttcggatcatgtctggtggctccgcggattataacaggtatgcagtctgttggcggtcgcggtctgtagtgaaggtcatagggcgccaggggagatgatagtggatggcaaggaggcaaaaactctaaattaatggacgttttcttagggtacagcactcctgtgcccttccagaagcttccatgatgggtagggcccggattgtggggagataggacggtggtgcgaaagcagtggctaaagggcgtttttcctcyctaagacattacgaaacttcggctgctttccttcccagtgtagagcacgggaaacatggagtaaaaagccgtggcgcagtccgagttcggtacactgtaaccaggacccgaagctttattttcggtcatccacacgagttgggggagggtcctaggctttacttggggaagggttggaggcagcggtctccactcggccacggcgcggaggcgacgggacaggaccggtgccggtgaaccgttggcatcgccctcgccaggccgctccgcccgcgtcaatcacccggcttgcgcattgtt

SEQ ID NO: 115372 - DNA, 601 bp, Human
gatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggagattgagttcaaggagacccaagcactagtattggcccccaccagagaactggctcaacaggtattgatagtgtagttcaaaaaaactgcttgcgtgttgcataggtttcaggtttcacaactgtgaagaatttaaaacttagtataaattggt

SEQ ID NO: 115373 - DNA, 601 bp, Human
cattttttaagtttgaatgcagttgtgcaacatgaaaactgcagtgacatgttaccatttgactgtctccgtagttcgtgatgcatctgttgcatgctatgttttcaaagctcactgctatattggctttgaagtaaaccttcctaataaagctgtaggctttattgaggtcaggattatataaggcacaataccctctgggggaaaaaaatcatttgccctagctgtaattacagaacataaatttcactacgtactccctacctacagtgaagaataatgtaggaaacgttattcttgrattgtctagctgatgcgtggagcagcagcatcccaagtttgacaaggcataagaaagacattaagggaattttaccttgcagcagttaggtcgtctgcattttaagcttggaagtagttttgtgctgtgcatgcataaaagctgttggcagaccagattatatttgcctttatgctttaaaaattagtcattgatcctggagttctgcggaataataattaaggcttgggttttagatccaaaaggtaattctggcacttggagactatatgggagccacttgtcatgcctgcattggtg

SEQ ID NO: 115374 - DNA, 601 bp, Human
ttgtctttaagagagtattttttttaaaactgttaacatagttgaaaagtcaaattgtatcactgagtagatctagaaatgacagtatgactttgtttctaacagctccaaaatggatcaaaatgtttgttttggatgaagcagatgaaatgttgagccgtggttttaaggatcaaatctatgagattttccaaaaactaaacacaagtattcaggtaagcattacttcacccccctcttaaaggtagagatggggtttatttaatgcaggtactgttacaatacaactgatgtgttttgytgtcgttccccctgcttaaagcacttgatgcataactctgtctaccttcattccgtagtaagacagagacgcttggcttcagacattttcctttgggtattaatgtgtaagttgtgctacaacataattttctctttttaaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggtaactgtctgatt

SEQ ID NO: 115375 - DNA, 601 bp, Human
aaaagttagctttttggggggcaggtttttaagtaacctttgccaacttgggctatttggaagagtaaaagaccacactccacagtgggctataccacttagtatagttcgctactattttgtggcctacatgacaggtgtcaagtttttttgaatcaatttttaaaacatgccattgtgtttcaggctcgcgggattgatgtgcaacaagtgtctttggttataaattatgatctacctaccaatcgtgaaaactatattcacaggtgagaagccagcatcttggctgtattgaaaaaamttcatacgtttttctactgtgatttgtatgaaaggtaacatcaaatcaaggaatagattcagtaaagtcagtagtgttcagtaagatgatgtaattaaatttgtactagggaaggttgatgagaacaaagtgggaaaacttgtaaacattgcccagattgtggacatagggtttttttccacaattgttggtcttaccttatgcttgagcttttagtgatgttcttgtgtccatgtgtttttcttggtgattttttctatagttgggattttcttggtgtcgcctggtagcaatttgagt

SEQ ID NO: 115376 - DNA, 601 bp, Human; identical to SEQ ID NO: 115370

SEQ ID NO: 115377 - DNA, 601 bp, Human; identical to SEQ ID NO: 115371

SEQ ID NO: 115378 - DNA, 601 bp, Human; identical to SEQ ID NO: 115372

SEQ ID NO: 115379 - DNA, 601 bp, Human; identical to SEQ ID NO: 115373

SEQ ID NO: 115380 - DNA, 601 bp, Human; identical to SEQ ID NO: 115374

SEQ ID NO: 115381 - DNA, 601 bp, Human; identical to SEQ ID NO: 115375

SEQ ID NO: 115382 - DNA, 601 bp, Human; identical to SEQ ID NO: 81562

SEQ ID NO: 115383 - DNA, 601 bp, Human; identical to SEQ ID NO: 81563

SEQ ID NO: 115384 - DNA, 601 bp, Human; identical to SEQ ID NO: 81564

SEQ ID NO: 115385 - DNA, 601 bp, Human; identical to SEQ ID NO: 81565

SEQ ID NO: 115386 - DNA, 601 bp, Human; identical to SEQ ID NO: 81566

SEQ ID NO: 115387 - DNA, 601 bp, Human; identical to SEQ ID NO: 81567

SEQ ID NO: 115388 - DNA, 601 bp, Human; identical to SEQ ID NO: 81562

SEQ ID NO: 115389 - DNA, 601 bp, Human; identical to SEQ ID NO: 81563

SEQ ID NO: 115390 - DNA, 601 bp, Human; identical to SEQ ID NO: 81564

SEQ ID NO: 115391 - DNA, 601 bp, Human; identical to SEQ ID NO: 81565

SEQ ID NO: 115392 - DNA, 601 bp, Human; identical to SEQ ID NO: 81566

SEQ ID NO: 115393 - DNA, 601 bp, Human; identical to SEQ ID NO: 81567

SEQ ID NO: 115394 - DNA, 601 bp, Human; identical to SEQ ID NO: 34326

SEQ ID NO: 115395 - DNA, 601 bp, Human
gaattgcttgaacccgggaggtggaggtttcagtgagctgagattgcaccactgcattccagcctgggcaacagagtgagactccatctcaaaaaaaaaaaaaaaatgaagttagaaaccagttgggagttcagtgcaatcatgtaggcagcttgtgatggagtctggacttgggcaggggatgtggaagcgaagaggtaaagggagatttgaagttgagtttgaaggaggaactggtaaggaaagaagtgagaaattagaaacaacttaaatgtccatcaatatatggacagttaaacayagtcatgcaatgagctattacacagccaaaaccacagtgatgtagatctgcacttatagacatggaagctatccataacagattgtgaaatgagaagggcagttataatacaatttcatttttatagaaacaattacatgtgtttgagtcagggtttaaatatgcatagaaaaaagtctggaaggatatacatcaatacattaacagtggtgggatttggggtgagttttattattttttttccttatctaatctctaaattttaatccaaacatggattgcttttacagtagaaacaaa

SEQ ID NO: 115396 - DNA, 601 bp, Human
gctaattttctaaaaaaaaaatttattacagagacaagtctcactatgttgtccagactggtctgaaacttttggcctcaggcagtcctcccaaagtactgggattacaggcataagccaccacagctggcctctactttcaatatatctggaacacaaccacttctcataacaatcactgctaccattttggttcaagcccctgcaccttcaagcttggtactattggcaatattaggttattgcaataaatctcccacttggtctccctgcagctgcctagcccctttaaagtctattmtccagagtcaggggttggcaaaacttttttataaagaactagagagtaaatcctttaggctttgtgggccgtgatgtctctgtcacagctactcaactcttccagcaaaagcagccatggacaagataaaagtgaatgggcgtgattatgttcccataaaacttcatttaccaaaacaggtggctggcccttgggctgtagtttgctgacccctgttctgagtgatctttacaaaatttaagacagatcgtctcccccttctgcttaaaaaaccctccagtggcttctcacttgactcaa

SEQ ID NO: 115397 - DNA, 601 bp, Human
aagtctgggaaccactgccctgtagaactttggacagtgccatgcacttagcagatgcttaatggcagattcttttggctctcctttttcttttttctttttcttttttttaatttagagacagggtcttgctcagtcattcatgctggagtgcagtggcacaatcatagctcaggatagcctctcgaatttctcagttcaagccatcctcccgcctcagcctcctgaggagctgggaccacaagtgcacactaccacacgaggctaattttctaaaaaaaaaatttattacagagacaastctcactatgttgtccagactggtctgaaacttttggcctcaggcagtcctcccaaagtactgggattacaggcataagccaccacagctggcctctactttcaatatatctggaacacaaccacttctcataacaatcactgctaccattttggttcaagcccctgcaccttcaagcttggtactattggcaatattaggttattgcaataaatctcccacttggtctccctgcagctgcctagcccctttaaagtctattctccagagtcaggggttggcaaaacttttttataaaga

SEQ ID NO: 115398 - DNA, 601 bp, Human
ttttcttggcacttgaaaagtttcttgctccatctgaacaagaacacagcaggtgagcagaggtgaccagctccgcagcgatggatctaagattcagtgggctggcaggggttttccccactccctcccaccccacctaccatgaagaataggattgggggcaggactgagctcgttctccattgtccccactgaagtacaggaaaactaaaatcactccttcaaatctaagcaggccaaatctgaaggcacagaataggaaggcacctgctatgtctcattcctcagtcttctcttgggccatgttaactgttcaacttgaggtaagaattgaggatctgaaagtttctggggtcacctaaagaaaatcattcttgccctcttttaagaggaaggagaaaagctcttgccaaatgatttttcttacacccaatactttcctgcgtccatgacttttctggttctgtacctcttcatcttctcatttccaaatccttctcaccacccttctaggcccagttcacatgatactctgtgaagtcatcttgggttctccttgatgagagagagctctctgttgacttccccggttttacctttt

SEQ ID NO: 115399 - DNA, 601 bp, Human
ctggggaaagcctgttgtccttgttattttctccacaaatgcaaatggaaatgtagtgtggaagaaagaaaggtatgtagggtttgatgctgaaagtccaggaaaggagctttattttgcaatatccctccacatctgttgagtattttccaggttacaaagtgttatcacagatattgccacattaatcctcacaataaaaccctgaggtcatctggaaaggtgttgagggaatgcaggctcagagagagcccatgtttattgcctgaggtgctgtaggactgaacccacctcttcatcmtttcttatatttctgatggattttttctcttggccatttcatcttttacttttaacatttgtgatatttacagtgggacagagagggaatcttgtccactggactttatttcctaagaaggccttgatctctccccggcatctcccttggacctcgtacctgggcagcagccacctcgtagccgtcggggttcatggatggcaggatgtgaatgcgcgtgtcctggatgagctggacgatgcgctggttcctgttccggaactcctcgcacagaaactccgacagctgcagcatcagctc

SEQ ID NO: 115400 - DNA, 601 bp, Human
ctgatgcacagccacagaagagaaccattgatttaaagttacgcatatcgatctgaaacacttaagatgttactaataataataagacaaatgttaggcacgctgacattttgaatttatgttagaaaataaagtaaaaagtcctgccaggcacggtggctcacgcctgtaatcccagcactttgggaggctgaggtgggtggatcacctgaggccaggagttcaagaccagcctggccaacctggcgaaatcccgtctctactaaaactacaaaaaattagctgggcatggtggcgcacrcctgtagacccagctactcgagggctgaggcaggagaattgcttgaacctgggaggcagaaatcgcagtgagccgagatcgcaccactgcactccagcctgggcaacaaagtaagactctatcccaaaaaaagaaagcccttagacattttttcttatcggtcccactgcaaatataactctaaaatatagaatcaatagactaagtgctatactagtagaggaaacaactctatggaaatataataaagtatgaagaatgtagaattagccccctacccccagttctggggaaagcctg

SEQ ID NO: 115401 - DNA, 601 bp, Human
gcaactcttgactgtcagcataaacagctatgggcattatccactgatttccctgcacactggtcaatagttaagttggcaggaaggggcttcccctaacagaaggtttcataaacagggctagtgttgtgtttcctattactgctgtaacaaattaccccaaatttagtggtttaaaacagcacgagtgtattgtctcatagttttggaggtcagaagactaaaacgggtctcacaggcctaaaagcaaggtgtctctccagtttctagagatcattcacattccttggctcttccatcttttttttttttttttttttttgagacagagttttgctcttgttgcccaggctggagtgcaatggcgtgatctcagctcaccgcaaccttcatctcccaggttcaagtgattctcctgcctcagcctcccgagtagctgggattacaggcatgtgttaccacgcctggctaattttgtatttttagtagagacagggtttctccatgttggtcaggctggtcttgaacttctgacctcaggtgatcctcctacttcagcctcccaaagtgctgggattacaggcctgagccacggcgccca

SEQ ID NO: 115402 - DNA, 601 bp, Human
cttgtcactgcttgcttatttatatcaaggcaactcttgactgtcagcataaacagctatgggcattatccactgatttccctgcacactggtcaatagttaagttggcaggaaggggcttcccctaacagaaggtttcataaacagggctagtgttgtgtttcctattactgctgtaacaaattaccccaaatttagtggtttaaaacagcacgagtgtattgtctcatagttttggaggtcagaagactaaaacgggtctcacaggcctaaaagcaaggtgtctctccagtttctagakatcattcacattccttggctcttccatcttttttttttttttttttttttgagacagagttttgctcttgttgcccaggctggagtgcaatggcgtgatctcagctcaccgcaaccttcatctcccaggttcaagtgattctcctgcctcagcctcccgagtagctgggattacaggcatgtgttaccacgcctggctaattttgtatttttagtagagacagggtttctccatgttggtcaggctggtcttgaacttctgacctcaggtgatcctcctacttcagcctcccaaagtgct

SEQ ID NO: 115403 - DNA, 601 bp, Human
tttatcacattttgtttatccattcaccagtattagtattagtttaatactattagtattaggaaactgtgttagtttcctagggctgccataacaatcaccacaaactaggtggtttataacaacagcaatttattctccaatttattctctggaggctagaagttgtaatcaagtcaactggatgggcggcacgctctctggtccccttctttgtttcttccaggttctggtggccagaggaagtccttggcattctttggctcttagacccatcactctaatttctgctttcatcttcatatggcctcctccccagtctgtctgcatctctattcgcaaatttctttcttcttacaaggacaccagttatgctggatttagagtccatcctgattctaggtgacctcatctcaattgtatccgtaaagaccctcagtaggccctccatatccatgggttccacatgtgtggattcaaccaacctctgattgaaaatgtagttaggcctatgatggttgcatctgtactgaatatgtacatacttttttcttgtcattattccttaaacagtacattataacaactgtttacatagcat

SEQ ID NO: 115404 - DNA, 601 bp, Human
aacaaggccagcttttcactgttcctcttcctcaaggatattccatcaggagcgagggaaacctctttgcttttccccctaaaatttagacagaggattgagtgggagcctagttatcattgattcaattaccttattttacttagagaaacaagtttattacatcagaacattcttctggttggatatcctgactaacacgaagttctttgctttttggttttggttttggtttttttgtgagatggagtcttgatctgtcgcccagactagagtgcagtgatgccatctgcaacctccrccatctgggttcaagcaattctcctgcttcagcctcccaagtagctgggattataggcgcccaccaccacagctggctaatttttgtatttttagtaggatggggtttcaccatgttagccaggctggtctcgaactcctgacctcagctgatctgcccgcttctgcctcccaaagtgctgggattacaggtgtgagccactgcgcccagccttacaaagttattttttatttactatttacttgaaccaagaggatagttgctgtttgaaatctaacatgtcagcatggcttttgcttc

SEQ ID NO: 115405 - DNA, 601 bp, Human
tactatacagtggacaaagtgagatcaatggagaaaaaaacaatgtgctattcaccatgtagttcattaatgattaatacttaatatcattaatgtttatttaaattatatagatatattatatattaatatattagtatataattttttttttgagacggagtttcactcttgtcacccaggctggagtgcagtggcacaatcttggctcactgcaacctccgcctcccagcttcaagtgattctcctgtctcagcctcccaagtagctgggattacaggcacccaccgccgtgcctggytaatttttttatttttagtacagacagtgtttcgccatgttgggcaggctggtctcaaactcctgacctcaggcaattcgtctgcctcggcctcccaaagtgctgggattacaggcgtgagccaccgcaccaggccaataattacaaatttattatattatgccattttatatattaatataaaattaatgttaacatatcgttttgaactgttatttaaacctttttcatgtagtctatttttctttttttctttaaggccccacctaatactatcacagtctatttttcattaatatg

SEQ ID NO: 115406 - DNA, 601 bp, Human
tcattactatttactatacagtggacaaagtgagatcaatggagaaaaaaacaatgtgctattcaccatgtagttcattaatgattaatacttaatatcattaatgtttatttaaattatatagatatattatatattaatatattagtatataattttttttttgagacggagtttcactcttgtcacccaggctggagtgcagtggcacaatcttggctcactgcaacctccgcctcccagcttcaagtgattctcctgtctcagcctcccaagtagctgggattacaggcacccaccrccgtgcctggctaatttttttatttttagtacagacagtgtttcgccatgttgggcaggctggtctcaaactcctgacctcaggcaattcgtctgcctcggcctcccaaagtgctgggattacaggcgtgagccaccgcaccaggccaataattacaaatttattatattatgccattttatatattaatataaaattaatgttaacatatcgttttgaactgttatttaaacctttttcatgtagtctatttttctttttttctttaaggccccacctaatactatcacagtctatttt

SEQ ID NO: 115407 - DNA, 601 bp, Human
gtaggtgggtatgtgtgaatgcatgtgtgtgaatgtgactgtgtgtctaagagagtgtatgtgtggtagactagagttaggagatctgtattctgattttgtcactatcttggggctgagttttctcttgtgcaaagtgaggagttgcactagatgatattgaaggtcccttgtttttgtgccattttctagccgaattttgtcaaagaaatcaaggagtaagtaaggcaagacttctccagtaaaagtaatgcatatttagggggtgagagtcgtgcgttgcagggagaggaatatattygaactctataattctccttcattactatttactatacagtggacaaagtgagatcaatggagaaaaaaacaatgtgctattcaccatgtagttcattaatgattaatacttaatatcattaatgtttatttaaattatatagatatattatatattaatatattagtatataattttttttttgagacggagtttcactcttgtcacccaggctggagtgcagtggcacaatcttggctcactgcaacctccgcctcccagcttcaagtgattctcctgtctcagcctcccaagtagctg

SEQ ID NO: 115408 - DNA, 601 bp, Human
ttccagatctcaacttgagtgcaaaattctatgctattcccattgtttccctgagaaaactgggaatttagaaggagaaatgagcactattccacttcagcttgagcagttcccaggactccccttacccttgctgagagaataccaggaagccccattggtgatgccatctgggaagtaatctccgcagttccaaccttggaacatccatccatgtgcataggagtagaccttggccagctagaggaaaagcaggaggaaaacgaccttgatgattcccaactcaaatggcaatgctccyactcacaactaggttgaagccaagaagccctgctgggtatataaacagtggattatttgctttagtgaaagaaaataggatcagggatagaaacagcgtgtgtatgtgtgtgtgtatgtgtgtatatgtaggtgggtatgtgtgaatgcatgtgtgtgaatgtgactgtgtgtctaagagagtgtatgtgtggtagactagagttaggagatctgtattctgattttgtcactatcttggggctgagttttctcttgtgcaaagtgaggagttgcactagatgatattgaaggtcccttg

SEQ ID NO: 115409 - DNA, 601 bp, Human
caccttagttttaaagaatcacaatatgatcactaaatgccaacctgagacttcctcattttccagatctcaacttgagtgcaaaattctatgctattcccattgtttccctgagaaaactgggaatttagaaggagaaatgagcactattccacttcagcttgagcagttcccaggactccccttacccttgctgagagaataccaggaagccccattggtgatgccatctgggaagtaatctccgcagttccaaccttggaacatccatccatgtgcataggagtagaccttggccagmtagaggaaaagcaggaggaaaacgaccttgatgattcccaactcaaatggcaatgctcccactcacaactaggttgaagccaagaagccctgctgggtatataaacagtggattatttgctttagtgaaagaaaataggatcagggatagaaacagcgtgtgtatgtgtgtgtgtatgtgtgtatatgtaggtgggtatgtgtgaatgcatgtgtgtgaatgtgactgtgtgtctaagagagtgtatgtgtggtagactagagttaggagatctgtattctgattttgtcactatcttgg

SEQ ID NO: 115410 - DNA, 601 bp, Human
ttataggcatcagtcaccatgcctggccttattattcttaattacagatgaggaaaccaaagcacagagagaataagtaattatccatcccagagccacatgactagtaaatgggcatgagagtttcaacccaatctactctcagataccacaaatgactacattattttcctcctatgccctaatctattgtgtaaaccaccagttttacaggaccaaaaggtgtccctactttagttattttttgtttttgtttttgttttttcgagacggagtctcactctgtcacccaggctggagkgcagtgatgcgatcatggctcactgcaaactctgcctcccgggttcatgccattctcctgactcagcctcccgagtagctgggactacaggcgcccgccaccacacccggctaattttttcatatttttagtagagacggggtttcactgtgttagccaggatggtctcgatctcctgacctcgtgatccaccctcctcggcctcccaaagtgctgggataacaggcgtgagccactgtgcccagccatccccaccttagttttaaagaatcacaatatgatcactaaatgccaacctga

SEQ ID NO: 115411 - DNA, 601 bp, Human
gtgtgaggcatactactgtgctactttttaaaatacagttacaccatttataagccaggcatttccaaatgccttatgtgtattattttatttaatactcatattaaaattacgaggcaagtattctttctttttttttttttttggagtctcactccgttgtccaggctggagtgcagtggtgcaatcttggctcactgcactgcagccttgacttcctgggctcaggtgatcctcccacctcagcctccccattagctgggactacaggtgtgcaccaccatgcccacctaatttttctttttttttttttggtagggatgaggtcttgctatgatgcccaggctggtctcaaacaactggcctcaagagattctcccttctcggcctcccaaggtgctgggattataggcatcagtcaccatgcctggccttattattcttaattacagatgaggaaaccaaagcacagagagaataagtaattatccatcccagagccacatgactagtaaatgggcatgagagtttcaacccaatctactctcagataccacaaatgactacattattttcctcctatgccctaatctattgtgta

SEQ ID NO: 115412 - DNA, 601 bp, Human
accagcttaatttagggcaatgattctcagtggaggcatgggccttgctctctcagaggatggagagggagagggaggagagagagaaaaaaagaacaagcataatttgaaaaagtatattggttattttcaatttggagggcaaaaaatattttgctttcctaatgcaaactaaagaaagtaactttaaaaaaacatttaaaattacggatgtatttatttatttatttttcagagacagggtctcgctctgctgcccaggctggagtgcagtgtcatgatcatagctcactgtagcctygaactcccaccttaagccatcctcccacctcagcctctcaaagcgctgagattacaggtatgagccactgcgcccagccgtgccttgtattcaagcgagtttttgtccccagtctaccctcccagtacatggcaactcctcagttttgcacctctctactctccacaggaccagccaccaactcagttctcaccaatctgctgcctgggccatggccaggtcagatttgaaggatggggaaagacaggtgctagagaatgattcctaaaagaactcagcttcttgctccagactcttctc

SEQ ID NO: 115413 - DNA, 601 bp, Human
gacaagaatgccaagaccattcaatggggaaaggacagtcatgtcaacaaatggtgctggagaaactggatatccaaatgcaaaagaatgaagctggagccttacctaacaccatatacaaaaattaactcaagatggattggcaacctaaacgtaagacccaaaactataaaactcttagaagaatatatagggcaaaagcttcatgacattggatttggcaatgatttcctggatataaaatcaaagacacaggcaacaaaagaaaaaaaataacagattagacttcatgaaaatggamaaattttgttcatcaaaagacagtatctctaggacagaataggtgacgacagaatcaaactgaccaacaaacaaacaaatacaatgtcaacagagtaaaaaggcaaccatggaatgggaaaaatatttgtgatacatatatctgataagatattaatattcagcatacacagagaactcctaaaacataacaataacaacaacaacaacaacaaaacccaaacaacttgattttttaaatgggcaaaggacttgaatagacatttctccaaagaaggtatataaatagccaataagcaca

SEQ ID NO: 115414 - DNA, 601 bp, Human
ttgtgcatgatcaagctgggctgagtcagcttacaacaccattctgctgtgagataattctgtacccttctaggaggttccaggtagctctaagatccgcctccaccatcaatcttgcccccacagtaagcctatgatggaaagaatcttgctaactttcccaatggaggtgtagggaaatgccaagtcagcgacaaggctaactatctgtttcacagtcctctttctacccgatttcacaccagtatgtgagctattaacaggcttaagcccagaaaatacccctaacaaaattgtatgyggtagcaactcctgaatgctgatgagaagttacatttacatcagtctttcctggtcctgacctctcagggattgcttgcatcagaagcaaaagattttccattaaaacatcttggttgtttgattcagcctcttaatttactgtctccattttcattgcccttctttcctccatcccccccactcccagcatccttgacacccctgctggtttcactagcttacaaactggccccttgattatgctgaagaagatgcaggagttaacgcttccttcttacccctaagcagtgaccaccta

SEQ ID NO: 115415 - DNA, 601 bp, Human
atttttgtagttttagtagagacaggggtttcaccatgttggccaggccggtcttgagctcctgacctcaagtgttcctctcacctgagcctcccaaactgttgagattacaagcatgagccactgtgcccagcaatatatgttgattggctggaatgttttacagacattcccacacttgcttggatagagcataaaatctagcaaaagccaggtgtgcattcctggaatcccagcactttgggaggctgaggcaggcagatgacttgagctcaggagttcgagaccagcctggacaacagggcaaaactctgtctctgtaaaaaaataaaaataaaaaataaaaaaattagctgagcatggtggtatgcacttgtagttccagctacttgggaggctgaggagggaggctcacctgagcctggaaggtcaaggctgcagtgagccctgactgcaccactgcactgcagcccaggcaatagagtgagaccctgtaatccagctatttgggaggctgaggcagaagaattgcttgagtttgagaccagcttgggcaacatagtgagaccccatcaccttgctagaaagaatctagcaagcc

SEQ ID NO: 115416 - DNA, 601 bp, Human
tattttagtagagatggggtttcaccatgttgcctaggctggttgcgaattcctgagctcaggcaatccccccacctcggcctcccaaagtgctgggattacaggtgtgagccaccgctcctggccacacccagctaatttttgtagttttagtagagacaggggtttcaccatgttggccaggccggtcttgagctcctgacctcaagtgttcctctcacctgagcctcccaaactgttgagattacaagcatgagccactgtgcccagcaatatatgttgattggctggaatgttttasagacattcccacacttgcttggatagagcataaaatctagcaaaagccaggtgtgcattcctggaatcccagcactttgggaggctgaggcaggcagatgacttgagctcaggagttcgagaccagcctggacaacagggcaaaactctgtctctgtaaaaaaataaaaataaaaaataaaaaaattagctgagcatggtggtatgcacttgtagttccagctacttgggaggctgaggagggaggctcacctgagcctggaaggtcaaggctgcagtgagccctgactgcaccactgca

SEQ ID NO: 115417 - DNA, 601 bp, Human
gacaaacaataatgaagaagtctttttctgccccctattaaatgtctgtaatttactttaaaatacttcagcaaagtacatgtgttggatagttgaaatgacaccccaggggttgtcattttcttaactggggacttgaatcctgaagtggttagcgagtgttgtatcagaaaggccgcattccagatgcagctactatgagggcttcagctagctttctctctcatcaacactagatgctttgctaagtaatataatgaatgtttacaatgggttttttccctgatgaaatgaaaaaaawtttttttttttttgagatggagtcttgctctgtcgcccaggctggagtacagtggctcaatcctggctcactgcaacctccacctcctgggttcaagcgattctcctgcctcagcctcctgagtatctgggactacaggtgcctgccaccatgcctggctaattttttgtatttttagtagagacggggttttaccacgtaggccaggctggtcttgaactcctgaccttaggtgatccacccgccttggcctcccaaagcgctgggattacaggcatgagctactgtgcccagcctaat

SEQ ID NO: 115418 - DNA, 601 bp, Human
aaggaaagtgcattttggctaatgactttccatccctttagactcaattatgacagtgattttaaaattcattttaagtatatagcaatgaatatttgaaataataaatacaataaacattgagacaaacaataatgaagaagtctttttctgccccctattaaatgtctgtaatttactttaaaatacttcagcaaagtacatgtgttggatagttgaaatgacaccccaggggttgtcattttcttaactggggacttgaatcctgaagtggttagcgagtgttgtatcagaaaggccscattccagatgcagctactatgagggcttcagctagctttctctctcatcaacactagatgctttgctaagtaatataatgaatgtttacaatgggttttttccctgatgaaatgaaaaaaaatttttttttttttgagatggagtcttgctctgtcgcccaggctggagtacagtggctcaatcctggctcactgcaacctccacctcctgggttcaagcgattctcctgcctcagcctcctgagtatctgggactacaggtgcctgccaccatgcctggctaattttttgtattttta

SEQ ID NO: 115419 - DNA, 601 bp, Human
atattttatttcattttatttttattttgagataaggtcttactctgtcatccaggctggagtgcagtggtgcaatcacggttcactgcaggctccatctcctgggttcaagtgatcctcccacctcagcctcccaagtagctggcactacatgtgcatgacaccatgcccggctaatttttgaactgttttgtagagatatgatttcgccatgttgcccaggctggtctcaaacccctgggctcaagtgatctgccagcctcagccttccaaagtgctgagattacaggtatgagtcacygcacccagctgagacattttaaagctggaaactctgtagtaaacaatctttttttttttttttgagatggagtcttgctctgtcacccaggctggagtgcagcggcacaatctcggctcactgcaacctccgccccctgggttcaagcaattctcttgcctcagcctcccaagtagctgggattacaggcatgagctaccacacttggctaatttttgtattttgagtagagacagggcttcgccatgttggccaggctggtctcgaattcctgacctcaagtgatccgcctgcctcagc

SEQ ID NO: 115420 - DNA, 601 bp, Human
cctgaagccagctgggagttaaaaaacatgtcactgactaagaggcctctctgtagggttatttcctgccccttccgcaaaaattgatagccagtttttctgctagttcctccaggagggaaggggagaatcagagccaactgtgctgtattatttaccaattcctatttagtaacataggaatctagacagaaaaaaatgagagagaagagagacaagaaaatgaggcaaggacagaggaaaaggaaaggagtggtgacatgtggaaggccttggggaaaagcaaagaaaacactgggcyccggaagatattttatttcattttatttttattttgagataaggtcttactctgtcatccaggctggagtgcagtggtgcaatcacggttcactgcaggctccatctcctgggttcaagtgatcctcccacctcagcctcccaagtagctggcactacatgtgcatgacaccatgcccggctaatttttgaactgttttgtagagatatgatttcgccatgttgcccaggctggtctcaaacccctgggctcaagtgatctgccagcctcagccttccaaagtgctgagattacaggtat

SEQ ID NO: 115421 - DNA, 601 bp, Human; identical to SEQ ID NO: 20214

SEQ ID NO: 115422 - DNA, 601 bp, Human; identical to SEQ ID NO: 20215

SEQ ID NO: 115423 - DNA, 601 bp, Human; identical to SEQ ID NO: 20216

SEQ ID NO: 115424 - DNA, 601 bp, Human; identical to SEQ ID NO: 20217

SEQ ID NO: 115425 - DNA, 601 bp, Human; identical to SEQ ID NO: 20218

SEQ ID NO: 115426 - DNA, 601 bp, Human; identical to SEQ ID NO: 20219

SEQ ID NO: 115427 - DNA, 601 bp, Human
cagttggttcttgaacatcactttcaatcttaagatcctttacaccttcttcagcttcatcaatatcaaatatctttttagttttttttttctttttcttttgattaaagaagttcaagtcatctagatcaccagcagcatcttttttcctagtgtcctcttcatcagcttccaaatctttgtcctcagttggctctggccccacttcttttgtttctgaaggctgggttatctctgtttgggtatccgcttcctcatctaacataaaaggcttctttttcttctttttctttttgctcayagtaggatcaaaaatcatctcgtccccagacatggctgcggcttgagtgggcttggcacggacgggaagtcagacgggtcaaccccagaccccggctgcagcgctgctcctgccggtacctctcccaccaccgcactggtgctttgttgttgttgttgtttttctttctttctattgtctgtcttttctcttggttttggatcaagggctatctccttgtatatcagggtttttttttttgtttttttttttttatatggagtcttgctctgtcgcccaggctggagtgcaatggcagga

SEQ ID NO: 115428 - DNA, 601 bp, Human
aatgtcaaggtcattctctggttcagttggttcttgaacatcactttcaatcttaagatcctttacaccttcttcagcttcatcaatatcaaatatctttttagttttttttttctttttcttttgattaaagaagttcaagtcatctagatcaccagcagcatcttttttcctagtgtcctcttcatcagcttccaaatctttgtcctcagttggctctggccccacttcttttgtttctgaaggctgggttatctctgtttgggtatccgcttcctcatctaacataaaaggcttcttyttcttctttttctttttgctcacagtaggatcaaaaatcatctcgtccccagacatggctgcggcttgagtgggcttggcacggacgggaagtcagacgggtcaaccccagaccccggctgcagcgctgctcctgccggtacctctcccaccaccgcactggtgctttgttgttgttgttgtttttctttctttctattgtctgtcttttctcttggttttggatcaagggctatctccttgtatatcagggtttttttttttgtttttttttttttatatggagtcttgctctgtcgcc

SEQ ID NO: 115429 - DNA, 601 bp, Human
ccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggtaaggcggccgggcgagggtgggggcgaggaagcgccacccggcaggtggcagcgcccgggaggccgagggggcgaagggggcaggcggtagacggctgtggcaaaagcgatggaaaagcagctgtckggcacgcgcggggacgggaggcgcgcggccggggctgaccgcaccgtgactcagattggttttcctgcaccttgcaggcgtcggggcgcgcgggccggcggtagacctcgcggcgagggcagccgtggaccgcgcgtgttacccggggtggggctcccttagcgggagggacggggaaaggggcgtcgaggcgcccctggccggcccccgtggggcagggatcgcagccgggcccgggtggctacggggctggacctggttcaacaggcttgtgcagtgaaagagcctgaccctttccgt

SEQ ID NO: 115430 - DNA, 601 bp, Human
tcatttttgatgtcctaatctggatatactctccaaagttatctgataattgctgaattgttcacttgtcattgtatatacggtttataataaatactttgaaacaatgagtggagaaatttaaagcaaagtggattttaaaatttattgatcattactttttcattaaaaagaaagtgtcccaaagaatattttgaaatagaaaataaaattcccataacttcattactgtaatgtgatttaaatatttgcagatccactctcaatttctgaccgtgtgcatctatttgttgagactataaggcttgcaactatataacaaatagatgttgtaatatttctatgtagtatttatatgcattttagacaagtataggattaaaaattcactagcttatatacttaatagttcttggtcaaaggcttgactctagtttaccagagaccttaaaaatagtggtttctatgtaatatggggatatttcccagaaatttgccccagattttaagtaaattgtagctaattgtctaccttctcagttggcagcattcttccagatccacattttttttctttgccatgattttgtaacttgttaaa

SEQ ID NO: 115431 - DNA, 601 bp, Human; identical to SEQ ID NO: 115429

SEQ ID NO: 115432 - DNA, 601 bp, Human; identical to SEQ ID NO: 115430

SEQ ID NO: 115433 - DNA, 601 bp, Human
cttgatccagtccatcattgttggacatttgggttagttgcaagtctttgctattgtgaatactgctgcaataaatatacctgtgcatgtgtctttacagcagcatgatttataaaccttttggtttatacccagtaatggtattgctgggtcaaatggtatttctagttctagatccctgaggaatcaccacactgacttccacaatggttgaactagtttacagtcccaccaacagtgtaaaactgttcctaattctccacatcctctccagcacctgttgtttcctgactttttaatsattgccattctaactggtgtgagatggtatctcattgtggttttgatttgcatttctctgatggtaagtgatgatgagcattttttcatgtgtctgttggctgcataaatgtcttcttttgagaagtgtctgttcatatactttgcccactttttgatggagttgtttgtttttttcttgtaaatttgtttgagttcattgtagattctggatattagccctttgtcagatgagtaggttgcaaaacttttctcccattctgtaggttgcctgttcactctgactgcagtttcttttgct

SEQ ID NO: 115434 - DNA, 601 bp, Human
tgactttttaatcattgccattctaactggtgtgagatggtatctcattgtggttttgatttgcatttctctgatggtaagtgatgatgagcattttttcatgtgtctgttggctgcataaatgtcttcttttgagaagtgtctgttcatatactttgcccactttttgatggagttgtttgtttttttcttgtaaatttgtttgagttcattgtagattctggatattagccctttgtcagatgagtaggttgcaaaacttttctcccattctgtaggttgcctgttcactctgactgcrgtttcttttgctgtgcagaggctctttagtttaattagatcccatttgtcaattttggcttttgttgccattgcttttggtgttttagacatgaagtccttgcccatgcctatgtcctgaatggcaatgcctaggttttcttctagggtttttatggttttaggtctaacacgtaagtctttaatccatcttgaattaatttttgtataaggtgtaaggaagggatccagtttcagctttctacatatggctagccagttttcccagcaccatttattaaatagggaatcctttccccca

SEQ ID NO: 115435 - DNA, 601 bp, Human
gctgctgcctgattgttcctctggaagttttgtctcagaggagtacccagccgtgtgaggtgtcagtccacccctactggggggtgcctcccagttaggctactcgggggtcagggacccacttgaggtggcagtctgcccattctcagatctcaagctgcatgctgggagaaccattactctcttcaaagctgtcagacagggacatttaagtctgcagaggttactgctgccttttatttgtctgtgccctgcccccagaggtggagcctacagaggcaggcaggcctccttgagctgyggtgggctccacccagttcgagcttcccagctgctttgtttacctagtcaagtctgagcaatggcaggcgcccctcccccagccttgctgccgccttgcagtttgatctcagactgctgtgctagcaaagagcagggctccatgggcgtaggaccctctgagccaagtgcaggatataatctcctggtgtgccatttcataagcccgttggaaaagcgcagtattagggtgggagtgacctgattttccaggtgccgtctgtcacccctttctttgactaggaaagggaattccctgacc

SEQ ID NO: 115436 - DNA, 601 bp, Human
aaaacttccttatgacttcaaagcccctctcaccttctgtttggtcttttccatttgagaaagaagttcacaagtggctgttaatgaattattttcattactaatatgccactcaaaagggctgaggcttctatttgggcaacttttactttgtatcattgcagatgttgttactcttgactcaagaaacactaattactagtaatgaatacagaaaggacatctatcaatgtagttatagagaccagagaggaatcttagaagtagtctgactcaaagagtgaataggcagaatagccaccctgatatggaatcactttatacaaatcctgtcacctcaatttggacattgagagctttggcactaagaaccaagcagagttttgtgtatggtcctcataattccttttttacccaaagaaacaaaccaatattagctatgactttggtaaggttagtgaatccatagctcaagagcatttccaccctacccaaatggattttgatgctaacaaatccttttgggcagggaaggacatttatctttaatgcttatatccattttttctaacaaatccacaaaccaagattaaacagtaaa

SEQ ID NO: 115437 - DNA, 601 bp, Human
gctctctggtttagactctattttccataccacccttatctcaggtactgctaatccaagagctaatgtgtatgaaagggcacatgaagtggcctaaggaagatgggtttaaatccatctctctccctcactctgcatatagaccaggggtcaacaaactacccctgtagtttggctcaggggccaaatccagcctactccctattgctatgaatattgtccgtggctgctttttcactacagaagcagatcaaatgaggcccataaagctgtaaatatttactatctggtcctttacagaaaaaattacggcaatccctgatcaaacctagatgtaagtccctctctttgtggagcagatctctgtgagaacagaagacacagggcagcacccttactctgcatgattttaatacacagcagtggtcgtgatccttaaaacatctacagtagagaacacaagcatccaaaacagggtcttagcatgacaatacagtgactgcaaatcctagctttactatacctttgcgagccctacactacccactggtagagaaacttcacaaaaattataaacataaaatgaattcaagatcaccaa

SEQ ID NO: 115438 - DNA, 601 bp, Human
aaaaaattttcaatactcagaatcacatttaggtcaagctttctaggtccgatttctttctataagataaaaatgcctaattatttactactaactcatgcaagttcctgagaaaatagcaaaataactggctgctcaacattcactattagagcttcaatgtgcctttggaggtcatacattagcttcagtttcttcatcactttcattatcagaaatgaaatgagaattgtgtcagatggtatttatggttcttttcaactctagatggatacacacatctagggaataataactcctcccccccaccattttccagaaagaaggaattctaccttcttcatcaagtccaccgatgatgttgtaaacatagtatggaaagaagcgccttgaatacaggattgtagacagcattgcagcaattgcccccgtagtcatggccttattattggaatgcttatacatctgcaattattgataaaagtcacaggcatgtagaggcagaggccattatagactagaacaatcaacagtataaagtgaataaataaatgcataccacagtggaaggggaaagcatgcctatttccttcatgatcaa

SEQ ID NO: 115439 - DNA, 601 bp, Human
ctgaattagaggcaagaaaagaagggaattaattcatgtgcttctatcttatttgagtttgttacaaagaacacaggtgattctacaatcgttaaaaaggcctgttaaaaacaaccgtgttctgggtatgagaaatcacgagtcatttacaaggtatgattttttaaaaacataactgatttagaaaacacattatataccagaactcagtaccctgggagatgtgatatagggacaatctccttactaaccatgtacaactgccactgttagctttgtatgttttctactatagaactgygtaaacttggccaggcgcggtggctcacgcctgtaatcccagcactctgggaggctgaggtgggccgatcacgaggtcaggagttcgagatcagcctggccaacacagtgaaaccccatctctactaaaaatacaaaaattagctgagcatggtggcacgtgcctctattcccaactacttgggaggctgaggcaggagaatcgcttgaacccaggaggcggaggttgtggtgagccgagatcatgccactgcactccagcctgggcaacagagcgagacttggtctcaaaaaaagaaaa

SEQ ID NO: 115440 - DNA, 601 bp, Human
tgctctgctatacttcaaaaaaactcttcagaaagtttaactgaactcactgtaggacacactttgtggatttattgtgtgttttgaagtcacactgtgagctatatagaattaaccaaaacacaactcttcttgaaaatgagagttcaagttggcagaaagtgcggggtaaagacatggatatgggcctaaagcatctatttctttgtgatcttttgatatatctctcaagtgctttttagtggattagctttagaatgcatcagccaactcctgctcaataatccatttttccagcccrgaatgtcttaaattgaggaaggacaaagtcccagaggtggggagcagggggactttggccgaggactttgcatgaatcgatgagcatgcatccacctccctgtcctgccccttgtgctctgtgtaccctcaggaggtcaggacaggcctttctgagaatgaaaatctgttcatttgctttcctactggatacttgtcatcagcatacaaaccaatgcgctctgcagtgtgtcatctttcagaacctcccctgaccgcatgttccctggagggctcgctgtcttcagagccaggcttgtct

SEQ ID NO: 115441 - DNA, 601 bp, Human
aggacaaagtcccagaggtggggagcagggggactttggccgaggactttgcatgaatcgatgagcatgcatccacctccctgtcctgccccttgtgctctgtgtaccctcaggaggtcaggacaggcctttctgagaatgaaaatctgttcatttgctttcctactggatacttgtcatcagcatacaaaccaatgcgctctgcagtgtgtcatctttcagaacctcccctgaccgcatgttccctggagggctcgctgtcttcagagccaggcttgtctcctgctgcagcctccactgytctcctagtcactctgtaacccaccccctctgcctgcggcccccaccacgcccctcaaagtggtcaaggttgtcctgttgtctaattccatggagcttgcctgtcttcattttattagcctcttttggcctctcacccttgtgcaaatcactagcattctgtgccaaggacggagctggcatctccaggcttggaatagagctaccaaagctcagccagatgtctggaagagcctcaggacaaggggacaccctgtagccttgtggtgggagcacagctgaggcccccttggccaccctc

SEQ ID NO: 115442 - DNA, 601 bp, Human
tgtaccccagtcattttcacaagattaattgtatctgtcagaaaattgcataaacaaactgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatrtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccct

SEQ ID NO: 115443 - DNA, 601 bp, Human
ctgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccctttttctctggaggataatttgaatcatgggaaacttatttaagtttgtgtgatggttt

SEQ ID NO: 115444 - DNA, 601 bp, Human
tcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaaytaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggct

SEQ ID NO: 115445 - DNA, 601 bp, Human
tcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctga

SEQ ID NO: 115446 - DNA, 601 bp, Human
acaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcaygtggcacctatctatacttctgagaaccatgaagactctctaattatcttcatattttatatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatct

SEQ ID NO: 115447 - DNA, 601 bp, Human
taagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcacgtggcacctatctatacttctgagaaccatgaagactctctaattatcttcatattttmtatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaat

SEQ ID NO: 115448 - DNA, 601 bp, Human
cactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcacgtggcacctatctatacttctgagaaccatgaagactctctaattatcttcatattttatatcctcaccttgtttctttggtcccaaacatttatagcttccttccccattcttcttaattgctgcttcattgtgctatgcatagaagtggtrcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaa

SEQ ID NO: 115449 - DNA, 601 bp, Human
ctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgarcagaaatttttcttaaaaccatcaaatgaacagtgaaattggcttggtcattaggaatatgaaacagaccaggcatggtggctcacacctgtaatcccaacactttgggaggcagaggcaggaggatcacatgaggccgggatttcaagaccagcctgcacagcacagtgagaccccagtctctacaaaaaaaaaaaaaaaaaaaaaaaaaaatagccaggcagggtggcatgtgcctgtagtcccaactactcaagaagctgaggtgggaggatagcttgagcccaaaaggttgaggct

SEQ ID NO: 115450 - DNA, 601 bp, Human
aactactcaagaagctgaggtgggaggatagcttgagcccaaaaggttgaggctgcagtgagctgaggtcacgccactgcactacagtctgggcaacagggggagaccctgtctctacaaaaaaaaaaaaaaaaaggatatgaaacattcaccacagatagtagttcaggttcatgcaacagaaagcaagagagagctatacccttgcacagtgataggatgctttattacatgccacactagtgttatacatccagagtcttagtcaagctgaagctagaccagcaccaaatttcataarcactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacgcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagct

SEQ ID NO: 115451 - DNA, 601 bp, Human
ccacagatagtagttcaggttcatgcaacagaaagcaagagagagctatacccttgcacagtgataggatgctttattacatgccacactagtgttatacatccagagtcttagtcaagctgaagctagaccagcaccaaatttcataaacactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacrcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagctcagatgtgaaacttaggtttcttatatttgatgattattgagaaatatttattctaagaaaatgatgttgatatggaaatttttatttagttgcagaggtccacaggaaatgtagtaagtaaaatttctgaagttcattttcttaaacaga

SEQ ID NO: 115452 - DNA, 601 bp, Human
cactttcaaaacctagttacctaaaataacaactcatttatttagctccacaaatctgtgggttgacagctgggcctgtgcttacctggacagttcctctggccttagagtgttgagagattaagtaatttgcccaaggtcatattgaaagctaagattcaaactcaaaatttggcctcaaagttcttagccctagccattttgctatactcccttttattactacaacatcttagcttcctctctaaaggaggagaaatagccaaagtggttttataaacactggtctgtcgactggtaycagtctatgacataagagttttcatcagtcagtatcaaaatgtaaaaaggcaggggcaagaaagtaaatttccataaaactaaatgtattcagttttaaatcttgcccttcctactttgagggagttcagttttctttctttatgaataatgttggtaatagtggattttttaaaaatgttcttatctagcagaattaaagtttgccagctctgtgtttatccctaaaatcttttgggcaagtttcaatgttctgtgaaatcccaaagtctgggattcactgatcaaccatattttttca

SEQ ID NO: 115453 - DNA, 601 bp, Human
acataaacaatgttaccatcatcttatcccagcagctattactttgccccattgaatcttttgtttttaactatatcatttagagtgtttgtgctgaaaggaaaattttaaaaaatcatattttctggttttcagtttccagtagtgaaactcttttcaaatgagatcttatctgaatcagaatgaaatgaacccacaaaaattaaaaattaaaaatgtttttaagaaagaatgaaatgagattaaacaaactcccatttgtccctatccacattttatttggtggctcatgatgtcacgyaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccaacacaacatggtgaaaccccgcctct

SEQ ID NO: 115454 - DNA, 601 bp, Human
tttatttggtggctcatgatgtcacgtaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccmacacaacatggtgaaaccccgcctctactaaaaacacaaaaaattagccaagcctgatggcgggcacctgtaatcccagctacttgagaggctgaggcaggacaattgcttgaacctgggaggcagaggttgcagtaacccaagatcacgccactgcactccagcctgggcgacagagtgagactccatctcaaaaaaaaaaaaaaaaaaaagttgtcagttaagctgtctgttatttagtcctcttggaaacatataggtcaagagtcaatatcccaaatgcacagaaggaggggtttt

SEQ ID NO: 115455 - DNA, 601 bp, Human
atatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctrtttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttat

SEQ ID NO: 115456 - DNA, 601 bp, Human
ggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagacyttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccg

SEQ ID NO: 115457 - DNA, 601 bp, Human
ttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcrcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaacaaagccctgtttcaaaaaacaaaaataaaacatgtcttt

SEQ ID NO: 115458 - DNA, 601 bp, Human
gccatatttgagcttcaaggcactgtttactctgactccttcagtcaaaaggagcataaacccatttcacctagttcaggttaaggaattttttttttgtaaggaagatattataacagtggttaagacactgggtcaaaatatgtggggttttttgtttgtttgttttggttttttttgaggtggtgtctcgctctgttgcttaggctggagtgcagtggcgcaatcccgactcgctgcaagctccgcctcccgggttcacgctattctccttcctcagcctcccgagtagctgggactrcaggtgcccaccaccacgcctggctaattttttgtattttttagtagagacgaggtttcaccatgttagccaggatggtctcaatctcctgcctcctgatctgcccgcctaggcctcccaaagtgctgggattacaggtgtgaaccactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggcctt

SEQ ID NO: 115459 - DNA, 601 bp, Human
cactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggccttgatggctcctctctcattaatgggattaaggcccttataaaagaggcttcatgcagcatttggctagcttgctcttccactctggcttacccttccaccctcacaagacaccaaatgccaacagcttgatcttgaacttcaaagckgccataattgtgagacaataaatttctgttctttatgtattacccagtctcaagtattctgttgtagcagcacagactatgagagagactatggaaaagttaattctcttttttgtttgtttgttttttgttttttgtgtttcttttttagatggagtcttgctctgtcaccaggctggagtgcagtggcatgatctcggctcactgcaacctctgcctctcgggttcaagcgattaccctgcctcagcctcccaagtagctggcgactacaggtgtgcgccaccacgcccggctaattt

SEQ ID NO: 115460 - DNA, 601 bp, Human
caacagcatggctttttttcctgcttataatgtctatctctgcaaaatgttattcattcaacacccagctcatgtcaccttctccaagatgcatttctaaatgtcccccaattgaggtgttatgttatttttaaagtgcatacgtggctttctctcctaaagctataaaaccctcaaggacaaacactgtgttttatccatctttgactcctttggtgcacccaaagcccagtacctagacattcaatagctgttggttgatggaatgaatccaggtacttctgacagattccagattttyactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcattggtataggaggtaagtttaacaggccagtttaagacagcatataaatcatcactaaaggacagatagctaagaaagatggaaaat

SEQ ID NO: 115461 - DNA, 601 bp, Human
ggtgcacccaaagcccagtacctagacattcaatagctgttggttgatggaatgaatccaggtacttctgacagattccagattttcactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcaytggtataggaggtaagtttaacaggccagtttaagacagcatataaatcatcactaaaggacagatagctaagaaagatggaaaataaacaaataattgaaaaaccagattgacccagaaatgactaagaacaaagtttgtgcagggagacagggagaattgagtttagtactgttagttgctgtaaaatatatcaggtttgctttaattacatggtaatgcttctaagaacaaaggtaattacatgataacttatgttactactcccatattatctctaaataactatgtaattagctt

SEQ ID NO: 115462 - DNA, 601 bp, Human
agggagacagggagaattgagtttagtactgttagttgctgtaaaatatatcaggtttgctttaattacatggtaatgcttctaagaacaaaggtaattacatgataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcacgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatg

SEQ ID NO: 115463 - DNA, 601 bp, Human
ataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcatgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatggggtgaggatgtgtagcactgggaactctcatttattgctggtaaaaaatgcaaaatggtaaacaaccactttggaagacaatttggcaatctcttacaaaactaaacatacttttaccatatgatctagcgatcagg

SEQ ID NO: 115464 - DNA, 601 bp, Human
ccaacaaaaagtaatgagctatcagctgggcatggtggctcacacccgtaatcccagcattttgagaggcaaaggcgggcagatcacttgaggccaggagttcaagaccagcctggccaacatggtgaaaccctgtctctactaaaaatacaaaaattagctgggcatggtggcaggcgcctataatcccagctacttgggagactgaggcaggagaattgcttaaacccaggaggcgaaggttgcagtgagctgagatcgtgccattgctctccagcctgggcaacaagagcaaaactcygtctcaaaaataaaaaaaagaaagaaggaaagaaatgagctattaagccaagaaaagacatgagggaaccttaaatgcatgttgctaaatgaaagaaggcagtcttaaaggctacatactgtgtgattctaactacagtcatgcaccacataacattttggtcattgacagaccacatatatggcagtggtctcataagattataaaaccttatttttactgtaccttttctatgtttagatatgtatagatacataggtacttaacattttgttacaattacctaaaattcaatagaat

SEQ ID NO: 115465 - DNA, 601 bp, Human
taaagttcccatgttttttaaaaaggtttattgacttagatctgatttgaaaagtgtaatgtagcttattatagaatatttaaaacataagaaaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatcygaaaaccttgggaggctgaggtgggaggatcacttgaggccagaagttggagaccagcctgggcaacctagtgaggccccatctctaccccaaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactacctta

SEQ ID NO: 115466 - DNA, 601 bp, Human
aaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatctgaaaaccttgggaggctgaggtgggaggatcacttgaggccagaagttggagaccagcctgggcaacctagtgaggccccatctctaccccmaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactaccttagcctcccgagtagctaggactaaaggtttacaccaccatgcccagctaatttttctattttttgtagatacagggtcttgctgtgttgccag

SEQ ID NO: 115467 - DNA, 601 bp, Human
tgcccgcctcggcctcccaaagcactgggattacaggcatgagtcaccatgcccagccctcattattatttttaatgggactgtgtatgttttctatttatttgtaattttactgtttccctttttccacattttctgcagttattgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctrtctattcacagtattctctgacctttaaatttatgtggcttaaaatctattttcaatgcataaacatttgtatatttttccaggtgaacaatgtactacctagatgtataataatttaaatttagtgtaaaatgagattttttacaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttc

SEQ ID NO: 115468 - DNA, 601 bp, Human
tgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctgtctattcacagtattctctgacctttaaatttatgtggcttaaaatctattttcaatgcataaacatttgtatatttttccaggtgaacaatgtactacctagatgtataataatttaaatttagtgtaaaatgagattttttasaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttcagcgtaatatatacttgtaaaaagtgaattagtaaaactattctggccgggcacagtggctcacacctgtaatcccagcactttgggaggctgaagtagaaggattgcttgagcccaggggttcagaccagctgggccacatggt

SEQ ID NO: 115469 - DNA, 601 bp, Human
atggttcttgttctctggtgtaatgcctcctatgcctgctctcttggctgtgttgaaaagcatacatacagagctgtgctcttcattttcaagatgatgtactgataaggaccacaagccagtggcactgggaaaaagggatcctaagagactttttcttattaaacatacattcaaagtcagttatttaatattttgctttttggactcttggtaagcccaaatcttgttctaaaaagagcagacttttttgttttgttttgttttgtttgagatagtgtctcactctctctcccattckggagtgcagtggagcgatatggctcactgcagccacaacctcccaggcttgggtgatcctcccacctcagcctcctgagtaagtagctgagactacatgtatgtaccaccacgcctggctaaatttttgaatttttttgtagggacggaattttgccatgttgcccaggctggtctcaaacttctgggctcaaatgatctgggtgcctcagcctccctaagtactgggattacaggcatgagccaccaggcctgacttgtttttgtttttttgttgttgttgttgcccaaactagagtac

SEQ ID NO: 115470 - DNA, 601 bp, Human
aggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaaygggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaa

SEQ ID NO: 115471 - DNA, 601 bp, Human
ggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatrgagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctc

SEQ ID NO: 115472 - DNA, 601 bp, Human
gcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggytggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagca

SEQ ID NO: 115473 - DNA, 601 bp, Human
atcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccscatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagat

SEQ ID NO: 115474 - DNA, 601 bp, Human
agaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattsactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttgg

SEQ ID NO: 115475 - DNA, 601 bp, Human
aggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacatygtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgag

SEQ ID NO: 115476 - DNA, 601 bp, Human
ttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcamatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaattt

SEQ ID NO: 115477 - DNA, 601 bp, Human
cacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacataygtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtga

SEQ ID NO: 115478 - DNA, 601 bp, Human
tcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggtaccaagtatttaattgtgacaaagttcagattattttttcttctataaaagttgyattcttagccaagtgtggtaacttatacatgtaatcccagtgctttgggaggccaaggcgggcagattacttgagcccaagagttcaagaccaacctgagcatctctacaaaaaaatgcaagaattagaggaaagctgaggtgggagaagagcttcagcccagaaggtcgaggctgcagtgagccatgagtgtgccactgcactccagcctgggtgatagtgagacactgtctcaaaaataaataaatttttaaaaaagaaaagttcatactttttacctcttactaagtgatctttagc

SEQ ID NO: 115479 - DNA, 601 bp, Human
aaagatctcccgaccgggcacagtggctcaacacctgtaatcccaggccaaggcaggcagatcacgaggtcaggagtttaagaccagcctggccagcatggtgaaaccccatctctactgaaactacaagaattagctaggcatggtggtgcatgcctgtagtcccagctattcaggaggctgaggcaggagaattgcttgaacctgggaggcggaggttgcagtggccaagatgatgccactgtactccagcctgcgtgacagggcaagactccatctcggggaaaaaaaaaaaaaaaaagacctccctaacggtaacgcacaagactttctcttactgtcaaggctgaagaatgagacaggtgcttagatcatatattggtctgacccaatatgacatttctgctgctgttatacaatactcatgtgtttttttttgcctgtgttctaggttttctgtctcaactggtctctgacaagcctctgactgaatgtatccgtgctggccactatgcagcaagcatcataattagacggactggctgcacctttcctgagaagccagacttccactgatggaagagctgaaaacacaagccca

SEQ ID NO: 115480 - DNA, 601 bp, Human
atgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggayacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacat

SEQ ID NO: 115481 - DNA, 601 bp, Human
tttttgtatttctagtagagatggggtttcgccatgttggccaggctggtcttgaactcctgacctcaggtgatcctcctaccttggcctcccaaagtgctgggattataggcatgagccaccacacccggcctgaactgacagtttcaaaagcagatgagtccggtgattccaatcagctctggacaccgcaggatctgtgccccctcttcactggcctactgctgttttacaagccaggggcagtagcactgctatcaccagaacccttggtctctaaacatgtcagtttgatgatcgwcccacacctgtgccagggctcatcacaaacagtttcctgggggtttcgtgcccctcctcctatattggatgccaggcttcattcttcacaaggactggcacacagagtggaaaatcaataaatgtcatatctttacactgtaaacactgagacttgagtcagatctcaggacttgtcaaaaagaaggctgctacttgattccacaggagcaaggttatatataaccaaatcaaatacgaaaagcaaacgcttgacattcacataggttcagggtcaaaccagactctcaacttgaaagtg

SEQ ID NO: 115482 - DNA, 601 bp, Human
tgcttcaggtgataagtgcttcggtcctcatccttcaatgacaagtgcctggggtcttcctggggagcccatgtctctcagaactctcatctcagatggacgcaaccctccttcctaaactgtcctgatccagctaaggaggctgggctctctgtcctctcccagcctaccccactgggtaagtgtgctgttcattcaccccacgcacgagatgtgttcccagagcagctcagcttaccccagacaccactcggactgctgcgggttcctaaagccaggcaggcaccaggtggactctccrcaaacaggttcattaagtggcgatgagtgctgggatctgccgttttattctcggattaccactcgaaaaataactcagctaccaatattccctactgatgacagatttcagtgcagcaccaagtagaggcttggctcacgttgtctccaaagggctgggagagaggttccaaatctgctaagctgaataattcagcctcatgtagtcctcgtaattggacttacaccttgaaaattaaatttccaaagctgtgacaccggcgcatgccctgtgatacttggaggttctcggagctggagg

SEQ ID NO: 115483 - DNA, 601 bp, Human
attcccttcccagagacgtagggagatgtcaccacacctgttaattatagagctgccatccctctgtgtaacgaaaagttccccagtctcacacgattgcttcaggtgataagtgcttcggtcctcatccttcaatgacaagtgcctggggtcttcctggggagcccatgtctctcagaactctcatctcagatggacgcaaccctccttcctaaactgtcctgatccagctaaggaggctgggctctctgtcctctcccagcctaccccactgggtaagtgtgctgttcattcaccccaygcacgagatgtgttcccagagcagctcagcttaccccagacaccactcggactgctgcgggttcctaaagccaggcaggcaccaggtggactctccgcaaacaggttcattaagtggcgatgagtgctgggatctgccgttttattctcggattaccactcgaaaaataactcagctaccaatattccctactgatgacagatttcagtgcagcaccaagtagaggcttggctcacgttgtctccaaagggctgggagagaggttccaaatctgctaagctgaataattcagcctcatgt

SEQ ID NO: 115484 - DNA, 601 bp, Human
gtcccagcacaaatcaccaagaggcagttccataatcggcctgtagctgtagctatacaagcctcagacacaaactcctaccagattcccttcccagagacgtagggagatgtcaccacacctgttaattatagagctgccatccctctgtgtaacgaaaagttccccagtctcacacgattgcttcaggtgataagtgcttcggtcctcatccttcaatgacaagtgcctggggtcttcctggggagcccatgtctctcagaactctcatctcagatggacgcaaccctccttcctaaaytgtcctgatccagctaaggaggctgggctctctgtcctctcccagcctaccccactgggtaagtgtgctgttcattcaccccacgcacgagatgtgttcccagagcagctcagcttaccccagacaccactcggactgctgcgggttcctaaagccaggcaggcaccaggtggactctccgcaaacaggttcattaagtggcgatgagtgctgggatctgccgttttattctcggattaccactcgaaaaataactcagctaccaatattccctactgatgacagatttcagtgcagcac

SEQ ID NO: 115485 - DNA, 601 bp, Human
tctgaggacattaatattcaatgactattaatgaagagaccctaaagatcatcttcttaagccctcagacgacagaaagggaaactgaggcctgggacttgtatacttttccaaagcctcttctttgccaggttttgcaccttcctctaagacatcttttcttttccatctcataattctggatgcaaatgaactcatagctcatggaaactataaacccataaaaatgcacaaaaggacattaacaaaatattacctaaaatttccagaacttcatcaacctccttcctgatccataagygcatccacagatcccaggttgagcaggcctgcttccaacaatacccacattgttggatgtaaattcttacacaaagactcactcggggaacttcgtccctttccacgatttcttccctctgcctcacctgtccctccctgcatgtatacacaattttaaacttccttcaagaattaaatacagtaaaacaaatcctctgggaccattttacactttatgttgaaataaactcacaataacgctgccctgaaaagccaaaatgaaaaatgacagtttttccctaacctgggttgctcctaa

SEQ ID NO: 115486 - DNA, 601 bp, Human
ttggtggaagagtcagaagacttctgaggacattaatattcaatgactattaatgaagagaccctaaagatcatcttcttaagccctcagacgacagaaagggaaactgaggcctgggacttgtatacttttccaaagcctcttctttgccaggttttgcaccttcctctaagacatcttttcttttccatctcataattctggatgcaaatgaactcatagctcatggaaactataaacccataaaaatgcacaaaaggacattaacaaaatattacctaaaatttccagaacttcatcracctccttcctgatccataagcgcatccacagatcccaggttgagcaggcctgcttccaacaatacccacattgttggatgtaaattcttacacaaagactcactcggggaacttcgtccctttccacgatttcttccctctgcctcacctgtccctccctgcatgtatacacaattttaaacttccttcaagaattaaatacagtaaaacaaatcctctgggaccattttacactttatgttgaaataaactcacaataacgctgccctgaaaagccaaaatgaaaaatgacagttttt

SEQ ID NO: 115487 - DNA, 601 bp, Human
aacaccaagggcctcctccatccaaaaacaactttcttctcaactgtctccaaaagcctagatgttttttgacattgtggcacctggcacagccagcccacgggactgggaagacccatgttcccagctccctggcgacaacggcgacaaggccatgcacccggtgcttactggatgccagcccctgtgctaattgctctttatgtccaggtcaaatggaaatctcctaacaaccttttggtggaagagtcagaagacttctgaggacattaatattcaatgactattaatgaagagaccytaaagatcatcttcttaagccctcagacgacagaaagggaaactgaggcctgggacttgtatacttttccaaagcctcttctttgccaggttttgcaccttcctctaagacatcttttcttttccatctcataattctggatgcaaatgaactcatagctcatggaaactataaacccataaaaatgcacaaaaggacattaacaaaatattacctaaaatttccagaacttcatcaacctccttcctgatccataagcgcatccacagatcccaggttgagcaggcctgcttccaacaa

SEQ ID NO: 115488 - DNA, 601 bp, Human
taaacataacctttccctgaggggccaaaagaaaaggaccctctagtgttagggcccaggcttcttcctggaacttctcagtcacatttttctcctatccaatagacattatctaaactgagcttccaaataaattagcaaaccaaaaagtcttacaagataagaccttggtgcacagaaggtcaaggtggaacttactgctaaccaaagctatagtagttctaatcatggagaactgatggacaggggcacaggcacgcacgcacgcacgcgcactcgcgcacacacacacacacacgcrcactctctctctctctctctctcttccaattcaccagcacagagcctaaacctgagcccattttcagctgttaaaaactcctttctcatctataattcaatgaccttcctaatcacctctgacaccaaagcgaactcctgcaacagaagaactggtcttagggctcaaatcagtggccagtattagactaacagatgaggggaagtggggaccctacagaaagcaaacacagcttcctggaaacaccaagggcctcctccatccaaaaacaactttcttctcaactgtctccaaaagcct

SEQ ID NO: 115489 - DNA, 601 bp, Human
actaaacataacctttccctgaggggccaaaagaaaaggaccctctagtgttagggcccaggcttcttcctggaacttctcagtcacatttttctcctatccaatagacattatctaaactgagcttccaaataaattagcaaaccaaaaagtcttacaagataagaccttggtgcacagaaggtcaaggtggaacttactgctaaccaaagctatagtagttctaatcatggagaactgatggacaggggcacaggcacgcacgcacgcacgcgcactcgcgcacacacacacacacacrcacactctctctctctctctctctcttccaattcaccagcacagagcctaaacctgagcccattttcagctgttaaaaactcctttctcatctataattcaatgaccttcctaatcacctctgacaccaaagcgaactcctgcaacagaagaactggtcttagggctcaaatcagtggccagtattagactaacagatgaggggaagtggggaccctacagaaagcaaacacagcttcctggaaacaccaagggcctcctccatccaaaaacaactttcttctcaactgtctccaaaagc

SEQ ID NO: 115490 - DNA, 601 bp, Human
tcaacagaatagtacttggcattgaggactgccccccttcgagtcaataaccatgttttcactcctctgctggtgccctataacaatgaatgaccaaaaggaaattaacaatgaatgaccaactggaaaactcatatttaatctgaaatattaaaaactaaaatcttctagagattattttcttaagtcaattgagtgggcccaaccccactgctactatttcagaacgtgtccagaagacaaatgatatatatgatatatgatatgacatatgatatgatacgatattgcacaaagccamgatgactaaacataacctttccctgaggggccaaaagaaaaggaccctctagtgttagggcccaggcttcttcctggaacttctcagtcacatttttctcctatccaatagacattatctaaactgagcttccaaataaattagcaaaccaaaaagtcttacaagataagaccttggtgcacagaaggtcaaggtggaacttactgctaaccaaagctatagtagttctaatcatggagaactgatggacaggggcacaggcacgcacgcacgcacgcgcactcgcgcacacacacacac

SEQ ID NO: 115491 - DNA, 601 bp, Human
agacttcaaatatttataatgttaatcaacagaatagtacttggcattgaggactgccccccttcgagtcaataaccatgttttcactcctctgctggtgccctataacaatgaatgaccaaaaggaaattaacaatgaatgaccaactggaaaactcatatttaatctgaaatattaaaaactaaaatcttctagagattattttcttaagtcaattgagtgggcccaaccccactgctactatttcagaacgtgtccagaagacaaatgatatatatgatatatgatatgacatatgayatgatacgatattgcacaaagccacgatgactaaacataacctttccctgaggggccaaaagaaaaggaccctctagtgttagggcccaggcttcttcctggaacttctcagtcacatttttctcctatccaatagacattatctaaactgagcttccaaataaattagcaaaccaaaaagtcttacaagataagaccttggtgcacagaaggtcaaggtggaacttactgctaaccaaagctatagtagttctaatcatggagaactgatggacaggggcacaggcacgcacgcacgca

SEQ ID NO: 115492 - DNA, 601 bp, Human
ctggcgagaatcggaccagtacagtggagagtagcacaccagctatatttcctacctagcgtaacagccaggcacccaaaaatcaatttcccatgttttcctttaatgactaaaattcgcttccatggaaatgtaagggtaagctagattagagggagtttttaacaattaccctggctaaacaaacacctaaacaacagtctgcaaactggaagactagtggatacattttattgaaactacgaacattaaacaaaacacttccagtttaaacacgaccccagttatttcatagccatgyaattatttgttaagtctgatattaaaaacatctcatattggattgctgtggttttgtgaattctcaccctcaactgggtcagaaagacttgaaaggaataaagtctttacttatggcttgatgcggggccattggcatagtaagtgctctgtcttttaactggttgaaataaacagacaaaacagaaacacacacatataccccaaatttgaatcagagagagccagtataaaatgatacaagtaccagttctctgggcttgccagatttctgctctataagtaatattaaacatggctc

SEQ ID NO: 115493 - DNA, 601 bp, Human
cagcaaaaatctctaaatcatatgggatacagcaaaaagatggaaaaaaatgcaaaacttaaggctaggacaggtgtggtggctcacacttgtaatcccagcactttgggaggccaaggctgccaggagttggagaccagcctgagcaacatggcgaaaccccatatctacgaaatatttttaaaaattatccaggcctgtagtcccagctactcaggaggttggaggaccccttcagcccaggagtccgagggtacagtgagccacgtttgacaatgcagtgagggtacaattgcaccaytgtactccagcctgggtggcagatcaagactctgtctcaaaaaacaaaaacaaacaaaaaaccaaaggctaaaatcatctctcaaggaaaaaaaaatagagaccataagcattttgcacagttgcataaaacctactggatcagaattatctgtggaatagcctaaaaaacttccaaaaaataatttctgaactgcctacagagatgtccccctggcgagaatcggaccagtacagtggagagtagcacaccagctatatttcctacctagcgtaacagccaggcacccaaaaatcaatt

SEQ ID NO: 115494 - DNA, 601 bp, Human
aaaaagtagagccatctctaaatctcatgggatacagcaaaaatctctaaatcatatgggatacagcaaaaagatggaaaaaaatgcaaaacttaaggctaggacaggtgtggtggctcacacttgtaatcccagcactttgggaggccaaggctgccaggagttggagaccagcctgagcaacatggcgaaaccccatatctacgaaatatttttaaaaattatccaggcctgtagtcccagctactcaggaggttggaggaccccttcagcccaggagtccgagggtacagtgagccamgtttgacaatgcagtgagggtacaattgcaccattgtactccagcctgggtggcagatcaagactctgtctcaaaaaacaaaaacaaacaaaaaaccaaaggctaaaatcatctctcaaggaaaaaaaaatagagaccataagcattttgcacagttgcataaaacctactggatcagaattatctgtggaatagcctaaaaaacttccaaaaaataatttctgaactgcctacagagatgtccccctggcgagaatcggaccagtacagtggagagtagcacaccagctatatttccta

SEQ ID NO: 115495 - DNA, 601 bp, Human
aactctatatgtgtgcattccattctgaaatgaattggaatttaccattctttagttagacaaggggttaaaggaaagaatatacaacagcttagccccctgacttggtactgtcaaaaagaatcagaagtttttgagagtggcatgatgtggccaaagtccacaatggcgcagaattacttacagtattccaaagtggagtaaattacacattcagcatctgaaaactcttccatggtaccggtttcccaaaaccaaaattactgaaaatctaaagcacgcctattttacttgacacacrctcttcaaggatggccatggcttgtcccaatgattcatacttgtgtataaatatttaaatggtaagagcttgaagttatataaatagaagtcagctaccacatacaaatcacagtgaggaaagagaaacttgtaaaaagtgtgacttttgtctattacagaaggagacatcttcaagacgtgaaggatcaccacaatgacctgtccagcatcttgttcaatcagacctctccttaaaagaacttagcctctgaatagccaaggcaatcctaagcaaaaataacaaagctgggggcatcac

SEQ ID NO: 115496 - DNA, 601 bp, Human
gttcttgaatctatcagcattttccttataagctatttttagcctcctcataaaacacattcagcataacctgaaactctatatgtgtgcattccattctgaaatgaattggaatttaccattctttagttagacaaggggttaaaggaaagaatatacaacagcttagccccctgacttggtactgtcaaaaagaatcagaagtttttgagagtggcatgatgtggccaaagtccacaatggcgcagaattacttacagtattccaaagtggagtaaattacacattcagcatctgaaarctcttccatggtaccggtttcccaaaaccaaaattactgaaaatctaaagcacgcctattttacttgacacacactcttcaaggatggccatggcttgtcccaatgattcatacttgtgtataaatatttaaatggtaagagcttgaagttatataaatagaagtcagctaccacatacaaatcacagtgaggaaagagaaacttgtaaaaagtgtgacttttgtctattacagaaggagacatcttcaagacgtgaaggatcaccacaatgacctgtccagcatcttgttcaatcagac

SEQ ID NO: 115497 - DNA, 601 bp, Human
catcccttgttctcgttcttgaatctatcagcattttccttataagctatttttagcctcctcataaaacacattcagcataacctgaaactctatatgtgtgcattccattctgaaatgaattggaatttaccattctttagttagacaaggggttaaaggaaagaatatacaacagcttagccccctgacttggtactgtcaaaaagaatcagaagtttttgagagtggcatgatgtggccaaagtccacaatggcgcagaattacttacagtattccaaagtggagtaaattacacaytcagcatctgaaaactcttccatggtaccggtttcccaaaaccaaaattactgaaaatctaaagcacgcctattttacttgacacacactcttcaaggatggccatggcttgtcccaatgattcatacttgtgtataaatatttaaatggtaagagcttgaagttatataaatagaagtcagctaccacatacaaatcacagtgaggaaagagaaacttgtaaaaagtgtgacttttgtctattacagaaggagacatcttcaagacgtgaaggatcaccacaatgacctgtccagcatc

SEQ ID NO: 115498 - DNA, 601 bp, Human
acatgcattggtggaaatccaggaggcttagcaggacaagaaggctccttaaggcagccacacatctttgggggcaatcccactgtcaactgaaaatctgaactttaagggtgttcaaagagtttaaaacctaaacttaaccattgcaatgatcttgacattcattttatagtacacccccctgagcacatacacacaccatagatacacacagttggccttttcaatgtctggatacttttaaaatattacaactggtcactatggaaaatttaacagtaaactgtcaggtatacaaatkggtcacatatagtaatataggagctcaagggttcgaaaataatcacgataattgatatagagtttattaacgttagagctcagaattgagtcctctccaagaaaggcgctacataaatcatacaaataaatacatcccttgttctcgttcttgaatctatcagcattttccttataagctatttttagcctcctcataaaacacattcagcataacctgaaactctatatgtgtgcattccattctgaaatgaattggaatttaccattctttagttagacaaggggttaaaggaaagaa

SEQ ID NO: 115499 - DNA, 601 bp, Human
tctccatcccgcaccccaccccaaccaatcccataacccctctccatcccacaccccaccccaactgatcccataacccctctccatcccgcaccccaccccaaacgatcccataaccctctccatcccgcaccaccccaaccgatcccataacccctctccatcccgcaccccaccccaaccgatcccataaccctctccatcccgcaccccaccccaaacgatcccataacccctctccatcccgcaccaccccaaccgatcccataacccctctccatcccgcaccccaccccaaccrattccataacccctctccaatgttcttcaccgggcctaatggcaatgtggcagagtattttgtattttgaagcttcaaacagaaaactcttttgccaaaatacattgttcctcatgaagtatgtgtctgctgttattattacagagctgcaactgacttttttcaacagaggggaaaaaaaatttcaaccttgaaccatttggactgcaagcagcaggatgatcccatttctaaaatccatgggacttgcaaaagcccaagataataaaaagggttggacaaatccagggcctagagcca

SEQ ID NO: 115500 - DNA, 601 bp, Human
tacaggggtctgtctatgcaggtaggccttgacttcatacccagtcgtaaatcagaaattctgggaagaaaagcttgacataatatccaagtggcaacagctgagggttagcaggcactaggacaaaccagcagaggcatctgggacaaggaataactggggacggcctgctctgctgagatggctcatgcatcaacgggcaacagaggccagcccttcttgttatggactcctacggtgtggcgcagcctggaccaccaactgggacccagtctcccattggtctccttggcagcagtcrgggttagcctctttccaataagtcacatgccaccagaagccattctagaagaatcacaaagtataatcattaaacatttttattgtctggaatttttcttcaaatgtctttaggagaattcggtatggatgtgtgagaaagaaacagaatcaaccagcagtgtccctaacaggtttaatagtcaaacgacagatttaggaaagaatgaggggtcaccacattctccagcaaaaaaaaaaaatcctcctgctcaggaagaagggaaatttttcttacaccaacacattcacccaaagacct

SEQ ID NO: 115501 - DNA, 601 bp, Human
agcctgggtgacagagcaagagactctgtctcacaaaaaaagaaaaaaaagaaaaaggaattctacaactttcctccaaaactcaactcccacttggaaatgcctggaacccctgagtgttctgcaactgctgtacaggtagccaagaacaaagttcagctgcctaaaccagcctcgattcacctacacattagctggtactggagttcactttttatttttaaataccaaactgatctttgcttgctttaaaaatgggctccattccctggcctctttttttcccctaaggacacccttyctggccaagactggaagaagagtaggtgtttctgcttttggccttttcattcttggaattttttcttttttggctttcttagtctctcctcctaatctctgcagaaaagtgacattagaagggtcaggtagtccttggtgcttgtttccatgaccacagttcgtgggagtcccaagtacaggggtctgtctatgcaggtaggccttgacttcatacccagtcgtaaatcagaaattctgggaagaaaagcttgacataatatccaagtggcaacagctgagggttagcaggcactaggac

SEQ ID NO: 115502 - DNA, 601 bp, Human
ccactgcactccagcctgggtgacacagtgaacagagagagaccctgcatttaaaaaaaaaaaaaaaaaaaaaaaagcagcagcagcagcagcttcatagtcccagtccctgggaactcctaaacatggggcacatgcctccggcccatgcttttccttcacagaatcttcacctttgactggacctagcccttcattttttatttttgtttatttattttgatttttttttttatttttgagacagagtctcaccctgtcgcccaggctggaatgcaatggcgtgatctcagcttactgmaacctctgcctcccaggttcaaagattctcctgcctccgccccccaagtacctgggactacaggtgcctgccaccacccccggctaatttttgtatttttagtagagaccacgtttcaccatgttggccaggctagtctcaaactcctcacctcatgatccgcccacctcggcccctcaaagtgctgggattacaggcgtgagccactgcacccagtcctagcccttcatttttgcaattatttgacaagagcctgtctcccccactcaactgttcattgcttgctattccatccccaca

SEQ ID NO: 115503 - DNA, 601 bp, Human
cagaaggctaaggtgggaagaccgcttgagcccaggaggtccaggatgcaatgagctgtgattgcaccactgcactccagcctgggtgacacagtgaacagagagagaccctgcatttaaaaaaaaaaaaaaaaaaaaaaaagcagcagcagcagcagcttcatagtcccagtccctgggaactcctaaacatggggcacatgcctccggcccatgcttttccttcacagaatcttcacctttgactggacctagcccttcattttttatttttgtttatttattttgatttttttttttttttttgagacagagtctcaccctgtcgcccaggctggaatgcaatggcgtgatctcagcttactgaaacctctgcctcccaggttcaaagattctcctgcctccgccccccaagtacctgggactacaggtgcctgccaccacccccggctaatttttgtatttttagtagagaccacgtttcaccatgttggccaggctagtctcaaactcctcacctcatgatccgcccacctcggcccctcaaagtgctgggattacaggcgtgagccactgcacccagtcctagcccttcattttt

SEQ ID NO: 115504 - DNA, 601 bp, Human
tcactacctctcacaatcctccaaagcagcattcagagggaagctttagatctcagaagggctgtgcgccggctcccacgaatgtaggctttctgggacagggcatcccccaggcgaggcacctgggaggaggcagaatcccatcctgcccacacctggcctgactcccctggccgccctccggccatctctctgcctccacattgacctggcaagaaactctgccaattagaggtagtaacagaaaagagataggaagcaggctgaaacgacccactcaaatacggcctggaggccgccrggatgcccttgaccggcctcctcactcgccacaccttcaagggcaagcacctcacaggaggggagaagaggggcctctgagcccagctgcacgcattcactcaacggcctctgctccacctccatcaacatcaacaggtgaagccagcaagggacagcagagaggctaggccctggaaaatcacctcactggacaagggtcaacctagcaggcaaggtggctggtactgataagggtcaaccttgcaatgcaggtgggtttgctggggaatccaggtgggtgccacctccttaaggggaa

SEQ ID NO: 115505 - DNA, 601 bp, Human
aggcacagagttgtggcctggggagccggcagcaatcagctgaatgggaatgacctggaggaaaggttccccacactgccttcgggtgggcgggacacggtcccagctggttttgcaccgcaggacccaaggaaggcaggtcggagccacagggatcacttttctcctgtgttttgcagaggaaagaaaaactctccctcaggggatcctgagccagaggactgaaacccacattaattcaggacattccacgttaagagccggcgccatcacagttaacctttcttccctgctccaaacygcatatttgcatagaggtaaaagcttcaagaaaacaaacaaactttgaagagtcactacctctcacaatcctccaaagcagcattcagagggaagctttagatctcagaagggctgtgcgccggctcccacgaatgtaggctttctgggacagggcatcccccaggcgaggcacctgggaggaggcagaatcccatcctgcccacacctggcctgactcccctggccgccctccggccatctctctgcctccacattgacctggcaagaaactctgccaattagaggtagtaacagaaaa

SEQ ID NO: 115506 - DNA, 601 bp, Human
aaagcctgactcattccagaagcaggttttcagggacagtcaccttgccacacttactgttacctgtggctcctagaagctgctgctgggacaagctcacctccctgatattgatgtaaacattcaataaatggtgcatactccagcggatacgtttgccctgtatggccctgaaaggtcagatagatgtccagatcccgtttgacattttcccccaagcccatagagcaggccctcccacactgcgcactttctgaataaagaaatacttttaaagtggccaaggctacaaaagaaaagrgaaggttaagagttattccaggagggcaaggctgcctcctgctttctcaactcaggaccttctgggggtactgtttggcaagttgatttaaagggctcggcctttcttctctcagcaggatctcggttccaacactccttcagagtctgcagatgtgtccccgcctgatcccctcagcagcatcccagccatttgcaaatgaagcagcagcagctggagactgggaaacagatggtcttcctcatttgaatgggtttgaacggtctgcttgaggctcaccaagttcaggcctggccagca

SEQ ID NO: 115507 - DNA, 601 bp, Human
ctgctgcagggcaaggtcaccacaaggacacaatcaaaggctgcctaggaaggcctctgtatatttaaagtgaggggcacgtctgagagcaagcactcctcatcctggcgggcggttggaggtagtggggggtccccatcctgcaactcagccctggccaggagggcagtcctgggttcctgtttacggggcgtaactggcctgcagattgctttttccaaccatgtgagagcctctattcgcattcctctgacttcaaaacaggttttctttcaagtgaacaaataggtctcatcacatrtaagttacctaaatgaggattcctggaatgttcccagagactaaacatctgaagattttgtgagattcatcattatcaacacccatgtatgatgcctgtttaatttacaaagaggcctgtggcttcttaaaataccttctactattcatccatccaacacatttgagagtagctgatatttgcatgtggggcacagtaacacaccacagaattcccttgagatgagaaccccagcagggctcaggagccggataacttaccctagccccacagcatgccgggaataaccctgcaaacacc

SEQ ID NO: 115508 - DNA, 601 bp, Human
gcagaggttgcagtgagccaagattgtgccattgcactccagcctggacaacaagagcaaaagtctgtctcaaaaggaaaaaacaaaaaaagattctgggtcagtaggcctgcaggtgcgggctgacattctttatttcccacaggtgaggcctgatgctgctggtccaagacccacactacaagaagttcagctccagtgtccaaggatgagactttgagacccgcctctgccagtagtgaacgtgtcagcttggacagcctcacaccgctgagcctcagagtcatgctttagagaagaraaaaacatctccagtgctgcctgctgcagggcaaggtcaccacaaggacacaatcaaaggctgcctaggaaggcctctgtatatttaaagtgaggggcacgtctgagagcaagcactcctcatcctggcgggcggttggaggtagtggggggtccccatcctgcaactcagccctggccaggagggcagtcctgggttcctgtttacggggcgtaactggcctgcagattgctttttccaaccatgtgagagcctctattcgcattcctctgacttcaaaacaggttttctttcaagtga

SEQ ID NO: 115509 - DNA, 601 bp, Human
ataggacacagaaggcacccagcacaatgtctggcacttacacatctgccatcagaaagaccttccggctgaaatcctcactcctccgctaaacaggaaaaaaagcaaggctgcctagccaggtcttctcagtgtggaaggtcaggaaatgagagaggagggggcagggctcctggtctatttctcaatccctaacacagaattgggggttaattatcttcggttagcattctgcttcctgctggtgcgtacatgtgcgtatgtgttcttatggacaggaacatgtcaaggaggacttctygcctttctaggaaatttctccttccctgccacccctcctgtatccatggatatacccagaattccacctctggctcttctggtcctttccctgcattccagtctcctgggcacgtgtggcttttcccacctcctccccgcagatgccactcaagtccctgcttgtaggttcatatttccacctgcccggggggaggaaatacataacctggatgtctgcagaggtcgtatccaaaacaagcaagtgaccttcaacctcctcctcctccaccagcctcttctcttacacgatgaagggagt

SEQ ID NO: 115510 - DNA, 601 bp, Human
aatcgtatgaccttgaggcaagtcctcggagcaggaacaataataaatgagataggacacagaaggcacccagcacaatgtctggcacttacacatctgccatcagaaagaccttccggctgaaatcctcactcctccgctaaacaggaaaaaaagcaaggctgcctagccaggtcttctcagtgtggaaggtcaggaaatgagagaggagggggcagggctcctggtctatttctcaatccctaacacagaattgggggttaattatcttcggttagcattctgcttcctgctggtgcgyacatgtgcgtatgtgttcttatggacaggaacatgtcaaggaggacttcttgcctttctaggaaatttctccttccctgccacccctcctgtatccatggatatacccagaattccacctctggctcttctggtcctttccctgcattccagtctcctgggcacgtgtggcttttcccacctcctccccgcagatgccactcaagtccctgcttgtaggttcatatttccacctgcccggggggaggaaatacataacctggatgtctgcagaggtcgtatccaaaacaagcaagtgacc

SEQ ID NO: 115511 - DNA, 601 bp, Human
tgctcagccagaggcagctctcttcatcttacaaagtagtaaagcacctgtctcaacagacagctataccccaagcctctcatggtcccttagcagtaaggctatggcctcatttttgtcccttctctggtgactcttcagaaaaggctgggggtgttaaaggtacagaccaaggccgggcatggtggctcatgcctgtaatcccagaactttgggaagctgaggcaggtggatcattcaaggtcaggagttcgagaccagcctggccaacatggggagaccccatctctattaaaaatayaaaagttagctgggcatggtggcaggcgcctatagtcccagctactcgggaggctgaggcaggagaatcgcttgaacctgggaggcggaagttgcagtgagccaagatcacgccactgtgctccagcctggatgacagagcgagactccatctcaaaaaaaaaaaaaaaaaaaaaaaaatatatatatatatatatatagagagagagagagagagagagagagagagagagagagagagagacaccaaacagacctgtcactgacaccgagactatgccacttacaaatcgtatgacct

SEQ ID NO: 115512 - DNA, 601 bp, Human
tggcacacgcctgtaatcccagctactaaggagggtgaggcaggagaatcgcttgaacctgggcggtggaggttgccgtgagccgagatcacgccactgccctccaacctgggcaacaagagcgaaactccgtctcaaaaaataaataaataaataaatcgagtcttttgttcagaaagcatttcccaaagcgacaggccattagatcatgtagcgcccaggaaatagatacttgcgttacaagctatgttgaagtcctgcacgccccggcttggatgtacaatgaggagtctgtgtgccyggctgcctggccagcccagcccgagcctcctaccttctgaaaatacacttgctggacatagcagagaaagctggtacatctccagcccttcagggcttcttgggacacactgttctggggaaaaccctttcatcaaaaggcatgtggggggctcacaaggaggtgaaggagtgaataggatgtgcctggcctttaatgacccaatcttagggtgaagagtggccctacagagttgtcactctgtaaaatgaatgcattgtgatctccagtcctgaaactgaaccctctggtctcaaaaca

SEQ ID NO: 115513 - DNA, 601 bp, Human
aacgaagacagcctgctgcagcccagacatcctcaaagcctcccctctgcaagagccgacttgcaagaagaccaaattcctcacatcaaacagagaccttataaggcataggtactacgtgttctttaagggggcgaggaagggacaaatactccgcacaatataaaggtgaaagttctctacctcgagaaatactgccaacataaaaacggagaacaaaaagaagtcaaagcaacaaacaacagataagtacgcaggatgaaagggtgcagtcctctctttctaaccagttgtcagggtrtctggtagacacaagtcgggactgaaacctccctggtcgctaacaaggatgccggtaacaacagctaacagccgcctctgcagcggtagctggatttctccagaaactccagactggctcatgttcctagtcatcagatgggatcatggctaatgtttccaatatggtaaccattaaaaattatatatttaggcacacccctcatatcatttaagtctgcctttgagaaacatgctggatggctcttcatgtttgaaagaaattatattgttgcccatgagaaaataaaaatgcacacag

SEQ ID NO: 115514 - DNA, 601 bp, Human
tatggcacaatctgggtatcactggcatcagaacttatcagcagaaagaaataaaggcaatggaggccaggtgcggtggctcatgtctgtaataccagcactttgggaggcccaggcaggtggatcacttgaggtcaggagttcgagaccggcctggccaacaagacgaaaccccgtctctactaaaaacacaaaaattagatgggcatggtggtgtgtgcctgtagtcccagctacacgggaagctgaggcaggagaattgcttgaatccgggaggcgggggttgcagtgagcccagatygcgccactgcactccagcctgggtgacagaactaaactccatctcaaaaataataataataataataattaaattaaaaaataaaggcaatggagtcccgccattgaagtcagaaccaaccacctttgcatgccctgccatgagggctgtgtacacagcaacgaagacagcctgctgcagcccagacatcctcaaagcctcccctctgcaagagccgacttgcaagaagaccaaattcctcacatcaaacagagaccttataaggcataggtactacgtgttctttaagggggcgaggaa

SEQ ID NO: 115515 - DNA, 601 bp, Human
actggggagagaaagaaactgaggcaggggctgcctgactctccgagcccctcagcagaccatttgacatcacacagagtgccactagccacaagctgcatgaatttacctctctataagtaaacagagagaaaaaaatcctcgctgtgtgtgaagatagccccaggagggggaaatcttgtaaaagtcaaaaaaggctgtgacttatgtgacttcactgcacacatccagctggacttctcacccatctcagcgggagggttgtcttgagacagttgaaacagcaaaagggtttggaaayggtaagctatttcaggtaacactttacgttgccaaaccagcgatagcagcacttcagactgtcactttttataatgtttgcctataaacttttcccgtgtggtttttgaaatggcgcccaaatgcaaacagagaacagatgggaaacctgagtcttgccccgtccaatcacttcacggagaatggacgacagatttaaactgttaaggaagaaaaaagcagtttctaccaacggcacagctccctccattacttttcacaaattaagccttttctggggtttcccagggatggtgtcttt

SEQ ID NO: 115516 - DNA, 601 bp, Human
ttaacccagaaggtggaggttgcagtgagccgagaccatgccattgcactccagcctgggcgacatgagtgaaactgtctcaaacaaaaaaaaaacacaaataaataaatagtatgaataacaacaggcatctgcacatgagctgtgagtaattcctgccttgacctggccttccttccctaagaaaaccatcctgttattccttgggagctcataggacctctgactggggagagaaagaaactgaggcaggggctgcctgactctccgagcccctcagcagaccatttgacatcacacrgagtgccactagccacaagctgcatgaatttacctctctataagtaaacagagagaaaaaaatcctcgctgtgtgtgaagatagccccaggagggggaaatcttgtaaaagtcaaaaaaggctgtgacttatgtgacttcactgcacacatccagctggacttctcacccatctcagcgggagggttgtcttgagacagttgaaacagcaaaagggtttggaaatggtaagctatttcaggtaacactttacgttgccaaaccagcgatagcagcacttcagactgtcactttttataat

SEQ ID NO: 115517 - DNA, 523 bp, Human
gccttttttttctttttttttttgagacggagtctggctttgtcgcccaggctggagtgcagtggcgcgatcttggctcactgcaagctccacctcccgggttcacgctattcacctgcctcagcctcctgagtagctgggactacaggagcctgccaccacacctggctaatttttggtattttttttagtagagacggggtgggtttcaccatgttggccaggatgatcttgatctcctcacctcgtgatacgcccacctcagcctcccaaagtgctgggattacaggcgtgagccacygtgcctggccttttttttttttttttttttttttgagacggagtctcgctctcgcccaggctggagtgcagtggtgcgatctcggctcactgcaagctccacctcctgggttcaagtgattctcctgcctcagcctctggagtaatgggattacaggtgcatgccatcacgcctgggaattctcttgttgttgttgtattttagtagagacagggtgtcttc

SEQ ID NO: 115518 - DNA, 601 bp, Human
ttttcacaatatgaattaaaagtcgaaaagaagcaagcaagcttcacagtagtattggccaatctttgtcactgtttcctaaaactggtaaacaaacaaggcaccaagtctccttcctgggacacagctcaacactcgtttctactgccgtggccacactactgcagccctgctgcataaagctcagttgcatccacgtgaattttctcccagaagtttcaaatacttgggaagtaccagcagcgtgttagcaagcagccttttttttctttttttttttgagacggagtctggctttgtygcccaggctggagtgcagtggcgcgatcttggctcactgcaagctccacctcccgggttcacgctattcacctgcctcagcctcctgagtagctgggactacaggagcctgccaccacacctggctaatttttggtattttttttagtagagacggggtgggtttcaccatgttggccaggatgatcttgatctcctcacctcgtgatacgcccacctcagcctcccaaagtgctgggattacaggcgtgagccaccgtgcctggccttttttttttttttttttttttttgagacggag

SEQ ID NO: 115519 - DNA, 601 bp, Human
ttccacagacagagaatatgtttccatgtatttttcacaatatgaattaaaagtcgaaaagaagcaagcaagcttcacagtagtattggccaatctttgtcactgtttcctaaaactggtaaacaaacaaggcaccaagtctccttcctgggacacagctcaacactcgtttctactgccgtggccacactactgcagccctgctgcataaagctcagttgcatccacgtgaattttctcccagaagtttcaaatacttgggaagtaccagcagcgtgttagcaagcagccttttttttctttttttttttgagacggagtctggctttgtcgcccaggctggagtgcagtggcgcgatcttggctcactgcaagctccacctcccgggttcacgctattcacctgcctcagcctcctgagtagctgggactacaggagcctgccaccacacctggctaatttttggtattttttttagtagagacggggtgggtttcaccatgttggccaggatgatcttgatctcctcacctcgtgatacgcccacctcagcctcccaaagtgctgggattacaggcgtgagccaccgtgcctggcctt

SEQ ID NO: 115520 - DNA, 601 bp, Human
atttcctgtttttaaatgaaagtgttttcattgagaatcctttccttcacctaaaatcagtaaaccccaaaatcttgctgaaactgggggtatctgagctgctggactaccacgtgctgttctagaaggaagtacaggggacagcgaggacctgtgtcttatttggagctggacatgggagatgcctggtgaagggtgctgccctggacgagaagaggatgaagccctgagttcccacgcctctccattcctgcttaaccttttggcctggtgttccccatctgttgcagggtaagagtayccaaatactggtttattattggtaagattccaatgagccaacgaagatgaacctgatcatcaactacaacatgtcgggctaatgactgtcactattactgttactcttcaaggcggaagatgcttgccgtgattttttaagcaccacgattttcagaggataatcacagaacatctgggtttctttttcttttcttttcttttcttttcttttttttttttttgagacagagtcttgctctgtcacccaggctggaatccagtggcacgatctcggctcaccgcaacctccgcctcccag

SEQ ID NO: 115521 - DNA, 601 bp, Human
actaatagaaatactttaaactatggagaccaaacagaaaaaagaaaggaagagaaatatgagaaggaggagaagacggcagggattcagtctggtcccaaatcttggcccatctcccactcccaacatcctagagtcacagattcactcaacatgagagctgaaggggccccaaacgctattggtccaacccctttgacagctggctaaggcaaggaccagatgtcctttgagtcccaggtctccaacaactcattgctgaaacagcacccaccatgttagaatgaatttacattggatyagtctgggtcataaaatgatcaatgtctattatgacaacatcacatgatcagcaagtcaccagaaatgttatggaatgtactttcctcttagccagaattgatcaccagggcagccgctgagcagaagcagcaaagcttccctccctcacagggaaggcacctgggacccacacaccaatctgctccatcctgaccctcagataaggtgcaaccatgtccctatgtcacgcagaggaatgctctaagactccattagggggaaaaaaagaaaaaaaaaagataagcaaggcatttgcaat

SEQ ID NO: 115522 - DNA, 601 bp, Human
aacatggacaaatgcaccccaaagcaaggaaagcccagctgacgggcaggttatgtttctaacatttgttttctcactcagtaattatttactgcatgtctactatacaacaagcctattctggaagctccgcagcaagaggagacaagataaagaccctgcacttgtggagcgtccattatggtgggggtgacagacgatagatacaaaatctacaaaaaatacagtgttcttgcttaagcattaggaagaaggacatggcaaggtacgggcacacacagcagtggcagaggagggctgstcccttggcaggaggtggcggatgatggcccgcgggccaagccagccgcagcttgtttttgtaaacaaagctttattagaacacggccatgcccattccttattgtctggcgctgcttttgtgtgttacaagggcagagttcagtcattgcaacagaaaccctgtggcctgcaagccctacaatatttgcagtcttgcctttgcaaaaagtgtttcaatccctgttgtataagacaatcagagagacttctccaaagaacaggcatttgagctgagaagtgaaggacaaagcgaagttta

SEQ ID NO: 115523 - DNA, 601 bp, Human
gggacaagaaatccccctcaccaccaccatcaacagccacacaggaggcccggggcttctcaagggggcatcaccaaaggcatgcatgccaagccccagatgccaactagcacgtgaacacaaagagagaatcacaacaaaaggaggaaaatagaagctaaatgtaacatggacaaatgcaccccaaagcaaggaaagcccagctgacgggcaggttatgtttctaacatttgttttctcactcagtaattatttactgcatgtctactatacaacaagcctattctggaagctccgcagsaagaggagacaagataaagaccctgcacttgtggagcgtccattatggtgggggtgacagacgatagatacaaaatctacaaaaaatacagtgttcttgcttaagcattaggaagaaggacatggcaaggtacgggcacacacagcagtggcagaggagggctggtcccttggcaggaggtggcggatgatggcccgcgggccaagccagccgcagcttgtttttgtaaacaaagctttattagaacacggccatgcccattccttattgtctggcgctgcttttgtgtgttacaagggc

SEQ ID NO: 115524 - DNA, 601 bp, Human
gtcaaacaaggtcacagttcccagatatgcagcacgggattggacccacaaggatccaacccacacaacctctccactggagttgagaggacaccactggcatttattaataacaacagctggagcggccagctgggatggccacgagggcccaagaaggaggctttcatccctccagtgagaagtgtgaatgggacccagagttccaggcctagaaaatgcaaagcttcccagcactgagacagcaccaaatcagggcaggatcaaaggcaactgttttgcctagacacccctcagaagracaaatctcccacaggagactgaaatcaagtcaatctgtgtttcagtcccactgtgaaaggagcaagggccacatgcattggggacaagaaatccccctcaccaccaccatcaacagccacacaggaggcccggggcttctcaagggggcatcaccaaaggcatgcatgccaagccccagatgccaactagcacgtgaacacaaagagagaatcacaacaaaaggaggaaaatagaagctaaatgtaacatggacaaatgcaccccaaagcaaggaaagcccagctgacgggcaggttat

SEQ ID NO: 115525 - DNA, 601 bp, Human
agaagacggagacagatgggaaggagggagaggagagaacgtccaacaaaggtcagtggaggcctgcttattcccaggagaagctgttcttgctctgcaaatggccccagcaggcatccacctctccccaagccccaggaagtcaggaagtatctggaagagcaaccagaggatacccccagaaaatctgtcctgacttagtttccacatcctatggggctttagaaacaaaccaaaccatagcatggaagaatattccacaagaaaatgtttaaattgattgccaaagcgtgcttgcacygtaatacctgcaaaaatctgttattgtggtatgttttatttgtaagaatgccgagttttacacatttgtacgtgaaacgtgactgtgcgccacacacacatacactctttattatttgtgctagacttggtctgttgccccaaggccaagcttcttaaaatgaaatgtctcaaactcaaggaaaactaagggatccctctacaagattttttgccatccagagttttcatgagctctcatgttcagatcagtactttgccggtttagagacctaattctgtgctgggtgagctgagacct

SEQ ID NO: 115526 - DNA, 601 bp, Human
caccccatccttagtccaactgatcacggcggcatctttcaacaggcagcgcacctctagcgactcccctggcgcagccacgtacacttctggttgagagatttggtatttggttggtggctctgcagaaaggtgggagagagaagacggagacagatgggaaggagggagaggagagaacgtccaacaaaggtcagtggaggcctgcttattcccaggagaagctgttcttgctctgcaaatggccccagcaggcatccacctctccccaagccccaggaagtcaggaagtatctggaasagcaaccagaggatacccccagaaaatctgtcctgacttagtttccacatcctatggggctttagaaacaaaccaaaccatagcatggaagaatattccacaagaaaatgtttaaattgattgccaaagcgtgcttgcactgtaatacctgcaaaaatctgttattgtggtatgttttatttgtaagaatgccgagttttacacatttgtacgtgaaacgtgactgtgcgccacacacacatacactctttattatttgtgctagacttggtctgttgccccaaggccaagcttcttaaa

SEQ ID NO: 115527 - DNA, 601 bp, Human
atcgtgaccctaggatgctctcaggcaacaggcctacaactgaaacgcagcccttcttttgcttgctaagccacaattttccattcaataaagcaagaataaatactctctccacctgatcgggttattggtggcatggacggaaccagcagccagcacagagcctgtctagtgcaggccctcagcatctttgcctccagcttcatgccagagccactggccaaaagaagtgagtgggccaggtgccgtggctcacgcctgtaatcccagcactttgggaggccgaggcgagcagatcacraggtcaggagatcgagaccattctggctaacatggtggaaccccatctctactaaaaaatacaaaaaattagccgggtgtggtggtgggcacctgtagtcccagctactcgggaggctgaggcaggagaatggcgtgaacccgggaggcggagcttgcagtgagccgagatagcaccactgcactccagcctgggcaacagagcaagactccgtccccaaaaaaaaaaaaaaaaaaaaaaaaaaagaggcgagtgacatgctccacttatcagtgctttttattaaataacaataatgat

SEQ ID NO: 115528 - DNA, 601 bp, Human
ctcctgaccttgtgatccgcctgcctcggcctcccaaagtactgggattacatccatgagccaccgcgcccgatctttaattcttcattgttatttttgccattgtatttggcacccaagcttttcgtactctgtacagaatctaaaaaacactctagcaggcagctgagcttgccttcttatgttaaccaacaaaattagatcaataatctagcaaatcagcagagggaataacctgcaatatatttttccaactggaagatacagaactaaattttcaatgtctcaatccaaaaggagaaaaaaaaaaaaaaaaaaaaaactcaaaaaagcccaaaaacgtcaccatcaacacagggtcactggagcatcatttgtcaaagttcctaaagaagaacatacaaacacaccccagtggcattttcagacaatcagaaggcaccaaagaaatcaatctggacacatgagtgttttccaggtggctgaaaatacaaagaatttggtgcttctgcaattttccctattaatcgggtcaggcatttgacacttgaggtggcaaaaaattgttttaatggcaacgtcccctttcctgccttgccaa

SEQ ID NO: 115529 - DNA, 601 bp, Human
tatgtaacagcattatttcctggcaaccaggcttgtaatgacatcacaggactgttccacttggaaacatctagtgctggtaccatgtgaggtcatcagctagtcagctgctaaaatatgaccagagaatgccctgcacatctgtgatgaagaaaccaacttaaaaagatcaatcaaatcagcccatggctgggtttttcaatgcatgtacaacatgatgttaatagatacagttttttgtttttttttttttttgagacggagtctcactctgtcgcccaggctggggtgcagtggcacratttcggctcactgcaacctccacttcccgggttcaagtgattctcctgcctcagcctcaggcgcccgccaccaagcccggctaatttttatattttagtagagatggagtttcaccatattggccaggctggtctcgaactcctgaccttgtgatccgcctgcctcggcctcccaaagtactgggattacatccatgagccaccgcgcccgatctttaattcttcattgttatttttgccattgtatttggcacccaagcttttcgtactctgtacagaatctaaaaaacactctagca

SEQ ID NO: 115530 - DNA, 601 bp, Human
tgggcatctgcaggtctcaacaggaatgaaaccaaaatagaaaattactttttctctcatcactcgagagaaagaaccactttagcagcaagagtcttgatgcaactgtctctccatcacttccctcgagttaagcaatggacctgaacttttcgtccatcatgatcttctcaaaaactaagtctcaagctcttcagaaacattaatcaccgaaacaagctggaaacaataaaaatccctcgaacaaatgggtatatgcatctacctagttgctgccagataacccattaacatacctagyacctagggaaggcaagaactagttaacttatacttttctatgcgaaaggataaattctcaacccttcaaaaccctcaacctggatgcatttcaaaaattagcatatgaaactgcaactttctttctggagaaaatgtgttgcaccgaggggcatatgtaacagcattatttcctggcaaccaggcttgtaatgacatcacaggactgttccacttggaaacatctagtgctggtaccatgtgaggtcatcagctagtcagctgctaaaatatgaccagagaatgccctgcacatctgtga

SEQ ID NO: 115531 - DNA, 601 bp, Human
caaccacagctcactgcagccttgacctcctgggctcaggtgatcctcccacctgagcctcccaagtaactgggactgcaggcatgagctaccacacctggctaatcttttattttttgtagagatgcggtcttgctatgctcccgaggctagtctcaaactcctgggtatacacgatcctcctgcttcggcctcccaactagctggaattacaggtgcgagctgctatgctggcccaaaccaacttattgatgatgttttcattacaaagggaatttctaaaaatttgcaaagcctgtgygggttttttgttgtttttattactgatattgttcttttcaattcctagaaacttcaacacaactaagaagcctgctgttaccaacttaggatctctaccaagtaaaaatcccaattagaacaaaggtgactttgaactgttatcggcaggttaatcaatgaaatgagtttggaatctcaggctaactaccttcattttccctaggtacttccaaaaaaaatagcctttctccctgacatggagtgtgggcatctgcaggtctcaacaggaatgaaaccaaaatagaaaattactttttct

SEQ ID NO: 115532 - DNA, 601 bp, Human
ttatctaaaatgaatctgcaggccaggcgcggtggctcacgcctgtaatcccagcctttgggaggccgaggtgggcggatcacctgaggtcaggagtccgagaccagcctgaccaacatggtgaaaccccgtctccactaaaaatgcaaaaattagctggacatggtgacgcatggctgtagtcccagctactagggagggtgaggcaggagaattgcttgaacccaggaggcagaggttgcagtgagccgagatcatgccattgcactccagcctgggcgacaagagcaaaactctgtcacaatcaatcaatcaatcaatcaatcaatatgaatctgcaagctaaggacacatgagtttccctgaactttatataccttagaggtgtatgaagagcgggcttaaagtcagctaatagagacgtgtggtataaacttccaatggcattcaaaatgaatgacactaatccacctgtaaaggaaacaaattaacctcgatgagaggtatggttcctttggctctgacattcttagaccttctgatgtaataggtaccacaagaatgatgttctcctaatcatcaaatactaagaatgagctgg

SEQ ID NO: 115533 - DNA, 601 bp, Human
cacccaggctcccatgtgtgaccagccccaccctggtgactgctaacatcacaccagcacacagcctctctttaaatatcaagctcacaaatatgtttaatgaacttgatacgggaggggaggaagtcttttttttttttttcctttttttgagacagcgtcttgctctgttgcccaggctggagtgcagtggcgcgatcttggctcactgcaagctctgcctcccgggttcacgccattctcctgcctcagcctcccgagtagctgggactacaggtgcccgccaccatgcccggctaatttttttttttttttttttgtatttttagtagagacagggtttcaccgttttagccagggtttcaccgttttagccaggatggtctggatctcctgacctcatgatccacctgcctcagcctcccaaagtgctgggattacaggcgtgagctaccgcgcccggctggaactcttttataattttacaatagctcttcctaaaatacactagctttatgtgaaccttgaatctgtaagatctagaaaaataataatactataagatagccctactgtgtttccttcatcagcagccttgtgt

SEQ ID NO: 115534 - DNA, 601 bp, Human
gatatgttaaagttatgccctccaaatgtccccgaaagtcataaatacaagtgattttttaaagtcaagaaaaaagttttaaatcacaaagtaaagtatattttttctaaataaaagccacaacatcaagccagaataccactgtaaattcttcatgtctgctaataatggcgaatgactactaccgactgaaagcttctactttgccaagcactgctcaaagagtttttacatgtcaacacattaatcttcacaatgcttcaacaagaaaggcactatcataatcttggcttccaagtgrggaaactgaggcacagagcagttaagtaacctgccaaaagccacaaagcttggaagaggtgcagccaagatttgaaccacatcagtctgatgccagagcccactatcttcaaccctactctccactgctaagaagatgcagcttctccacgaggttggaatccgtaccttccaccaatctgatgtttaaggctgaagtccgggaaagccagcctgggtcaaggcacacgtcctccttttttcctgtccagaacctctactgtacagcaatttaactattcacatatatgtttctgtctta

SEQ ID NO: 115535 - DNA, 601 bp, Human
ggaatgagcctctttgagctccagtgactccaggacctggggttggcttaacacatcattagcgaagatgatgccttaggtaactgaaggaaccttcccaggagatgagaaatgtgtctttccttttcaagtcccggaagcccttgggactcagtggaatttctaagagtttctggcatctccaaaatgaacgttcaatgccactgctgttgtgaaaagcccttgatcaacctaggctgaccacctctgcaactagcgggccaacctcccaggccgccccaccctacagccatagcctttytccaccagagaaccagaaaggagaggaccacgccagcacactgcatccaaatgtgtggccctctgccgcttttggccttttttttttttttttttttttttttttggtaaagcaaaatatattttaggtttttgtcccacacactgaaattccatttccttttccctccagaaacggctcagcgtgatacaacaaaatcactttggtcatctgcactccacaggggcaggctaaaggctttctgctgggagtcctcattttgcttttagaacataggtgctcttcatctagcgaaatgtt

SEQ ID NO: 115536 - DNA, 601 bp, Human
aaaatatcagagagaaaacccaacaccagggaccattctccccaaagtctgccttggtcaggccccaacaaggactctctgaggcaaacgcaggccatagccagccaaggagctccccatgggggaggcccacaggtgggaatgagcctctttgagctccagtgactccaggacctggggttggcttaacacatcattagcgaagatgatgccttaggtaactgaaggaaccttcccaggagatgagaaatgtgtctttccttttcaagtcccggaagcccttgggactcagtggaatttytaagagtttctggcatctccaaaatgaacgttcaatgccactgctgttgtgaaaagcccttgatcaacctaggctgaccacctctgcaactagcgggccaacctcccaggccgccccaccctacagccatagcctttctccaccagagaaccagaaaggagaggaccacgccagcacactgcatccaaatgtgtggccctctgccgcttttggccttttttttttttttttttttttttttttggtaaagcaaaatatattttaggtttttgtcccacacactgaaattccatttccttt

SEQ ID NO: 115537 - DNA, 601 bp, Human
ggggctccaggggaacctgaacccctgtaatacccaacgctgagggcttctgtgccaatttcacagtcacgttgaatgagccctctgtcctgcgatctctcttggtctatgcaggcacttcgaagtggcataaaagatggtttttaagaaccccctatgcctaaataattacctacgaaggaggtgagaattgaggtggtctattaattatctcagccagcttcttgcttttctgcattaaattgcaataactgtcctgagccctgtgaaatatctagccatgaaggtaacctctttattaaaaaaaaaaaaaaaaaatctgtgctgttgtttaagaagagaaatggctgatgctacacgatggtgatactattaaattatggttctcagagcctgaagggatcaggattattcagccaatcttcccattttaaggcaagggattctggggcacagagagctgaaaaaacttgcccatggtcaagactgacgcaaaagcccaggaataagtatgattagggagatagagttatgattcaagtcctttactattatatcaatcacatattaataacatccagcaagactttgctcatgcact

SEQ ID NO: 115538 - DNA, 601 bp, Human
aggactgggacagatacttgtacaccaattgctacaatggctattcacaatagccaaaaggtagaagcaacccaagtgatcatcatcagatgaatggataaacaaaatgtggggccgggcacagtggctcatgcctgtaatcccagcactttgggaggctgaggtgggtggatggcaagttcaggagatcgagaccagcctgaccaacatggtgaaaccctgtctctactaaaaatacaaaaattagccgggcatggtggtgagcacctgtaatcccatactcaggaggctgaggcaggaraatcgctcgaacctgggaggcggaggttgcagtgagccaaggttgcaccactgcactccagcctgggcaacagagtgaaactccgtcttaaaaaaaaaaaaaaaaaaaagtggtatatccatacaatggaatataattcagccataaaaaggaataaagttttgattcatgctacaatatggatggacttttgttaagtgaaataagccagacacaaaaggaaaaatatcctgatttcacttatataaggtacacagaataggcaaattcatagacacaaaaagtaggttagaggttacc

SEQ ID NO: 115539 - DNA, 601 bp, Human
gagacgccattcttatgttctccccctgcttttcaaatatttccatagactcaaattttcaaacttgcgagagttttccttaccacaaaatgcaacatcttgtatcttcagggtttgaggctttagtatttctatctgaatccaagtcattctctacaggtgttttggacaaggcactccagtgaaacgaaatgaaaaaataaacagtcaaggcctactaaccttagctatcatttcaggaatttcaactgaccttctgagccatgccctgggcattgcaagtgtttttgggttaatcacrtaaaaaacaaatacaggcagagcatctgcaagcacatgagtgatataagaaactagagaataaagaaaatcatctcgtaaccactccactataaaaacaggagggcagagcagctgtccactttgcaaagcagcgccagtgattagcctgccaacagagttaagagatgcgaagagcacactggagtgccacggttttcatgtcagccactcagttctatgcaagccatgactgcagggtggaggtactgctgctgagttctaaaacgaggtcgctgctcatcactgacagtcttagaaa

SEQ ID NO: 115540 - DNA, 601 bp, Human
acaccactgaatcatacgctcttttcaacaagactgattgccaggggattaacattagacagcacaattccattattcagcagcccaattcaaatcccaaccctaaactctaagagagatttcagggcttcacagggatgagccgccagaaagctcaaaggggaggtggggtgaggggcttttgaatgttttacataacaactcaacctaaaacttgctttaagcaagagcccagaccggagtggccgccatctgactccacgatgcctagaatggccccagcccagcctaatgaatgatktgtagacctatgcaaagctataatcccaaaagactgctatagctcaattattttttcccacaataaattacttaatttcaaaattaggtatttagaacatttagcccaaaatctctctttccctaaatagaaatagttttacgtcacattcggtacacacaggaacccaggtaaaggccaagtcatatgctctttgatcaatggatttacagtgtatcaatgccaacacaaatgttaatcattttcttctcaaatttgagtgttacttctctttttgtttgttttgtaaaatatctgaac

SEQ ID NO: 115541 - DNA, 601 bp, Human
ctttcactgggaaagggtttctgattttctgtgaaacagagaggtggctgaaaagctgttatcacacagcagtgtatcacatttgggcctgtgggctaccagaaattcactgcttaagcttgaatcctttttgtttccacttgctgagatgttcagaatgactgccaaccctgtacgtctatatgagcctctttagctgactcaattcttattttattagtgcttcgcaaagcaattactagggttttgagcagagatgagagtatttcacacttccatctttactgaaaatgccttttamtccactgacttttggcttctatttataaagaaggttcaaggcttggaaaattattggagttgagctttaatggatattcccaaccagcattgtgtcattattggcccgtgtttagctgggcgatctcccaaatttgtgacataatcaggcctctctctgcattactccatacactccacgctctctctacattacaccactgaatcatacgctcttttcaacaagactgattgccaggggattaacattagacagcacaattccattattcagcagcccaattcaaatcccaaccctaaa

SEQ ID NO: 115542 - DNA, 601 bp, Human
acttcgctttcactgggaaagggtttctgattttctgtgaaacagagaggtggctgaaaagctgttatcacacagcagtgtatcacatttgggcctgtgggctaccagaaattcactgcttaagcttgaatcctttttgtttccacttgctgagatgttcagaatgactgccaaccctgtacgtctatatgagcctctttagctgactcaattcttattttattagtgcttcgcaaagcaattactagggttttgagcagagatgagagtatttcacacttccatctttactgaaaatgcmttttactccactgacttttggcttctatttataaagaaggttcaaggcttggaaaattattggagttgagctttaatggatattcccaaccagcattgtgtcattattggcccgtgtttagctgggcgatctcccaaatttgtgacataatcaggcctctctctgcattactccatacactccacgctctctctacattacaccactgaatcatacgctcttttcaacaagactgattgccaggggattaacattagacagcacaattccattattcagcagcccaattcaaatcccaac

SEQ ID NO: 115543 - DNA, 601 bp, Human
cagtgaacatcaaatgaagaagtccgcttggagagcaaggagcattcatacagataggcgtggagaacacccagatggaggccccagctccagaatgcctgctccaagcccttacttagcaaatcacttaccccagctgaacctgaacttcctccactgcaaagtgggggaggggaggggtgggcgtaaagaagccaactccatgaacttcaagtcctcaaactccacacccctctcctgcaagtccaacagccaaatcagtctcaggatggccttgatgacagcattaatcaaaggtggmaacctcagcaggaaatgtcaatgtcagcctctggccacgtctgtaggtcccaaaatggctttttttttttttttttttttttttgagacggagtctcactttgtcgcccaggctggagtgcaatggcacaatctcagctcactgcaacctctgcctcctgcgttcaagcgattctcctgcctcagcctcctgagtagctgggattacaggtacctgccaccacccctgggtaatttttgtatttttggtagagacggggtttcaccatgttggtcaggctggtcttgaactcctgacctc

SEQ ID NO: 115544 - DNA, 601 bp, Human
gtctgtatttgccagtcagtacgtttggagtgatctagctgccactaaccagcctttgccccccgggatccctgttgtgaaacaggaatgaaaagctgctttgtagcaatcaaaagctcattaaacagtagctaccaaaggaagttttgaaatctctatcctggaggaaaggacaggactgacccctcctttcatcaggatgggctcagggtgcacggctctgtctggagatgcaagaggaagtatgggaccaacgcacaataacgactaacagttgcatggtactattatttaaaagcgytgcctctcctaccacctcctcctccccatagtgctacaaggaaacagtcatcaccccattttacaggcaaggaaactgaggctcagaggttccatgccttttctaaggccatagagttagcaagggtggaaacagaacttgacacccctctccacgtaatttccacctgaacctccagagagggcatctggcacagagtagagacccttaggggttgtctgtgacagcgatggtttataagaacaggatgagatggctgctggggacacgaaagcggcaaaaggaaggtgcttcctcctc

SEQ ID NO: 115545 - DNA, 601 bp, Human
atcaagccaaggtgtgctagcaaccacacatgagactcctcaagtgttaagtaatacccatggaaaaatgggctaaggacttaactatgcatttctccaagacacaaatggccactaggtgtatgaaaagtttctcaatgtcactaatcattagagaaatgcaaatcaaaaccacaaggagctatcacatgacacctgtcaggatgggaggaaaaaaaaaaaagacaagtgtcggcaaggatgtggagacactggaacccctgcacactgttggtgggaatataaaatgatgcagccaccrtggaaaacaatatggaggttcctcaaaaaattaaaaacagaactaccctaagatcctgcaatcccacttctctatttatctaaaagaactgcaatcaggatctgcactcctatattaattgcagcaccattaacaatagccaagaaatggaatcaatctaagtgtctgccaaaggattaatttttacaatgtggctatatacacaacggaatactattcagccatgaagaaggaggacatggtgcaatatgtgacaacgtggaagccatgatgctaagtgaaacaggatagtcacagaaa

SEQ ID NO: 115546 - DNA, 601 bp, Human
tgagaaccttgaggtagggcagcccgtcgggcccgtatttactgccgttcttttccacgtgcttgatccactggatgtggggctgggcatcactgtaaaccttgcagacaaactctacgtctcctccgaccactgtggaggcatttgccggcagtccggcttggaggatgggccggtgaggcgatcgctctggtggagagagggaagaaaggaggagtggggatgggagaatgagagaccaataaataagttgtgttgtccagagggctgtcagtgacctcatgccagaaaagcctcaagyctgctggctgacacctttgaaataacactgtggccccatgaataacagaaacgacttcaaaggagactgctggagcgcgacccttgtaaaaagaacacttacttagaaaattgagaaaagaacttattacatcccaggttattggctgtccactgccacctgatgaatacgggaagaaattctactctgacaatctaagtgacaaatggtaggggagggaagcttcttcacttatcctatttgagataatctcaaaaactcacctcaaccacaagcttaacatcacaggcaaatgacaag

SEQ ID NO: 115547 - DNA, 601 bp, Human
ccaaaaaaactgggctttttctcttttcattaataaacatttggatgtgagtcatgacaaacctaaaaagtcaaccttttgcctttagtagcgtccagtagtacattcattaagatgagctcccctcaaatttggtgcaacaaggtcaagaacagcaactcataaggatcaactatgcaaccaaagaaatgatgctttgttgaacaaattgcatcttgccaatatttccctaaaaacttgaagtagaaggagacaaactctgctgatactcaaatgccccgtattaaacaggcatggaagygtgtgttttaaatggtgttaatgtgcagtaatgatgggaaatgtgcagcctaaacaagatcaaccagaaggaacaacttaaaaactgggtgggggtggaggctaatctctagaagaaattggagcaagcactttgaacgttgtgggcatttttccatggctactggcatcataccagctgcatcaccgaagaaagattattataaatataccaaggccacaagagttatcctataagctgcctgcagtctcccaaagcaccaagtcttttcagcttctatatccagctttctttttaaaa

SEQ ID NO: 115548 - DNA, 601 bp, Human
accacgcccggccaggctgaattctcttaaagaaaaaatataaatggtattgcatgtgagtatacatataattacttaatttagaacattcttatgtcaacttccaatgtctgccctcttcttagtcctcaaggatccatccacaagcagtatatttccaaatactatttttctcaaactgtattcttagatggacagtgaagaaaagccagctggcactggggaaagaaaacacgatgactgtggctgagtcagggggattttaagggcatcttacccttctatattaagtaaaaagaamagcattttaacagttgcagaaaaaaagatgatgagataattaaggggcagtggcctagctatgccaaattacaagttgcctccagaagttaccatttttccctgttagaaaaaaaataatagaaaccatgtaagagttatctcaggactggactcttctagaaactggttggccaactggcctcatctttgctttcctggccccaagaaagataatcatgtcactcaaaatgacaacagcattcttggtggcagacgtgacccaacaggcccctcttttccatgctgttaacacaatttg

SEQ ID NO: 115549 - DNA, 601 bp, Human
gggttcaaaggatcctcccgcttcagcctcctgtggagctaggattacaggcatttaccatcaaataaccttggaaccactggtgaatgtgacaggctgtgtcttacatgtaacctgatttataccccgcacttagtaaattatgatgaataaataaagaaaggagggaagaaaaagaggaaggaactctgatgttccctctggtaacacagggaagagaggaaaaaggaccaacttaggctgaattctctctctttttttttaaagacggagttttactcttgttgcccaggctggagcrcaatggtgtgatcttggctcattgcaacctccacctcccaggttcaagtgattctcctgcctcagcctcccaagcagctgggactacaggcatgcaccaccacacccagctaatttttgtacttttagtagagacgaggtttcaacatgttagtcaggctggatggtctcgaactcctgacctcgggtgatccacgcgcctcagcctcccaaagtgctgggattacaggcgtgagccaccacgcccggccaggctgaattctcttaaagaaaaaatataaatggtattgcatgtgagtat

SEQ ID NO: 115550 - DNA, 601 bp, Human
ctgttatactccttggccctactgaacacaagccaattacattttcttttttttcccactttgggtttttgttttgttttgttttgttttgttttttgagttggagtctcgctgtgttggtcaggctggtcttgaactcctgggttcaaaggatcctcccgcttcagcctcctgtggagctaggattacaggcatttaccatcaaataaccttggaaccactggtgaatgtgacaggctgtgtcttacatgtaacctgatttataccccgcacttagtaaattatgatgaataaataaagraaggagggaagaaaaagaggaaggaactctgatgttccctctggtaacacagggaagagaggaaaaaggaccaacttaggctgaattctctctctttttttttaaagacggagttttactcttgttgcccaggctggagcgcaatggtgtgatcttggctcattgcaacctccacctcccaggttcaagtgattctcctgcctcagcctcccaagcagctgggactacaggcatgcaccaccacacccagctaatttttgtacttttagtagagacgaggtttcaacatgttagtcaggc

SEQ ID NO: 115551 - DNA, 601 bp, Human
cagagaaagaaactgatgtgctcgatgtaaaactgattcagcaaacccagcaacaccgcacgtctcctaaacaggcatcctcagtttcctctgcactccatcctccacccacccctacaccttcccccaccacccaattgatgtgtggaaaacacagaaagtaatgctgccccctttaactcacaaaggctgcttcacactggtcactggctgtccagcagacctgtaccagaaccaacacgctcacaaagatgcccctctctgggctggctgttgttggtctcatttaactcgctgggcrccaaaggagtgggagtgggtgagcagtgtctggcacggtgcccaagccctgacactgaatgtgacatgagcctccatcaaaggacacagggagatgccacctgccatctgcctcccaccacccaaaagttgcttctccttcttcaaccatgtgcatacaaagtctcaaaaaattcacgcttactaggaaatgattgcaaggaatttcttctttggtactggaaaaaaatatttttgctcaaaaaaataacataaactgaaacgtctgtgttacaccagtaagtctagtgcaaattaataa

SEQ ID NO: 115552 - DNA, 601 bp, Human
cacaggagatgaatttatctggacggagccaaccataagacagttaaatctccatcctaccctatggaagcttcaagccccagagaaagaaactgatgtgctcgatgtaaaactgattcagcaaacccagcaacaccgcacgtctcctaaacaggcatcctcagtttcctctgcactccatcctccacccacccctacaccttcccccaccacccaattgatgtgtggaaaacacagaaagtaatgctgccccctttaactcacaaaggctgcttcacactggtcactggctgtccagcakacctgtaccagaaccaacacgctcacaaagatgcccctctctgggctggctgttgttggtctcatttaactcgctgggcgccaaaggagtgggagtgggtgagcagtgtctggcacggtgcccaagccctgacactgaatgtgacatgagcctccatcaaaggacacagggagatgccacctgccatctgcctcccaccacccaaaagttgcttctccttcttcaaccatgtgcatacaaagtctcaaaaaattcacgcttactaggaaatgattgcaaggaatttcttctttggtactg

SEQ ID NO: 115553 - DNA, 601 bp, Human
tacttataaacaatcaacacgaacactctagtaaactgttttcccactcccgaatcttggcaggcatttttttttaagcatgtattttcacagactccaattccatttcctcactttccggaatctctccagcatgtgccataagtcaagcttttaagtaaatgtgcttttcgtacatttccatagtacatatgggagattaagtgaggaagtgttttttttttttcctttctttttaaagggccaccaagaaacagtgttatctgtttcttttctttttttttttttttttttttttttkggtttgagacagagtttcactctcattatccaggcacgatcttggctcactgcaacccccgcctaccgggttcaagtgattctcctgcctcagcctcccaagtagctgggattacaggcatgtaccaccacgcccagctaattttgtatttttagtagacacatggtttcatcacgctggtcaggctggtctcgaactcctgacctcaggtgatccacctacgtcggcctcccaaagtgctgggattacaggtgtgggccactgcgcccggtctaacagtgttatctctttatactgaat

SEQ ID NO: 115554 - DNA, 601 bp, Human
attctcttgttagtgataagtgagttacttataaacaatcaacacgaacactctagtaaactgttttcccactcccgaatcttggcaggcatttttttttaagcatgtattttcacagactccaattccatttcctcactttccggaatctctccagcatgtgccataagtcaagcttttaagtaaatgtgcttttcgtacatttccatagtacatatgggagattaagtgaggaagtgttttttttttttcctttctttttaaagggccaccaagaaacagtgttatctgtttcttttcytttttttttttttttttttttttttggtttgagacagagtttcactctcattatccaggcacgatcttggctcactgcaacccccgcctaccgggttcaagtgattctcctgcctcagcctcccaagtagctgggattacaggcatgtaccaccacgcccagctaattttgtatttttagtagacacatggtttcatcacgctggtcaggctggtctcgaactcctgacctcaggtgatccacctacgtcggcctcccaaagtgctgggattacaggtgtgggccactgcgcccggtcta

SEQ ID NO: 115555 - DNA, 601 bp, Human
ttcttcaattcctacctagaaacttcaattccagagtttcattcctaaccaattttaacatattctcttgttagtgataagtgagttacttataaacaatcaacacgaacactctagtaaactgttttcccactcccgaatcttggcaggcatttttttttaagcatgtattttcacagactccaattccatttcctcactttccggaatctctccagcatgtgccataagtcaagcttttaagtaaatgtgcttttcgtacatttccatagtacatatgggagattaagtgaggaagtgttttttttttttcctttctttttaaagggccaccaagaaacagtgttatctgtttcttttcttttttttttttttttttttttttttggtttgagacagagtttcactctcattatccaggcacgatcttggctcactgcaacccccgcctaccgggttcaagtgattctcctgcctcagcctcccaagtagctgggattacaggcatgtaccaccacgcccagctaattttgtatttttagtagacacatggtttcatcacgctggtcaggctggtctcgaactcctgacctcaggtgat

SEQ ID NO: 115556 - DNA, 601 bp, Human
ttggagcctagggtggttctgtgtgtaagatacagtcagtcctccatatctgtgggttccgcattcatggtttcaaccaatcacagatcaaaaatatttgaaagctaattaataaaaaataacaatacaacaattttaaaatacaaataaaaaacaatacagtataacaactatttacatagcatttacaacgcgttagttattacaggtatcactagaaatgactaagtatatgagaggatgtacacagttcatatgcaaatactacaccattttaaataaaggtcttgggcatccacakattttggtatattcggggttgttagaaccaatccccaacgcataccaagcgacgattgtactgtcaaactgtgtgcaaccaggaagataacccagtgacattaaaggctgactgcagaagatatgccttagtgggcatgtctgatttgctagatgaggccctctgctcactgccaaggatgggctggggttctagtaagcaggagatgaagaatccaggagtcagggaatcatctcagggcaggaggaaaactggacagtaagagggtcctaatgacaaatatggcttaggggttacctc

SEQ ID NO: 115557 - DNA, 601 bp, Human
ggctaggagctcaaattctgcccactgactccatgccccacacgatgatcctgctgaggtttgcagttcagagctcccaggttaccaccacgtgaagggaaatgaaaggaaaactcgcacaagccaagaactctgctcagtcctgggaggtctgaaccaccaccctcattttatgagaatgaatttcagagaatcaggtgcctcacccgaggttgcccagccactgtctggcaaagccaggattcaaatgcagcccaacggagctccagtacgtggagttcaagcgagaccaagagatacrtagccccaacaccacccaggtggccatattttgactaaacatctgattggcacacctctgtatcatccaacaaggaaaatattatggatcacagaaattagatgtcaggtaccatatttgaagcttttcagcccaatatgacattaataaccaatgagaacagcaacactgggtagcggtccttaaggccatttatattctgcatctaatttctccacagaagtgaacagagaacagtcttgttctagtaaccaaaagctagaatgtcagatctgttttataaattggataattctactt

SEQ ID NO: 115558 - DNA, 601 bp, Human
cagccacataagctacctctcccttccaaatagagctcatcagatcagtctctggaagagcttatctttgcatttccaaatgtgtataggtacacatgagaagtgtatataatctgaggagctactgaaaatgtcaaggcaaacagggtagctgcttataagcaagtcaagagcttattccagtgtatgtgatgcagaagtagtcagcatttccaccttcccgtactctcaagctgtgacgacaaaaagtaccccagaagtgagtggacagccctacaatgaccactgcacttcctttcakaaggaggatctaggggtcggtccctgcctagaggacgagggctaggagctcaaattctgcccactgactccatgccccacacgatgatcctgctgaggtttgcagttcagagctcccaggttaccaccacgtgaagggaaatgaaaggaaaactcgcacaagccaagaactctgctcagtcctgggaggtctgaaccaccaccctcattttatgagaatgaatttcagagaatcaggtgcctcacccgaggttgcccagccactgtctggcaaagccaggattcaaatgcagcccaacgg

SEQ ID NO: 115559 - DNA, 601 bp, Human
tttatgtcccaccgccttgctactacaagcataacaatcctttctttgtataacttctgcctccgatctaataaactgcttctaaatagccttcattcattggaaatctgttccacctacgtttgcgctaaacactgttttgaaatgtttagcactcagattttccacactcagggtaccccgggtgggaggtaacagttgggcacatacagacttccactgttgactgtggtgtcacaggtggcaaaaactatggactaaacccgaaagctgcaatttcttaaaatatgatcacaactcyccagttcagttatatatataggaatgtgcacatgaacctatctgtgtatataatcacacacaaactagggctggcggagttcacaagaaacatccatttctccacatcctacaggtaaagaaaccattctttgtgttttctctggtgccccaccagtaaatgtccaattaacatgccttgagtgaatgaataagtgaatgagtgagtggtcttttcactacagtatacaaatcaactggaaattacttccattaacactctaaccaaataatatccatacaattattcagtcctagctaa

SEQ ID NO: 115560 - DNA, 601 bp, Human
acctccctttttgcaatatcccatgtaactctgagctccattagcaaaaccagaagttccgccaaaagagatgagaagcctgggtcctccccacacctggccctggtacgcagccaggggctgcctcagtcagtggtgccatgacacctggggcaagacagcacagtgttcctccccggcatcaggctccaaggtggggaacatctcaaagcactctagttttccttgggagtcactcagataaacagccttttaaaaaacccaaaaaacaaaatgcacatcttgttgacaaagtccagcytgctacttccccttgggagggatgtgatgactatcccatgagaacccacaaaagaaagacaaagcctaactccagagcgcctgcgacatgcccagcaccatatcccaaggatgggcctctctgcctggaaacgtgggaaacactcggcatgggatcttctttccgagatccctacaagaggatttataatgtgacagttccctataactcttctcataaaagaatactgcaggacgaataagttaatggttaaaagttctttaagttctttggacatgggcatgaagcagggttggaagg

SEQ ID NO: 115561 - DNA, 601 bp, Human
cagccataacaaacagtaggcaatgaacatctctgtacatgttcccttacacacgtgtgcaataatttctccatggtataggctcggggttggcagactacagcctgcaagccaaatcctgcctaccgcctgtttgggtaattaaattttattggcatgcagccaggtccattcatttctgtacttctagcactgctttctcactactatggcagacacgagaagttgcgacaaagaccatacggcccacaaaagtctaaaatatctacgacctccctttacagaaaaagttcaccaattmctatatagacctacaagagaaattgctaagtcaaagataggcgttttcaagtttactaattacttagcaaattgatttcaaagtgccagtaaacattcaatggaagaagccagggtctctctcccccagggaaaataacgtattccttcataccgctttctcctcttttaagctattcttgggagctcagccatctgtgacccacagcaagatgtggattcttcaatccctgttttaagggaagaacttctcaaccaaaacataggatcttattctgacaaatctctcttagcacttaca

SEQ ID NO: 115562 - DNA, 601 bp, Human
aaagtttttcttaaattaaaaagaaaaaaggcaaaaccccgtctctaccaaaacaaaaaacaaaaaacacaaaacttagccaggcatggtggcacatcctcgtactcccagctactcaggaggttgaggtgggaggctcacctgaacccaggaggtcaaggctgcagtgagctgtgattatgccacggcactccagcctgtttgaaagaaagaaaaaaccatccagaacatggggtagctctgggccatgttcctatgtggccagagagtagagctgaggtgcagccatccctcgaatctatgcactctgagtgatccgcaggccttggtggtgtgactggcatggccccatggagacttgagtttgtgactcttcaggcaacccagacccccagtgacagagggtgcacgccgaccagaggatctcacctctttggggacccaaggaattcctggcactgcaataaactgcaatgcaggtaggagcaaggcccacctctgcacaggaggcagctccgcccctccgcttccctatgtgtggggctgacaagggagttttgggtcatccaaaatgcctccgaggacatctgggcacctgtct

SEQ ID NO: 115563 - DNA, 601 bp, Human
tttttatacgaaaaagatctgaaaaagtcttaaactctaaactctcctgaaaaaatgtttttaaagtttttcttaaattaaaaagaaaaaaggcaaaaccccgtctctaccaaaacaaaaaacaaaaaacacaaaacttagccaggcatggtggcacatcctcgtactcccagctactcaggaggttgaggtgggaggctcacctgaacccaggaggtcaaggctgcagtgagctgtgattatgccacggcactccagcctgtttgaaagaaagaaaaaaccatccagaacatggggtagytctgggccatgttcctatgtggccagagagtagagctgaggtgcagccatccctcgaatctctgcactctgagtgatccgcaggccttggtggtgtgactggcatggccccatggagacttgagtttgtgactcttcaggcaacccagacccccagtgacagagggtgcacgccgaccagaggatctcacctctttggggacccaaggaattcctggcactgcaataaactgcaatgcaggtaggagcaaggcccacctctgcacaggaggcagctccgcccctccgcttccctatgtgt

SEQ ID NO: 115564 - DNA, 601 bp, Human
ttaatatgggtacttccgttcttccacgattaaatggatgcatttgccctgcttagcaaagttcgtctcttagttttctctctgccagctccaaaacaggaaggagctctgggtcctcagggctagggtgggcaggggtaccaccactgcctctaggaccaggactcaacacccgtgcttctcaccagtctgagcgccgaggctctactacctgccccctccttcctgaagctcccatgtggggcctctgtgctccgtgtcctgattttcctactgctcaggctgtgcctgctcggcctcygctgctgtttctggtgctttcagtcaatctctagatttgagaattttctcaggacctgacttcaggcttctattctcctcttccaagcttctccgcagatgagtttgtccacgcccatggcttgaactcacagctccctttgctgcctcccagctgttagcccaccctcagagctgagctgctgcctgcagcttcttcattatctccccttggatgactcagatacgctcaagacgagctcggattttccacccaaatctatgccccctgccccagccctgattcccaagtcctcccaga

SEQ ID NO: 115565 - DNA, 601 bp, Human
aagtaatcaaaggcaagccaaatccccgtcatccacaggaatgtgagctgttctccagcacagggagctgaccattttatacaattagggccctgggacagtttggtgttccataggtgaaggtcagtgggtcactaagggaaggaagaccaacatccctatgatgtagacagtatgccctgtgcccagtatggctgatgacatcgaattcctgcggcaacctatgacatggatagtgttatacccattttacaggtggggaagctggggcttcactaaaaaaactgctcaggctgagcgyggtggctcacacctgttatcccagcactttgggaggccaaggcaggcggatcccgaggtcaggagatggagaccaccctggctaacacagcgaaaccccatctctactaaaaacacaaaaaattagccgggcgtggtggcaagcgcctgtagtcccagctacttgggaggctgaggcaggagaatcgctagaacctgggaggcagaggctgcagtgagccgagatagcgccactgaactccagcctcggcaaaagagctagactctgtctcaaccaaaaaaaaaaaaaaaactgctcagg

SEQ ID NO: 115566 - DNA, 601 bp, Human
aagaaagtaatcaaaggcaagccaaatccccgtcatccacaggaatgtgagctgttctccagcacagggagctgaccattttatacaattagggccctgggacagtttggtgttccataggtgaaggtcagtgggtcactaagggaaggaagaccaacatccctatgatgtagacagtatgccctgtgcccagtatggctgatgacatcgaattcctgcggcaacctatgacatggatagtgttatacccattttacaggtggggaagctggggcttcactaaaaaaactgctcaggctgrgcgtggtggctcacacctgttatcccagcactttgggaggccaaggcaggcggatcccgaggtcaggagatggagaccaccctggctaacacagcgaaaccccatctctactaaaaacacaaaaaattagccgggcgtggtggcaagcgcctgtagtcccagctacttgggaggctgaggcaggagaatcgctagaacctgggaggcagaggctgcagtgagccgagatagcgccactgaactccagcctcggcaaaagagctagactctgtctcaaccaaaaaaaaaaaaaaaactgct

SEQ ID NO: 115567 - DNA, 601 bp, Human
aaaagaaagtaatcaaaggcaagccaaatccccgtcatccacaggaatgtgagctgttctccagcacagggagctgaccattttatacaattagggccctgggacagtttggtgttccataggtgaaggtcagtgggtcactaagggaaggaagaccaacatccctatgatgtagacagtatgccctgtgcccagtatggctgatgacatcgaattcctgcggcaacctatgacatggatagtgttatacccattttacaggtggggaagctggggcttcactaaaaaaactgctcaggcygagcgtggtggctcacacctgttatcccagcactttgggaggccaaggcaggcggatcccgaggtcaggagatggagaccaccctggctaacacagcgaaaccccatctctactaaaaacacaaaaaattagccgggcgtggtggcaagcgcctgtagtcccagctacttgggaggctgaggcaggagaatcgctagaacctgggaggcagaggctgcagtgagccgagatagcgccactgaactccagcctcggcaaaagagctagactctgtctcaaccaaaaaaaaaaaaaaaactg

SEQ ID NO: 115568 - DNA, 601 bp, Human
tatgatttttcctttctacaaatgatacgctactgtgagctgctgcatttttgttacactttcatatagcaagatttccacaagatacaaggtaattagggtctccaatcatcaccttctattttgggaagagataagacacaaagaagcaaatatcaccaccgaagccttttacactggttattggcaaaggttaactatcatacgaagcagaaagtcttatcagtccattcaacaaggctgaaatgggggcgatcttaggcactccacgaaatggacaattaaaaaaggggcaagctaygtgatccctgaaatataaataaggaattatttgattccaccccgacccctagctattccttgtgttcacacacttctgggcctcccgggtagcctaagcccagaagcgggaaagcaagaaagccacgcaagcttgcaatccctggccaggttggaagcaggaaacatgagagctcacagaagctgcctggagattcgtctggggctgcagccctgttcccagttttggaggcctgttcaaattgaacttccaagccccgggccaaactctcccggtggtgtgctcctgccgacacgcgct

SEQ ID NO: 115569 - DNA, 601 bp, Human
gattataggcgtgagccaccacgcccggcctatgatttttcctttctacaaatgatacgctactgtgagctgctgcatttttgttacactttcatatagcaagatttccacaagatacaaggtaattagggtctccaatcatcaccttctattttgggaagagataagacacaaagaagcaaatatcaccaccgaagccttttacactggttattggcaaaggttaactatcatacgaagcagaaagtcttatcagtccattcaacaaggctgaaatgggggcgatcttaggcactccacraaatggacaattaaaaaaggggcaagctacgtgatccctgaaatataaataaggaattatttgattccaccccgacccctagctattccttgtgttcacacacttctgggcctcccgggtagcctaagcccagaagcgggaaagcaagaaagccacgcaagcttgcaatccctggccaggttggaagcaggaaacatgagagctcacagaagctgcctggagattcgtctggggctgcagccctgttcccagttttggaggcctgttcaaattgaacttccaagccccgggccaaactct

SEQ ID NO: 115570 - DNA, 601 bp, Human
tagcgggtctctacgcttccaaacttagccctgttgtacctcctccatgtcccatgactaaggttcctgaaatgactagtcatgtcctttcttggtctctaccatggccaatgcccgtctatccacgttctcagtccagtttctcctaacacctggcctcagcctgaatgtgccacatacactgattctaaacactgaaatattaaatacttgctgcagaacagctaatttattgtcttgacactaactcttgggtctcagaaagatctagctattacgacttttccttctttttttttttttttttttttttgagacggagtttcactcttgtttcccaggctagagtgcagtggcacgatcttggctcaatgcaacctctgcctcccaggttcaagtgattctcctgccctcagcctcccaagtagctgggattgcaggtgcccaccaccacatcaggctaattttgtatttttggtagagatagggtttcaccatgttggtcaggctggtctcaaactcctgacctcaagtgatccacccgcctcggcctcccaaagtactgggattataggcgtgagccaccacgcccggcctatga

SEQ ID NO: 115571 - DNA, 601 bp, Human
tttgtatttttagtagagacggggtttcaccatgtcggtcaggctggtctcgaactcctgacctcaggtgagccacccgcctcggcctcccaaagtgctaggattacaggtgtaagccaccacacccagcccctctgtttagttttatcccgtccccttccctcagctgcctctctgtctctccctgccctcttagaatctctggctggctcttctctttttctgtcccttcaaatagaggaattgttccattaagtttatgtatttccatatatcctcaaggcattaattctaaacacayacaaaatatgcgcaagttcgtatctccatcatgacctccctcctgagacccatgttctcattttcaactgtctatgggacacttccccactgacattcccttgacgtctcaaattcaaggtttcaactcctccaatgctttgtctctcttaatcggagagctatacaccggtattctttacacattcctcccaagtcctgttgatttcaactccaaaatgccttcccatgtgtccacaccatgcctttcccactgctaatgccttagtccaggccatcttcactgtctgcccctccccct

SEQ ID NO: 115572 - DNA, 601 bp, Human
cgttggttaaaatccaacattgtgtcttcttcattcctggtcacttctcaaacattctaatctgtgttccactcttgcctctcctgaagcttatgaagaacctctgaattgttagacgcaaatgacgtcctccaactcctcagttgttcctcctctgtggcttcagatgctattgatttcttgcttgttttttaaaatggtccctctgtttaggttttcttgtttttgttttttttgttttaacatggagtcttgtccttgtcgcccaggctggagtgcaatggtgcgatcttggctcacygcaacctccgcctcctgggttcaagcgattctcctgcctcagcctcccgagtagctgagattacaggtgcctgccaccacacccggctaatattttgtatttttagtagagacggggtttcaccatgtcggtcaggctggtctcgaactcctgacctcaggtgagccacccgcctcggcctcccaaagtgctaggattacaggtgtaagccaccacacccagcccctctgtttagttttatcccgtccccttccctcagctgcctctctgtctctccctgccctcttagaatctctggct

SEQ ID NO: 115573 - DNA, 601 bp, Human
tgtatctgatcatcctaaaatcttttctctcaacacttgctctcctgccctttaaacctgaattttcagaagcgttggttaaaatccaacattgtgtcttcttcattcctggtcacttctcaaacattctaatctgtgttccactcttgcctctcctgaagcttatgaagaacctctgaattgttagacgcaaatgacgtcctccaactcctcagttgttcctcctctgtggcttcagatgctattgatttcttgcttgttttttaaaatggtccctctgtttaggttttcttgtttttgttttttttgttttaacatggagtcttgtccttgtcgcccaggctggagtgcaatggtgcgatcttggctcactgcaacctccgcctcctgggttcaagcgattctcctgcctcagcctcccgagtagctgagattacaggtgcctgccaccacacccggctaatattttgtatttttagtagagacggggtttcaccatgtcggtcaggctggtctcgaactcctgacctcaggtgagccacccgcctcggcctcccaaagtgctaggattacaggtgtaagccaccacacccagcccctc

SEQ ID NO: 115574 - DNA, 601 bp, Human
ataagaaatacagtgtggccgggtgcggtggctcatgcctgtaataccagcactttgggaggtcaaggtgggcggatcacttgaggtcagtagttcgagaccagcctggccaacacggcaaaatcccatctctgctaaaactacaaaaattagccgagcgtggtggtgtgcacctgtagtcccagctactcaggaggctgaggcacaagaatcacttgaacctgggagacagaggttgcagtgagctgagatcacgccattgcactccagcctgggtgacagagtgagactctgtctcaaaaaaaaaaaaaaaaaaagaaagaaaagaaaagaaaacgcagtgtggctctaagattaagaagacaggtcaactgggatcatcggagagcctggaacacgacatgtatttgttttggaattataaataaatagaatgatcattttgaagagcgaaggtagactaaataaccatattctcttctacctccagttgtccagccacaccagtgtctttctttcagctgcttatagatctgtatctgatcatcctaaaatcttttctctcaacacttgctctcctgccctttaaacctgaattttc

SEQ ID NO: 115575 - DNA, 601 bp, Human; identical to SEQ ID NO: 115482

SEQ ID NO: 115576 - DNA, 601 bp, Human; identical to SEQ ID NO: 115483

SEQ ID NO: 115577 - DNA, 601 bp, Human; identical to SEQ ID NO: 115484

SEQ ID NO: 115578 - DNA, 601 bp, Human; identical to SEQ ID NO: 115485

SEQ ID NO: 115579 - DNA, 601 bp, Human; identical to SEQ ID NO: 115486

SEQ ID NO: 115580 - DNA, 601 bp, Human; identical to SEQ ID NO: 115487

SEQ ID NO: 115581 - DNA, 601 bp, Human; identical to SEQ ID NO: 115488

SEQ ID NO: 115582 - DNA, 601 bp, Human; identical to SEQ ID NO: 115489

SEQ ID NO: 115583 - DNA, 601 bp, Human; identical to SEQ ID NO: 115490

SEQ ID NO: 115584 - DNA, 601 bp, Human; identical to SEQ ID NO: 115491

SEQ ID NO: 115585 - DNA, 601 bp, Human; identical to SEQ ID NO: 115492

SEQ ID NO: 115586 - DNA, 601 bp, Human; identical to SEQ ID NO: 115493

SEQ ID NO: 115587 - DNA, 601 bp, Human; identical to SEQ ID NO: 115494

SEQ ID NO: 115588 - DNA, 601 bp, Human; identical to SEQ ID NO: 115495

SEQ ID NO: 115589 - DNA, 601 bp, Human; identical to SEQ ID NO: 115496

SEQ ID NO: 115590 - DNA, 601 bp, Human; identical to SEQ ID NO: 115497

SEQ ID NO: 115591 - DNA, 601 bp, Human; identical to SEQ ID NO: 115498

SEQ ID NO: 115592 - DNA, 601 bp, Human; identical to SEQ ID NO: 115499

SEQ ID NO: 115593 - DNA, 601 bp, Human; identical to SEQ ID NO: 115500

SEQ ID NO: 115594 - DNA, 601 bp, Human; identical to SEQ ID NO: 115501

SEQ ID NO: 115595 - DNA, 601 bp, Human; identical to SEQ ID NO: 115502

SEQ ID NO: 115596 - DNA, 601 bp, Human; identical to SEQ ID NO: 115503

SEQ ID NO: 115597 - DNA, 601 bp, Human; identical to SEQ ID NO: 115504

SEQ ID NO: 115598 - DNA, 601 bp, Human; identical to SEQ ID NO: 115505

SEQ ID NO: 115599 - DNA, 601 bp, Human; identical to SEQ ID NO: 115506

SEQ ID NO: 115600 - DNA, 601 bp, Human; identical to SEQ ID NO: 115507

SEQ ID NO: 115601 - DNA, 601 bp, Human; identical to SEQ ID NO: 115508

SEQ ID NO: 115602 - DNA, 601 bp, Human; identical to SEQ ID NO: 115509

SEQ ID NO: 115603 - DNA, 601 bp, Human; identical to SEQ ID NO: 115510

SEQ ID NO: 115604 - DNA, 601 bp, Human; identical to SEQ ID NO: 115511

SEQ ID NO: 115605 - DNA, 601 bp, Human; identical to SEQ ID NO: 115512

SEQ ID NO: 115606 - DNA, 601 bp, Human; identical to SEQ ID NO: 115513

SEQ ID NO: 115607 - DNA, 601 bp, Human; identical to SEQ ID NO: 115514

SEQ ID NO: 115608 - DNA, 601 bp, Human; identical to SEQ ID NO: 115515

SEQ ID NO: 115609 - DNA, 601 bp, Human; identical to SEQ ID NO: 115516

SEQ ID NO: 115610 - DNA, 523 bp, Human; identical to SEQ ID NO: 115517

SEQ ID NO: 115611 - DNA, 601 bp, Human; identical to SEQ ID NO: 115518

SEQ ID NO: 115612 - DNA, 601 bp, Human; identical to SEQ ID NO: 115519

SEQ ID NO: 115613 - DNA, 601 bp, Human; identical to SEQ ID NO: 115520

SEQ ID NO: 115614 - DNA, 601 bp, Human; identical to SEQ ID NO: 115521

SEQ ID NO: 115615 - DNA, 601 bp, Human; identical to SEQ ID NO: 115522

SEQ ID NO: 115616 - DNA, 601 bp, Human; identical to SEQ ID NO: 115523

SEQ ID NO: 115617 - DNA, 601 bp, Human; identical to SEQ ID NO: 115524

SEQ ID NO: 115618 - DNA, 601 bp, Human; identical to SEQ ID NO: 115525

SEQ ID NO: 115619 - DNA, 601 bp, Human; identical to SEQ ID NO: 115526

SEQ ID NO: 115620 - DNA, 601 bp, Human; identical to SEQ ID NO: 115527

SEQ ID NO: 115621 - DNA, 601 bp, Human; identical to SEQ ID NO: 115528

SEQ ID NO: 115622 - DNA, 601 bp, Human; identical to SEQ ID NO: 115529

SEQ ID NO: 115623 - DNA, 601 bp, Human; identical to SEQ ID NO: 115530

SEQ ID NO: 115624 - DNA, 601 bp, Human; identical to SEQ ID NO: 115531

SEQ ID NO: 115625 - DNA, 601 bp, Human; identical to SEQ ID NO: 115532

SEQ ID NO: 115626 - DNA, 601 bp, Human; identical to SEQ ID NO: 115533

SEQ ID NO: 115627 - DNA, 601 bp, Human; identical to SEQ ID NO: 115534

SEQ ID NO: 115628 - DNA, 601 bp, Human; identical to SEQ ID NO: 115535

SEQ ID NO: 115629 - DNA, 601 bp, Human; identical to SEQ ID NO: 115536

SEQ ID NO: 115630 - DNA, 601 bp, Human; identical to SEQ ID NO: 115537

SEQ ID NO: 115631 - DNA, 601 bp, Human; identical to SEQ ID NO: 115538

SEQ ID NO: 115632 - DNA, 601 bp, Human; identical to SEQ ID NO: 115539

SEQ ID NO: 115633 - DNA, 601 bp, Human; identical to SEQ ID NO: 115540

SEQ ID NO: 115634 - DNA, 601 bp, Human; identical to SEQ ID NO: 115541

SEQ ID NO: 115635 - DNA, 601 bp, Human; identical to SEQ ID NO: 115542

SEQ ID NO: 115636 - DNA, 601 bp, Human; identical to SEQ ID NO: 115543

SEQ ID NO: 115637 - DNA, 601 bp, Human; identical to SEQ ID NO: 115544

SEQ ID NO: 115638 - DNA, 601 bp, Human; identical to SEQ ID NO: 115545

SEQ ID NO: 115639 - DNA, 601 bp, Human; identical to SEQ ID NO: 115546

SEQ ID NO: 115640 - DNA, 601 bp, Human; identical to SEQ ID NO: 115547

SEQ ID NO: 115641 - DNA, 601 bp, Human; identical to SEQ ID NO: 115548

SEQ ID NO: 115642 - DNA, 601 bp, Human; identical to SEQ ID NO: 115549

SEQ ID NO: 115643 - DNA, 601 bp, Human; identical to SEQ ID NO: 115550

SEQ ID NO: 115644 - DNA, 601 bp, Human; identical to SEQ ID NO: 115551

SEQ ID NO: 115645 - DNA, 601 bp, Human; identical to SEQ ID NO: 115552

SEQ ID NO: 115646 - DNA, 601 bp, Human; identical to SEQ ID NO: 115553

SEQ ID NO: 115647 - DNA, 601 bp, Human; identical to SEQ ID NO: 115554

SEQ ID NO: 115648 - DNA, 601 bp, Human; identical to SEQ ID NO: 115555

SEQ ID NO: 115649 - DNA, 601 bp, Human; identical to SEQ ID NO: 115556

SEQ ID NO: 115650 - DNA, 601 bp, Human; identical to SEQ ID NO: 115557

SEQ ID NO: 115651 - DNA, 601 bp, Human; identical to SEQ ID NO: 115558

SEQ ID NO: 115652 - DNA, 601 bp, Human; identical to SEQ ID NO: 115559

SEQ ID NO: 115653 - DNA, 601 bp, Human; identical to SEQ ID NO: 115560

SEQ ID NO: 115654 - DNA, 601 bp, Human; identical to SEQ ID NO: 115561

SEQ ID NO: 115655 - DNA, 601 bp, Human; identical to SEQ ID NO: 115562

SEQ ID NO: 115656 - DNA, 601 bp, Human; identical to SEQ ID NO: 115563

SEQ ID NO: 115657 - DNA, 601 bp, Human; identical to SEQ ID NO: 115564

SEQ ID NO: 115658 - DNA, 601 bp, Human; identical to SEQ ID NO: 115565

SEQ ID NO: 115659 - DNA, 601 bp, Human; identical to SEQ ID NO: 115566

SEQ ID NO: 115660 - DNA, 601 bp, Human; identical to SEQ ID NO: 115567

SEQ ID NO: 115661 - DNA, 601 bp, Human; identical to SEQ ID NO: 115568

SEQ ID NO: 115662 - DNA, 601 bp, Human; identical to SEQ ID NO: 115569

SEQ ID NO: 115663 - DNA, 601 bp, Human; identical to SEQ ID NO: 115570

SEQ ID NO: 115664 - DNA, 601 bp, Human; identical to SEQ ID NO: 115571

SEQ ID NO: 115665 - DNA, 601 bp, Human; identical to SEQ ID NO: 115572

SEQ ID NO: 115666 - DNA, 601 bp, Human; identical to SEQ ID NO: 115573

SEQ ID NO: 115667 - DNA, 601 bp, Human; identical to SEQ ID NO: 115574

SEQ ID NO: 115668 - DNA, 601 bp, Human; identical to SEQ ID NO: 115482

SEQ ID NO: 115669 - DNA, 601 bp, Human; identical to SEQ ID NO: 115483

SEQ ID NO: 115670 - DNA, 601 bp, Human; identical to SEQ ID NO: 115484

SEQ ID NO: 115671 - DNA, 601 bp, Human; identical to SEQ ID NO: 115485

SEQ ID NO: 115672 - DNA, 601 bp, Human; identical to SEQ ID NO: 115486

SEQ ID NO: 115673 - DNA, 601 bp, Human; identical to SEQ ID NO: 115487

SEQ ID NO: 115674 - DNA, 601 bp, Human; identical to SEQ ID NO: 115488

SEQ ID NO: 115675 - DNA, 601 bp, Human; identical to SEQ ID NO: 115489

SEQ ID NO: 115676 - DNA, 601 bp, Human; identical to SEQ ID NO: 115490

SEQ ID NO: 115677 - DNA, 601 bp, Human; identical to SEQ ID NO: 115491

SEQ ID NO: 115678 - DNA, 601 bp, Human; identical to SEQ ID NO: 115492

SEQ ID NO: 115679 - DNA, 601 bp, Human; identical to SEQ ID NO: 115493

SEQ ID NO: 115680 - DNA, 601 bp, Human; identical to SEQ ID NO: 115494

SEQ ID NO: 115681 - DNA, 601 bp, Human; identical to SEQ ID NO: 115495

SEQ ID NO: 115682 - DNA, 601 bp, Human; identical to SEQ ID NO: 115496

SEQ ID NO: 115683 - DNA, 601 bp, Human; identical to SEQ ID NO: 115497

SEQ ID NO: 115684 - DNA, 601 bp, Human; identical to SEQ ID NO: 115498

SEQ ID NO: 115685 - DNA, 601 bp, Human; identical to SEQ ID NO: 115499

SEQ ID NO: 115686 - DNA, 601 bp, Human; identical to SEQ ID NO: 115500

SEQ ID NO: 115687 - DNA, 601 bp, Human; identical to SEQ ID NO: 115501

SEQ ID NO: 115688 - DNA, 601 bp, Human; identical to SEQ ID NO: 115502

SEQ ID NO: 115689 - DNA, 601 bp, Human; identical to SEQ ID NO: 115503

SEQ ID NO: 115690 - DNA, 601 bp, Human; identical to SEQ ID NO: 115504

SEQ ID NO: 115691 - DNA, 601 bp, Human; identical to SEQ ID NO: 115505

SEQ ID NO: 115692 - DNA, 601 bp, Human; identical to SEQ ID NO: 115506

SEQ ID NO: 115693 - DNA, 601 bp, Human; identical to SEQ ID NO: 115507

SEQ ID NO: 115694 - DNA, 601 bp, Human; identical to SEQ ID NO: 115508

SEQ ID NO: 115695 - DNA, 601 bp, Human; identical to SEQ ID NO: 115509

SEQ ID NO: 115696 - DNA, 601 bp, Human; identical to SEQ ID NO: 115510

SEQ ID NO: 115697 - DNA, 601 bp, Human; identical to SEQ ID NO: 115511

SEQ ID NO: 115698 - DNA, 601 bp, Human; identical to SEQ ID NO: 115512

SEQ ID NO: 115699 - DNA, 601 bp, Human; identical to SEQ ID NO: 115513

SEQ ID NO: 115700 - DNA, 601 bp, Human; identical to SEQ ID NO: 115514

SEQ ID NO: 115701 - DNA, 601 bp, Human; identical to SEQ ID NO: 115515

SEQ ID NO: 115702 - DNA, 601 bp, Human; identical to SEQ ID NO: 115516

SEQ ID NO: 115703 - DNA, 523 bp, Human; identical to SEQ ID NO: 115517

SEQ ID NO: 115704 - DNA, 601 bp, Human; identical to SEQ ID NO: 115518

SEQ ID NO: 115705 - DNA, 601 bp, Human; identical to SEQ ID NO: 115519

SEQ ID NO: 115706 - DNA, 601 bp, Human; identical to SEQ ID NO: 115520

SEQ ID NO: 115707 - DNA, 601 bp, Human; identical to SEQ ID NO: 115521

SEQ ID NO: 115708 - DNA, 601 bp, Human; identical to SEQ ID NO: 115522

SEQ ID NO: 115709 - DNA, 601 bp, Human; identical to SEQ ID NO: 115523

SEQ ID NO: 115710 - DNA, 601 bp, Human; identical to SEQ ID NO: 115524

SEQ ID NO: 115711 - DNA, 601 bp, Human; identical to SEQ ID NO: 115525

SEQ ID NO: 115712 - DNA, 601 bp, Human; identical to SEQ ID NO: 115526

SEQ ID NO: 115713 - DNA, 601 bp, Human; identical to SEQ ID NO: 115527

SEQ ID NO: 115714 - DNA, 601 bp, Human; identical to SEQ ID NO: 115528

SEQ ID NO: 115715 - DNA, 601 bp, Human; identical to SEQ ID NO: 115529

SEQ ID NO: 115716 - DNA, 601 bp, Human; identical to SEQ ID NO: 115530

SEQ ID NO: 115717 - DNA, 601 bp, Human; identical to SEQ ID NO: 115531

SEQ ID NO: 115718 - DNA, 601 bp, Human; identical to SEQ ID NO: 115532

SEQ ID NO: 115719 - DNA, 601 bp, Human; identical to SEQ ID NO: 115533

SEQ ID NO: 115720 - DNA, 601 bp, Human; identical to SEQ ID NO: 115534

SEQ ID NO: 115721 - DNA, 601 bp, Human; identical to SEQ ID NO: 115535

SEQ ID NO: 115722 - DNA, 601 bp, Human; identical to SEQ ID NO: 115536

SEQ ID NO: 115723 - DNA, 601 bp, Human; identical to SEQ ID NO: 115537

SEQ ID NO: 115724 - DNA, 601 bp, Human; identical to SEQ ID NO: 115538

SEQ ID NO: 115725 - DNA, 601 bp, Human; identical to SEQ ID NO: 115539

SEQ ID NO: 115726 - DNA, 601 bp, Human; identical to SEQ ID NO: 115540

SEQ ID NO: 115727 - DNA, 601 bp, Human; identical to SEQ ID NO: 115541

SEQ ID NO: 115728 - DNA, 601 bp, Human; identical to SEQ ID NO: 115542

SEQ ID NO: 115729 - DNA, 601 bp, Human; identical to SEQ ID NO: 115543

SEQ ID NO: 115730 - DNA, 601 bp, Human; identical to SEQ ID NO: 115544

SEQ ID NO: 115731 - DNA, 601 bp, Human; identical to SEQ ID NO: 115545

SEQ ID NO: 115732 - DNA, 601 bp, Human; identical to SEQ ID NO: 115546

SEQ ID NO: 115733 - DNA, 601 bp, Human; identical to SEQ ID NO: 115547

SEQ ID NO: 115734 - DNA, 601 bp, Human; identical to SEQ ID NO: 115548

SEQ ID NO: 115735 - DNA, 601 bp, Human; identical to SEQ ID NO: 115549

SEQ ID NO: 115736 - DNA, 601 bp, Human; identical to SEQ ID NO: 115550

SEQ ID NO: 115737 - DNA, 601 bp, Human; identical to SEQ ID NO: 115551

SEQ ID NO: 115738 - DNA, 601 bp, Human; identical to SEQ ID NO: 115552

SEQ ID NO: 115739 - DNA, 601 bp, Human; identical to SEQ ID NO: 115553

SEQ ID NO: 115740 - DNA, 601 bp, Human; identical to SEQ ID NO: 115554

SEQ ID NO: 115741 - DNA, 601 bp, Human; identical to SEQ ID NO: 115555

SEQ ID NO: 115742 - DNA, 601 bp, Human; identical to SEQ ID NO: 115556

SEQ ID NO: 115743 - DNA, 601 bp, Human; identical to SEQ ID NO: 115557

SEQ ID NO: 115744 - DNA, 601 bp, Human; identical to SEQ ID NO: 115558

SEQ ID NO: 115745 - DNA, 601 bp, Human; identical to SEQ ID NO: 115559

SEQ ID NO: 115746 - DNA, 601 bp, Human; identical to SEQ ID NO: 115560

SEQ ID NO: 115747 - DNA, 601 bp, Human; identical to SEQ ID NO: 115561

SEQ ID NO: 115748 - DNA, 601 bp, Human; identical to SEQ ID NO: 115562

SEQ ID NO: 115749 - DNA, 601 bp, Human; identical to SEQ ID NO: 115563

SEQ ID NO: 115750 - DNA, 601 bp, Human; identical to SEQ ID NO: 115564

SEQ ID NO: 115751 - DNA, 601 bp, Human; identical to SEQ ID NO: 115565

SEQ ID NO: 115752 - DNA, 601 bp, Human; identical to SEQ ID NO: 115566

SEQ ID NO: 115753 - DNA, 601 bp, Human; identical to SEQ ID NO: 115567

SEQ ID NO: 115754 - DNA, 601 bp, Human; identical to SEQ ID NO: 115568

SEQ ID NO: 115755 - DNA, 601 bp, Human; identical to SEQ ID NO: 115569

SEQ ID NO: 115756 - DNA, 601 bp, Human; identical to SEQ ID NO: 115570

SEQ ID NO: 115757 - DNA, 601 bp, Human; identical to SEQ ID NO: 115571

SEQ ID NO: 115758 - DNA, 601 bp, Human; identical to SEQ ID NO: 115572

SEQ ID NO: 115759 - DNA, 601 bp, Human; identical to SEQ ID NO: 115573

SEQ ID NO: 115760 - DNA, 601 bp, Human; identical to SEQ ID NO: 115574

SEQ ID NO: 115761 - DNA, 601 bp, Human; identical to SEQ ID NO: 115482

SEQ ID NO: 115762 - DNA, 601 bp, Human; identical to SEQ ID NO: 115483

SEQ ID NO: 115763 - DNA, 601 bp, Human; identical to SEQ ID NO: 115484

SEQ ID NO: 115764 - DNA, 601 bp, Human; identical to SEQ ID NO: 115485

SEQ ID NO: 115765 - DNA, 601 bp, Human; identical to SEQ ID NO: 115486

SEQ ID NO: 115766 - DNA, 601 bp, Human; identical to SEQ ID NO: 115487

SEQ ID NO: 115767 - DNA, 601 bp, Human; identical to SEQ ID NO: 115488

SEQ ID NO: 115768 - DNA, 601 bp, Human; identical to SEQ ID NO: 115489

SEQ ID NO: 115769 - DNA, 601 bp, Human; identical to SEQ ID NO: 115490

SEQ ID NO: 115770 - DNA, 601 bp, Human; identical to SEQ ID NO: 115491

SEQ ID NO: 115771 - DNA, 601 bp, Human; identical to SEQ ID NO: 115492

SEQ ID NO: 115772 - DNA, 601 bp, Human; identical to SEQ ID NO: 115493

SEQ ID NO: 115773 - DNA, 601 bp, Human; identical to SEQ ID NO: 115494

SEQ ID NO: 115774 - DNA, 601 bp, Human; identical to SEQ ID NO: 115495

SEQ ID NO: 115775 - DNA, 601 bp, Human; identical to SEQ ID NO: 115496

SEQ ID NO: 115776 - DNA, 601 bp, Human; identical to SEQ ID NO: 115497

SEQ ID NO: 115777 - DNA, 601 bp, Human; identical to SEQ ID NO: 115498

SEQ ID NO: 115778 - DNA, 601 bp, Human; identical to SEQ ID NO: 115499

SEQ ID NO: 115779 - DNA, 601 bp, Human; identical to SEQ ID NO: 115500

SEQ ID NO: 115780 - DNA, 601 bp, Human; identical to SEQ ID NO: 115501

SEQ ID NO: 115781 - DNA, 601 bp, Human; identical to SEQ ID NO: 115502

SEQ ID NO: 115782 - DNA, 601 bp, Human; identical to SEQ ID NO: 115503

SEQ ID NO: 115783 - DNA, 601 bp, Human; identical to SEQ ID NO: 115504

SEQ ID NO: 115784 - DNA, 601 bp, Human; identical to SEQ ID NO: 115505

SEQ ID NO: 115785 - DNA, 601 bp, Human; identical to SEQ ID NO: 115506

SEQ ID NO: 115786 - DNA, 601 bp, Human; identical to SEQ ID NO: 115507

SEQ ID NO: 115787 - DNA, 601 bp, Human; identical to SEQ ID NO: 115508

SEQ ID NO: 115788 - DNA, 601 bp, Human; identical to SEQ ID NO: 115509

SEQ ID NO: 115789 - DNA, 601 bp, Human; identical to SEQ ID NO: 115510

SEQ ID NO: 115790 - DNA, 601 bp, Human; identical to SEQ ID NO: 115511

SEQ ID NO: 115791 - DNA, 601 bp, Human; identical to SEQ ID NO: 115512

SEQ ID NO: 115792 - DNA, 601 bp, Human; identical to SEQ ID NO: 115513

SEQ ID NO: 115793 - DNA, 601 bp, Human; identical to SEQ ID NO: 115514

SEQ ID NO: 115794 - DNA, 601 bp, Human; identical to SEQ ID NO: 115515

SEQ ID NO: 115795 - DNA, 601 bp, Human; identical to SEQ ID NO: 115516

SEQ ID NO: 115796 - DNA, 523 bp, Human; identical to SEQ ID NO: 115517

SEQ ID NO: 115797 - DNA, 601 bp, Human; identical to SEQ ID NO: 115518

SEQ ID NO: 115798 - DNA, 601 bp, Human; identical to SEQ ID NO: 115519

SEQ ID NO: 115799 - DNA, 601 bp, Human; identical to SEQ ID NO: 115520

SEQ ID NO: 115800 - DNA, 601 bp, Human; identical to SEQ ID NO: 115521

SEQ ID NO: 115801 - DNA, 601 bp, Human; identical to SEQ ID NO: 115522

SEQ ID NO: 115802 - DNA, 601 bp, Human; identical to SEQ ID NO: 115523

SEQ ID NO: 115803 - DNA, 601 bp, Human; identical to SEQ ID NO: 115524

SEQ ID NO: 115804 - DNA, 601 bp, Human; identical to SEQ ID NO: 115525

SEQ ID NO: 115805 - DNA, 601 bp, Human; identical to SEQ ID NO: 115526

SEQ ID NO: 115806 - DNA, 601 bp, Human; identical to SEQ ID NO: 115527

SEQ ID NO: 115807 - DNA, 601 bp, Human; identical to SEQ ID NO: 115528

SEQ ID NO: 115808 - DNA, 601 bp, Human; identical to SEQ ID NO: 115529

SEQ ID NO: 115809 - DNA, 601 bp, Human; identical to SEQ ID NO: 115530

SEQ ID NO: 115810 - DNA, 601 bp, Human; identical to SEQ ID NO: 115531

SEQ ID NO: 115811 - DNA, 601 bp, Human; identical to SEQ ID NO: 115532

SEQ ID NO: 115812 - DNA, 601 bp, Human; identical to SEQ ID NO: 115533

SEQ ID NO: 115813 - DNA, 601 bp, Human; identical to SEQ ID NO: 115534

SEQ ID NO: 115814 - DNA, 601 bp, Human; identical to SEQ ID NO: 115535

SEQ ID NO: 115815 - DNA, 601 bp, Human; identical to SEQ ID NO: 115536

SEQ ID NO: 115816 - DNA, 601 bp, Human; identical to SEQ ID NO: 115537

SEQ ID NO: 115817 - DNA, 601 bp, Human; identical to SEQ ID NO: 115538

SEQ ID NO: 115818 - DNA, 601 bp, Human; identical to SEQ ID NO: 115539

SEQ ID NO: 115819 - DNA, 601 bp, Human; identical to SEQ ID NO: 115540

SEQ ID NO: 115820 - DNA, 601 bp, Human; identical to SEQ ID NO: 115541

SEQ ID NO: 115821 - DNA, 601 bp, Human; identical to SEQ ID NO: 115542

SEQ ID NO: 115822 - DNA, 601 bp, Human; identical to SEQ ID NO: 115543

SEQ ID NO: 115823 - DNA, 601 bp, Human; identical to SEQ ID NO: 115544

SEQ ID NO: 115824 - DNA, 601 bp, Human; identical to SEQ ID NO: 115545

SEQ ID NO: 115825 - DNA, 601 bp, Human; identical to SEQ ID NO: 115546

SEQ ID NO: 115826 - DNA, 601 bp, Human; identical to SEQ ID NO: 115547

SEQ ID NO: 115827 - DNA, 601 bp, Human; identical to SEQ ID NO: 115548

SEQ ID NO: 115828 - DNA, 601 bp, Human; identical to SEQ ID NO: 115549

SEQ ID NO: 115829 - DNA, 601 bp, Human; identical to SEQ ID NO: 115550

SEQ ID NO: 115830 - DNA, 601 bp, Human; identical to SEQ ID NO: 115551

SEQ ID NO: 115831 - DNA, 601 bp, Human; identical to SEQ ID NO: 115552

SEQ ID NO: 115832 - DNA, 601 bp, Human; identical to SEQ ID NO: 115553

SEQ ID NO: 115833 - DNA, 601 bp, Human; identical to SEQ ID NO: 115554

SEQ ID NO: 115834 - DNA, 601 bp, Human; identical to SEQ ID NO: 115555

SEQ ID NO: 115835 - DNA, 601 bp, Human; identical to SEQ ID NO: 115556

SEQ ID NO: 115836 - DNA, 601 bp, Human; identical to SEQ ID NO: 115557

SEQ ID NO: 115837 - DNA, 601 bp, Human; identical to SEQ ID NO: 115558

SEQ ID NO: 115838 - DNA, 601 bp, Human; identical to SEQ ID NO: 115559

SEQ ID NO: 115839 - DNA, 601 bp, Human; identical to SEQ ID NO: 115560

SEQ ID NO: 115840 - DNA, 601 bp, Human; identical to SEQ ID NO: 115561

SEQ ID NO: 115841 - DNA, 601 bp, Human; identical to SEQ ID NO: 115562

SEQ ID NO: 115842 - DNA, 601 bp, Human; identical to SEQ ID NO: 115563

SEQ ID NO: 115843 - DNA, 601 bp, Human; identical to SEQ ID NO: 115564

SEQ ID NO: 115844 - DNA, 601 bp, Human; identical to SEQ ID NO: 115565

SEQ ID NO: 115845 - DNA, 601 bp, Human; identical to SEQ ID NO: 115566

SEQ ID NO: 115846 - DNA, 601 bp, Human; identical to SEQ ID NO: 115567

SEQ ID NO: 115847 - DNA, 601 bp, Human; identical to SEQ ID NO: 115568

SEQ ID NO: 115848 - DNA, 601 bp, Human; identical to SEQ ID NO: 115569

SEQ ID NO: 115849 - DNA, 601 bp, Human; identical to SEQ ID NO: 115570

SEQ ID NO: 115850 - DNA, 601 bp, Human; identical to SEQ ID NO: 115571

SEQ ID NO: 115851 - DNA, 601 bp, Human; identical to SEQ ID NO: 115572

SEQ ID NO: 115852 - DNA, 601 bp, Human; identical to SEQ ID NO: 115573

SEQ ID NO: 115853 - DNA, 601 bp, Human; identical to SEQ ID NO: 115574

SEQ ID NO: 115854 - DNA, 601 bp, Human; identical to SEQ ID NO: 115482

SEQ ID NO: 115855 - DNA, 601 bp, Human; identical to SEQ ID NO: 115483

SEQ ID NO: 115856 - DNA, 601 bp, Human; identical to SEQ ID NO: 115484

SEQ ID NO: 115857 - DNA, 601 bp, Human; identical to SEQ ID NO: 115485

SEQ ID NO: 115858 - DNA, 601 bp, Human; identical to SEQ ID NO: 115486

SEQ ID NO: 115859 - DNA, 601 bp, Human; identical to SEQ ID NO: 115487

SEQ ID NO: 115860 - DNA, 601 bp, Human; identical to SEQ ID NO: 115488

SEQ ID NO: 115861 - DNA, 601 bp, Human; identical to SEQ ID NO: 115489

SEQ ID NO: 115862 - DNA, 601 bp, Human; identical to SEQ ID NO: 115490

SEQ ID NO: 115863 - DNA, 601 bp, Human; identical to SEQ ID NO: 115491

SEQ ID NO: 115864 - DNA, 601 bp, Human; identical to SEQ ID NO: 115492

SEQ ID NO: 115865 - DNA, 601 bp, Human; identical to SEQ ID NO: 115493

SEQ ID NO: 115866 - DNA, 601 bp, Human; identical to SEQ ID NO: 115494

SEQ ID NO: 115867 - DNA, 601 bp, Human; identical to SEQ ID NO: 115495

SEQ ID NO: 115868 - DNA, 601 bp, Human; identical to SEQ ID NO: 115496

SEQ ID NO: 115869 - DNA, 601 bp, Human; identical to SEQ ID NO: 115497

SEQ ID NO: 115870 - DNA, 601 bp, Human; identical to SEQ ID NO: 115498

SEQ ID NO: 115871 - DNA, 601 bp, Human; identical to SEQ ID NO: 115499

SEQ ID NO: 115872 - DNA, 601 bp, Human; identical to SEQ ID NO: 115500

SEQ ID NO: 115873 - DNA, 601 bp, Human; identical to SEQ ID NO: 115501

SEQ ID NO: 115874 - DNA, 601 bp, Human; identical to SEQ ID NO: 115502

SEQ ID NO: 115875 - DNA, 601 bp, Human; identical to SEQ ID NO: 115503

SEQ ID NO: 115876 - DNA, 601 bp, Human; identical to SEQ ID NO: 115504

SEQ ID NO: 115877 - DNA, 601 bp, Human; identical to SEQ ID NO: 115505

SEQ ID NO: 115878 - DNA, 601 bp, Human; identical to SEQ ID NO: 115506

SEQ ID NO: 115879 - DNA, 601 bp, Human; identical to SEQ ID NO: 115507

SEQ ID NO: 115880 - DNA, 601 bp, Human; identical to SEQ ID NO: 115508

SEQ ID NO: 115881 - DNA, 601 bp, Human; identical to SEQ ID NO: 115509

SEQ ID NO: 115882 - DNA, 601 bp, Human; identical to SEQ ID NO: 115510

SEQ ID NO: 115883 - DNA, 601 bp, Human; identical to SEQ ID NO: 115511

SEQ ID NO: 115884 - DNA, 601 bp, Human; identical to SEQ ID NO: 115512

SEQ ID NO: 115885 - DNA, 601 bp, Human; identical to SEQ ID NO: 115513

SEQ ID NO: 115886 - DNA, 601 bp, Human; identical to SEQ ID NO: 115514

SEQ ID NO: 115887 - DNA, 601 bp, Human; identical to SEQ ID NO: 115515

SEQ ID NO: 115888 - DNA, 601 bp, Human; identical to SEQ ID NO: 115516

SEQ ID NO: 115889 - DNA, 523 bp, Human; identical to SEQ ID NO: 115517

SEQ ID NO: 115890 - DNA, 601 bp, Human; identical to SEQ ID NO: 115518

SEQ ID NO: 115891 - DNA, 601 bp, Human; identical to SEQ ID NO: 115519

SEQ ID NO: 115892 - DNA, 601 bp, Human; identical to SEQ ID NO: 115520

SEQ ID NO: 115893 - DNA, 601 bp, Human; identical to SEQ ID NO: 115521

SEQ ID NO: 115894 - DNA, 601 bp, Human; identical to SEQ ID NO: 115522

SEQ ID NO: 115895 - DNA, 601 bp, Human; identical to SEQ ID NO: 115523

SEQ ID NO: 115896 - DNA, 601 bp, Human; identical to SEQ ID NO: 115524

SEQ ID NO: 115897 - DNA, 601 bp, Human; identical to SEQ ID NO: 115525

SEQ ID NO: 115898 - DNA, 601 bp, Human; identical to SEQ ID NO: 115526

SEQ ID NO: 115899 - DNA, 601 bp, Human; identical to SEQ ID NO: 115527

SEQ ID NO: 115900 - DNA, 601 bp, Human; identical to SEQ ID NO: 115528

SEQ ID NO: 115901 - DNA, 601 bp, Human; identical to SEQ ID NO: 115529

SEQ ID NO: 115902 - DNA, 601 bp, Human; identical to SEQ ID NO: 115530

SEQ ID NO: 115903 - DNA, 601 bp, Human; identical to SEQ ID NO: 115531

SEQ ID NO: 115904 - DNA, 601 bp, Human; identical to SEQ ID NO: 115532

SEQ ID NO: 115905 - DNA, 601 bp, Human; identical to SEQ ID NO: 115533

SEQ ID NO: 115906 - DNA, 601 bp, Human; identical to SEQ ID NO: 115534

SEQ ID NO: 115907 - DNA, 601 bp, Human; identical to SEQ ID NO: 115535

SEQ ID NO: 115908 - DNA, 601 bp, Human; identical to SEQ ID NO: 115536

SEQ ID NO: 115909 - DNA, 601 bp, Human; identical to SEQ ID NO: 115537

SEQ ID NO: 115910 - DNA, 601 bp, Human; identical to SEQ ID NO: 115538

SEQ ID NO: 115911 - DNA, 601 bp, Human; identical to SEQ ID NO: 115539

SEQ ID NO: 115912 - DNA, 601 bp, Human; identical to SEQ ID NO: 115540

SEQ ID NO: 115913 - DNA, 601 bp, Human; identical to SEQ ID NO: 115541

SEQ ID NO: 115914 - DNA, 601 bp, Human; identical to SEQ ID NO: 115542

SEQ ID NO: 115915 - DNA, 601 bp, Human; identical to SEQ ID NO: 115543

SEQ ID NO: 115916 - DNA, 601 bp, Human; identical to SEQ ID NO: 115544

SEQ ID NO: 115917 - DNA, 601 bp, Human; identical to SEQ ID NO: 115545

SEQ ID NO: 115918 - DNA, 601 bp, Human; identical to SEQ ID NO: 115546

SEQ ID NO: 115919 - DNA, 601 bp, Human; identical to SEQ ID NO: 115547

SEQ ID NO: 115920 - DNA, 601 bp, Human; identical to SEQ ID NO: 115548

SEQ ID NO: 115921 - DNA, 601 bp, Human; identical to SEQ ID NO: 115549

SEQ ID NO: 115922 - DNA, 601 bp, Human; identical to SEQ ID NO: 115550

SEQ ID NO: 115923 - DNA, 601 bp, Human; identical to SEQ ID NO: 115551

SEQ ID NO: 115924 - DNA, 601 bp, Human; identical to SEQ ID NO: 115552

SEQ ID NO: 115925 - DNA, 601 bp, Human; identical to SEQ ID NO: 115553

SEQ ID NO: 115926 - DNA, 601 bp, Human; identical to SEQ ID NO: 115554

SEQ ID NO: 115927 - DNA, 601 bp, Human; identical to SEQ ID NO: 115555

SEQ ID NO: 115928 - DNA, 601 bp, Human; identical to SEQ ID NO: 115556

SEQ ID NO: 115929 - DNA, 601 bp, Human; identical to SEQ ID NO: 115557

SEQ ID NO: 115930 - DNA, 601 bp, Human; identical to SEQ ID NO: 115558

SEQ ID NO: 115931 - DNA, 601 bp, Human; identical to SEQ ID NO: 115559

SEQ ID NO: 115932 - DNA, 601 bp, Human; identical to SEQ ID NO: 115560

SEQ ID NO: 115933 - DNA, 601 bp, Human; identical to SEQ ID NO: 115561

SEQ ID NO: 115934 - DNA, 601 bp, Human; identical to SEQ ID NO: 115562

SEQ ID NO: 115935 - DNA, 601 bp, Human; identical to SEQ ID NO: 115563

SEQ ID NO: 115936 - DNA, 601 bp, Human; identical to SEQ ID NO: 115564

SEQ ID NO: 115937 - DNA, 601 bp, Human; identical to SEQ ID NO: 115565

SEQ ID NO: 115938 - DNA, 601 bp, Human; identical to SEQ ID NO: 115566

SEQ ID NO: 115939 - DNA, 601 bp, Human; identical to SEQ ID NO: 115567

SEQ ID NO: 115940 - DNA, 601 bp, Human; identical to SEQ ID NO: 115568

SEQ ID NO: 115941 - DNA, 601 bp, Human; identical to SEQ ID NO: 115569

SEQ ID NO: 115942 - DNA, 601 bp, Human; identical to SEQ ID NO: 115570

SEQ ID NO: 115943 - DNA, 601 bp, Human; identical to SEQ ID NO: 115571

SEQ ID NO: 115944 - DNA, 601 bp, Human; identical to SEQ ID NO: 115572

SEQ ID NO: 115945 - DNA, 601 bp, Human; identical to SEQ ID NO: 115573

SEQ ID NO: 115946 - DNA, 601 bp, Human; identical to SEQ ID NO: 115574

SEQ ID NO: 115947 - DNA, 601 bp, Human; identical to SEQ ID NO: 115482

SEQ ID NO: 115948 - DNA, 601 bp, Human; identical to SEQ ID NO: 115483

SEQ ID NO: 115949 - DNA, 601 bp, Human; identical to SEQ ID NO: 115484

SEQ ID NO: 115950 - DNA, 601 bp, Human; identical to SEQ ID NO: 115485

SEQ ID NO: 115951 - DNA, 601 bp, Human; identical to SEQ ID NO: 115486

SEQ ID NO: 115952 - DNA, 601 bp, Human; identical to SEQ ID NO: 115487

SEQ ID NO: 115953 - DNA, 601 bp, Human; identical to SEQ ID NO: 115488

SEQ ID NO: 115954 - DNA, 601 bp, Human; identical to SEQ ID NO: 115489

SEQ ID NO: 115955 - DNA, 601 bp, Human; identical to SEQ ID NO: 115490

SEQ ID NO: 115956 - DNA, 601 bp, Human; identical to SEQ ID NO: 115491

SEQ ID NO: 115957 - DNA, 601 bp, Human; identical to SEQ ID NO: 115492

SEQ ID NO: 115958 - DNA, 601 bp, Human; identical to SEQ ID NO: 115493

SEQ ID NO: 115959 - DNA, 601 bp, Human; identical to SEQ ID NO: 115494

SEQ ID NO: 115960 - DNA, 601 bp, Human; identical to SEQ ID NO: 115495

SEQ ID NO: 115961 - DNA, 601 bp, Human; identical to SEQ ID NO: 115496

SEQ ID NO: 115962 - DNA, 601 bp, Human; identical to SEQ ID NO: 115497

SEQ ID NO: 115963 - DNA, 601 bp, Human; identical to SEQ ID NO: 115498

SEQ ID NO: 115964 - DNA, 601 bp, Human; identical to SEQ ID NO: 115499

SEQ ID NO: 115965 - DNA, 601 bp, Human; identical to SEQ ID NO: 115500

SEQ ID NO: 115966 - DNA, 601 bp, Human; identical to SEQ ID NO: 115501

SEQ ID NO: 115967 - DNA, 601 bp, Human; identical to SEQ ID NO: 115502

SEQ ID NO: 115968 - DNA, 601 bp, Human; identical to SEQ ID NO: 115503

SEQ ID NO: 115969 - DNA, 601 bp, Human; identical to SEQ ID NO: 115504

SEQ ID NO: 115970 - DNA, 601 bp, Human; identical to SEQ ID NO: 115505

SEQ ID NO: 115971 - DNA, 601 bp, Human; identical to SEQ ID NO: 115506

SEQ ID NO: 115972 - DNA, 601 bp, Human; identical to SEQ ID NO: 115507

SEQ ID NO: 115973 - DNA, 601 bp, Human; identical to SEQ ID NO: 115508

SEQ ID NO: 115974 - DNA, 601 bp, Human; identical to SEQ ID NO: 115509

SEQ ID NO: 115975 - DNA, 601 bp, Human; identical to SEQ ID NO: 115510

SEQ ID NO: 115976 - DNA, 601 bp, Human; identical to SEQ ID NO: 115511

SEQ ID NO: 115977 - DNA, 601 bp, Human; identical to SEQ ID NO: 115512

SEQ ID NO: 115978 - DNA, 601 bp, Human; identical to SEQ ID NO: 115513

SEQ ID NO: 115979 - DNA, 601 bp, Human; identical to SEQ ID NO: 115514

SEQ ID NO: 115980 - DNA, 601 bp, Human; identical to SEQ ID NO: 115515

SEQ ID NO: 115981 - DNA, 601 bp, Human; identical to SEQ ID NO: 115516

SEQ ID NO: 115982 - DNA, 523 bp, Human; identical to SEQ ID NO: 115517

SEQ ID NO: 115983 - DNA, 601 bp, Human; identical to SEQ ID NO: 115518

SEQ ID NO: 115984 - DNA, 601 bp, Human; identical to SEQ ID NO: 115519

SEQ ID NO: 115985 - DNA, 601 bp, Human; identical to SEQ ID NO: 115520

SEQ ID NO: 115986 - DNA, 601 bp, Human; identical to SEQ ID NO: 115521

SEQ ID NO: 115987 - DNA, 601 bp, Human; identical to SEQ ID NO: 115522

SEQ ID NO: 115988 - DNA, 601 bp, Human; identical to SEQ ID NO: 115523

SEQ ID NO: 115989 - DNA, 601 bp, Human; identical to SEQ ID NO: 115524

SEQ ID NO: 115990 - DNA, 601 bp, Human; identical to SEQ ID NO: 115525

SEQ ID NO: 115991 - DNA, 601 bp, Human; identical to SEQ ID NO: 115526

SEQ ID NO: 115992 - DNA, 601 bp, Human; identical to SEQ ID NO: 115527

SEQ ID NO: 115993 - DNA, 601 bp, Human; identical to SEQ ID NO: 115528

SEQ ID NO: 115994 - DNA, 601 bp, Human; identical to SEQ ID NO: 115529

SEQ ID NO: 115995 - DNA, 601 bp, Human; identical to SEQ ID NO: 115530

SEQ ID NO: 115996 - DNA, 601 bp, Human; identical to SEQ ID NO: 115531

SEQ ID NO: 115997 - DNA, 601 bp, Human; identical to SEQ ID NO: 115532

SEQ ID NO: 115998 - DNA, 601 bp, Human; identical to SEQ ID NO: 115533

SEQ ID NO: 115999 - DNA, 601 bp, Human; identical to SEQ ID NO: 115534

SEQ ID NO: 116000 - DNA, 601 bp, Human; identical to SEQ ID NO: 115535

SEQ ID NO: 116001 - DNA, 601 bp, Human; identical to SEQ ID NO: 115536

SEQ ID NO: 116002 - DNA, 601 bp, Human; identical to SEQ ID NO: 115537

SEQ ID NO: 116003 - DNA, 601 bp, Human; identical to SEQ ID NO: 115538

SEQ ID NO: 116004 - DNA, 601 bp, Human; identical to SEQ ID NO: 115539

SEQ ID NO: 116005 - DNA, 601 bp, Human; identical to SEQ ID NO: 115540

SEQ ID NO: 116006 - DNA, 601 bp, Human; identical to SEQ ID NO: 115541

SEQ ID NO: 116007 - DNA, 601 bp, Human; identical to SEQ ID NO: 115542

SEQ ID NO: 116008 - DNA, 601 bp, Human; identical to SEQ ID NO: 115543

SEQ ID NO: 116009 - DNA, 601 bp, Human; identical to SEQ ID NO: 115544

SEQ ID NO: 116010 - DNA, 601 bp, Human; identical to SEQ ID NO: 115545

SEQ ID NO: 116011 - DNA, 601 bp, Human; identical to SEQ ID NO: 115546

SEQ ID NO: 116012 - DNA, 601 bp, Human; identical to SEQ ID NO: 115547

SEQ ID NO: 116013 - DNA, 601 bp, Human; identical to SEQ ID NO: 115548

SEQ ID NO: 116014 - DNA, 601 bp, Human; identical to SEQ ID NO: 115549

SEQ ID NO: 116015 - DNA, 601 bp, Human; identical to SEQ ID NO: 115550

SEQ ID NO: 116016 - DNA, 601 bp, Human; identical to SEQ ID NO: 115551

SEQ ID NO: 116017 - DNA, 601 bp, Human; identical to SEQ ID NO: 115552

SEQ ID NO: 116018 - DNA, 601 bp, Human; identical to SEQ ID NO: 115553

SEQ ID NO: 116019 - DNA, 601 bp, Human; identical to SEQ ID NO: 115554

SEQ ID NO: 116020 - DNA, 601 bp, Human; identical to SEQ ID NO: 115555

SEQ ID NO: 116021 - DNA, 601 bp, Human; identical to SEQ ID NO: 115556

SEQ ID NO: 116022 - DNA, 601 bp, Human; identical to SEQ ID NO: 115557

SEQ ID NO: 116023 - DNA, 601 bp, Human; identical to SEQ ID NO: 115558

SEQ ID NO: 116024 - DNA, 601 bp, Human; identical to SEQ ID NO: 115559

SEQ ID NO: 116025 - DNA, 601 bp, Human; identical to SEQ ID NO: 115560

SEQ ID NO: 116026 - DNA, 601 bp, Human; identical to SEQ ID NO: 115561

SEQ ID NO: 116027 - DNA, 601 bp, Human; identical to SEQ ID NO: 115562

SEQ ID NO: 116028 - DNA, 601 bp, Human; identical to SEQ ID NO: 115563

SEQ ID NO: 116029 - DNA, 601 bp, Human; identical to SEQ ID NO: 115564

SEQ ID NO: 116030 - DNA, 601 bp, Human; identical to SEQ ID NO: 115565

SEQ ID NO: 116031 - DNA, 601 bp, Human; identical to SEQ ID NO: 115566

SEQ ID NO: 116032 - DNA, 601 bp, Human; identical to SEQ ID NO: 115567

SEQ ID NO: 116033 - DNA, 601 bp, Human; identical to SEQ ID NO: 115568

SEQ ID NO: 116034 - DNA, 601 bp, Human; identical to SEQ ID NO: 115569

SEQ ID NO: 116035 - DNA, 601 bp, Human; identical to SEQ ID NO: 115570

SEQ ID NO: 116036 - DNA, 601 bp, Human; identical to SEQ ID NO: 115571

SEQ ID NO: 116037 - DNA, 601 bp, Human; identical to SEQ ID NO: 115572

SEQ ID NO: 116038 - DNA, 601 bp, Human; identical to SEQ ID NO: 115573

SEQ ID NO: 116039 - DNA, 601 bp, Human; identical to SEQ ID NO: 115574

SEQ ID NO: 116040 - DNA, 601 bp, Human; identical to SEQ ID NO: 115482

SEQ ID NO: 116041 - DNA, 601 bp, Human; identical to SEQ ID NO: 115483

SEQ ID NO: 116042 - DNA, 601 bp, Human; identical to SEQ ID NO: 115484

SEQ ID NO: 116043 - DNA, 601 bp, Human; identical to SEQ ID NO: 115485

SEQ ID NO: 116044 - DNA, 601 bp, Human; identical to SEQ ID NO: 115486

SEQ ID NO: 116045 - DNA, 601 bp, Human; identical to SEQ ID NO: 115487

SEQ ID NO: 116046 - DNA, 601 bp, Human; identical to SEQ ID NO: 115488

SEQ ID NO: 116047 - DNA, 601 bp, Human; identical to SEQ ID NO: 115489

SEQ ID NO: 116048 - DNA, 601 bp, Human; identical to SEQ ID NO: 115490

SEQ ID NO: 116049 - DNA, 601 bp, Human; identical to SEQ ID NO: 115491

SEQ ID NO: 116050 - DNA, 601 bp, Human; identical to SEQ ID NO: 115492

SEQ ID NO: 116051 - DNA, 601 bp, Human; identical to SEQ ID NO: 115493

SEQ ID NO: 116052 - DNA, 601 bp, Human; identical to SEQ ID NO: 115494

SEQ ID NO: 116053 - DNA, 601 bp, Human; identical to SEQ ID NO: 115495

SEQ ID NO: 116054 - DNA, 601 bp, Human; identical to SEQ ID NO: 115496

SEQ ID NO: 116055 - DNA, 601 bp, Human; identical to SEQ ID NO: 115497

SEQ ID NO: 116056 - DNA, 601 bp, Human; identical to SEQ ID NO: 115498

SEQ ID NO: 116057 - DNA, 601 bp, Human; identical to SEQ ID NO: 115499

SEQ ID NO: 116058 - DNA, 601 bp, Human; identical to SEQ ID NO: 115500

SEQ ID NO: 116059 - DNA, 601 bp, Human; identical to SEQ ID NO: 115501

SEQ ID NO: 116060 - DNA, 601 bp, Human; identical to SEQ ID NO: 115502

SEQ ID NO: 116061 - DNA, 601 bp, Human; identical to SEQ ID NO: 115503

SEQ ID NO: 116062 - DNA, 601 bp, Human; identical to SEQ ID NO: 115504

SEQ ID NO: 116063 - DNA, 601 bp, Human; identical to SEQ ID NO: 115505

SEQ ID NO: 116064 - DNA, 601 bp, Human; identical to SEQ ID NO: 115506

SEQ ID NO: 116065 - DNA, 601 bp, Human; identical to SEQ ID NO: 115507

SEQ ID NO: 116066 - DNA, 601 bp, Human; identical to SEQ ID NO: 115508

SEQ ID NO: 116067 - DNA, 601 bp, Human; identical to SEQ ID NO: 115509

SEQ ID NO: 116068 - DNA, 601 bp, Human; identical to SEQ ID NO: 115510

SEQ ID NO: 116069 - DNA, 601 bp, Human; identical to SEQ ID NO: 115511

SEQ ID NO: 116070 - DNA, 601 bp, Human; identical to SEQ ID NO: 115512

SEQ ID NO: 116071 - DNA, 601 bp, Human; identical to SEQ ID NO: 115513

SEQ ID NO: 116072 - DNA, 601 bp, Human; identical to SEQ ID NO: 115514

SEQ ID NO: 116073 - DNA, 601 bp, Human; identical to SEQ ID NO: 115515

SEQ ID NO: 116074 - DNA, 601 bp, Human; identical to SEQ ID NO: 115516

SEQ ID NO: 116075 - DNA, 523 bp, Human; identical to SEQ ID NO: 115517

SEQ ID NO: 116076 - DNA, 601 bp, Human; identical to SEQ ID NO: 115518

SEQ ID NO: 116077 - DNA, 601 bp, Human; identical to SEQ ID NO: 115519

SEQ ID NO: 116078 - DNA, 601 bp, Human; identical to SEQ ID NO: 115520

SEQ ID NO: 116079 - DNA, 601 bp, Human; identical to SEQ ID NO: 115521

SEQ ID NO: 116080 - DNA, 601 bp, Human; identical to SEQ ID NO: 115522

SEQ ID NO: 116081 - DNA, 601 bp, Human; identical to SEQ ID NO: 115523

SEQ ID NO: 116082 - DNA, 601 bp, Human; identical to SEQ ID NO: 115524

SEQ ID NO: 116083 - DNA, 601 bp, Human; identical to SEQ ID NO: 115525

SEQ ID NO: 116084 - DNA, 601 bp, Human; identical to SEQ ID NO: 115526

SEQ ID NO: 116085 - DNA, 601 bp, Human; identical to SEQ ID NO: 115527

SEQ ID NO: 116086 - DNA, 601 bp, Human; identical to SEQ ID NO: 115528

SEQ ID NO: 116087 - DNA, 601 bp, Human; identical to SEQ ID NO: 115529

SEQ ID NO: 116088 - DNA, 601 bp, Human; identical to SEQ ID NO: 115530

SEQ ID NO: 116089 - DNA, 601 bp, Human; identical to SEQ ID NO: 115531

SEQ ID NO: 116090 - DNA, 601 bp, Human; identical to SEQ ID NO: 115532

SEQ ID NO: 116091 - DNA, 601 bp, Human; identical to SEQ ID NO: 115533

SEQ ID NO: 116092 - DNA, 601 bp, Human; identical to SEQ ID NO: 115534

SEQ ID NO: 116093 - DNA, 601 bp, Human; identical to SEQ ID NO: 115535

SEQ ID NO: 116094 - DNA, 601 bp, Human; identical to SEQ ID NO: 115536

SEQ ID NO: 116095 - DNA, 601 bp, Human; identical to SEQ ID NO: 115537

SEQ ID NO: 116096 - DNA, 601 bp, Human; identical to SEQ ID NO: 115538

SEQ ID NO: 116097 - DNA, 601 bp, Human; identical to SEQ ID NO: 115539

SEQ ID NO: 116098 - DNA, 601 bp, Human; identical to SEQ ID NO: 115540

SEQ ID NO: 116099 - DNA, 601 bp, Human; identical to SEQ ID NO: 115541

SEQ ID NO: 116100 - DNA, 601 bp, Human; identical to SEQ ID NO: 115542

SEQ ID NO: 116101 - DNA, 601 bp, Human; identical to SEQ ID NO: 115543

SEQ ID NO: 116102 - DNA, 601 bp, Human; identical to SEQ ID NO: 115544

SEQ ID NO: 116103 - DNA, 601 bp, Human; identical to SEQ ID NO: 115545

SEQ ID NO: 116104 - DNA, 601 bp, Human; identical to SEQ ID NO: 115546

SEQ ID NO: 116105 - DNA, 601 bp, Human; identical to SEQ ID NO: 115547

SEQ ID NO: 116106 - DNA, 601 bp, Human; identical to SEQ ID NO: 115548

SEQ ID NO: 116107 - DNA, 601 bp, Human; identical to SEQ ID NO: 115549

SEQ ID NO: 116108 - DNA, 601 bp, Human; identical to SEQ ID NO: 115550

SEQ ID NO: 116109 - DNA, 601 bp, Human; identical to SEQ ID NO: 115551

SEQ ID NO: 116110 - DNA, 601 bp, Human; identical to SEQ ID NO: 115552

SEQ ID NO: 116111 - DNA, 601 bp, Human; identical to SEQ ID NO: 115553

SEQ ID NO: 116112 - DNA, 601 bp, Human; identical to SEQ ID NO: 115554

SEQ ID NO: 116113 - DNA, 601 bp, Human; identical to SEQ ID NO: 115555

SEQ ID NO: 116114 - DNA, 601 bp, Human; identical to SEQ ID NO: 115556

SEQ ID NO: 116115 - DNA, 601 bp, Human; identical to SEQ ID NO: 115557

SEQ ID NO: 116116 - DNA, 601 bp, Human; identical to SEQ ID NO: 115558

SEQ ID NO: 116117 - DNA, 601 bp, Human; identical to SEQ ID NO: 115559

SEQ ID NO: 116118 - DNA, 601 bp, Human; identical to SEQ ID NO: 115560

SEQ ID NO: 116119 - DNA, 601 bp, Human; identical to SEQ ID NO: 115561

SEQ ID NO: 116120 - DNA, 601 bp, Human; identical to SEQ ID NO: 115562

SEQ ID NO: 116121 - DNA, 601 bp, Human; identical to SEQ ID NO: 115563

SEQ ID NO: 116122 - DNA, 601 bp, Human; identical to SEQ ID NO: 115564

SEQ ID NO: 116123 - DNA, 601 bp, Human; identical to SEQ ID NO: 115565

SEQ ID NO: 116124 - DNA, 601 bp, Human; identical to SEQ ID NO: 115566

SEQ ID NO: 116125 - DNA, 601 bp, Human; identical to SEQ ID NO: 115567

SEQ ID NO: 116126 - DNA, 601 bp, Human; identical to SEQ ID NO: 115568

SEQ ID NO: 116127 - DNA, 601 bp, Human; identical to SEQ ID NO: 115569

SEQ ID NO: 116128 - DNA, 601 bp, Human; identical to SEQ ID NO: 115570

SEQ ID NO: 116129 - DNA, 601 bp, Human; identical to SEQ ID NO: 115571

SEQ ID NO: 116130 - DNA, 601 bp, Human; identical to SEQ ID NO: 115572

SEQ ID NO: 116131 - DNA, 601 bp, Human; identical to SEQ ID NO: 115573

SEQ ID NO: 116132 - DNA, 601 bp, Human; identical to SEQ ID NO: 115574

SEQ ID NO: 116133 - DNA, 601 bp, Human; identical to SEQ ID NO: 115482

SEQ ID NO: 116134 - DNA, 601 bp, Human; identical to SEQ ID NO: 115483

SEQ ID NO: 116135 - DNA, 601 bp, Human; identical to SEQ ID NO: 115484

SEQ ID NO: 116136 - DNA, 601 bp, Human; identical to SEQ ID NO: 115485

SEQ ID NO: 116137 - DNA, 601 bp, Human; identical to SEQ ID NO: 115486

SEQ ID NO: 116138 - DNA, 601 bp, Human; identical to SEQ ID NO: 115487

SEQ ID NO: 116139 - DNA, 601 bp, Human; identical to SEQ ID NO: 115488

SEQ ID NO: 116140 - DNA, 601 bp, Human; identical to SEQ ID NO: 115489

SEQ ID NO: 116141 - DNA, 601 bp, Human; identical to SEQ ID NO: 115490

SEQ ID NO: 116142 - DNA, 601 bp, Human; identical to SEQ ID NO: 115491

SEQ ID NO: 116143 - DNA, 601 bp, Human; identical to SEQ ID NO: 115492

SEQ ID NO: 116144 - DNA, 601 bp, Human; identical to SEQ ID NO: 115493

SEQ ID NO: 116145 - DNA, 601 bp, Human; identical to SEQ ID NO: 115494

SEQ ID NO: 116146 - DNA, 601 bp, Human; identical to SEQ ID NO: 115495

SEQ ID NO: 116147 - DNA, 601 bp, Human; identical to SEQ ID NO: 115496

SEQ ID NO: 116148 - DNA, 601 bp, Human; identical to SEQ ID NO: 115497

SEQ ID NO: 116149 - DNA, 601 bp, Human; identical to SEQ ID NO: 115498

SEQ ID NO: 116150 - DNA, 601 bp, Human; identical to SEQ ID NO: 115499

SEQ ID NO: 116151 - DNA, 601 bp, Human; identical to SEQ ID NO: 115500

SEQ ID NO: 116152 - DNA, 601 bp, Human; identical to SEQ ID NO: 115501

SEQ ID NO: 116153 - DNA, 601 bp, Human; identical to SEQ ID NO: 115502

SEQ ID NO: 116154 - DNA, 601 bp, Human; identical to SEQ ID NO: 115503

SEQ ID NO: 116155 - DNA, 601 bp, Human; identical to SEQ ID NO: 115504

SEQ ID NO: 116156 - DNA, 601 bp, Human; identical to SEQ ID NO: 115505

SEQ ID NO: 116157 - DNA, 601 bp, Human; identical to SEQ ID NO: 115506

SEQ ID NO: 116158 - DNA, 601 bp, Human; identical to SEQ ID NO: 115507

SEQ ID NO: 116159 - DNA, 601 bp, Human; identical to SEQ ID NO: 115508

SEQ ID NO: 116160 - DNA, 601 bp, Human; identical to SEQ ID NO: 115509

SEQ ID NO: 116161 - DNA, 601 bp, Human; identical to SEQ ID NO: 115510

SEQ ID NO: 116162 - DNA, 601 bp, Human; identical to SEQ ID NO: 115511

SEQ ID NO: 116163 - DNA, 601 bp, Human; identical to SEQ ID NO: 115512

SEQ ID NO: 116164 - DNA, 601 bp, Human; identical to SEQ ID NO: 115513

SEQ ID NO: 116165 - DNA, 601 bp, Human; identical to SEQ ID NO: 115514

SEQ ID NO: 116166 - DNA, 601 bp, Human; identical to SEQ ID NO: 115515

SEQ ID NO: 116167 - DNA, 601 bp, Human; identical to SEQ ID NO: 115516

SEQ ID NO: 116168 - DNA, 523 bp, Human; identical to SEQ ID NO: 115517

SEQ ID NO: 116169 - DNA, 601 bp, Human; identical to SEQ ID NO: 115518

SEQ ID NO: 116170 - DNA, 601 bp, Human; identical to SEQ ID NO: 115519

SEQ ID NO: 116171 - DNA, 601 bp, Human; identical to SEQ ID NO: 115520

SEQ ID NO: 116172 - DNA, 601 bp, Human; identical to SEQ ID NO: 115521

SEQ ID NO: 116173 - DNA, 601 bp, Human; identical to SEQ ID NO: 115522

SEQ ID NO: 116174 - DNA, 601 bp, Human; identical to SEQ ID NO: 115523

SEQ ID NO: 116175 - DNA, 601 bp, Human; identical to SEQ ID NO: 115524

SEQ ID NO: 116176 - DNA, 601 bp, Human; identical to SEQ ID NO: 115525

SEQ ID NO: 116177 - DNA, 601 bp, Human; identical to SEQ ID NO: 115526

SEQ ID NO: 116178 - DNA, 601 bp, Human; identical to SEQ ID NO: 115527

SEQ ID NO: 116179 - DNA, 601 bp, Human; identical to SEQ ID NO: 115528

SEQ ID NO: 116180 - DNA, 601 bp, Human; identical to SEQ ID NO: 115529

SEQ ID NO: 116181 - DNA, 601 bp, Human; identical to SEQ ID NO: 115530

SEQ ID NO: 116182 - DNA, 601 bp, Human; identical to SEQ ID NO: 115531

SEQ ID NO: 116183 - DNA, 601 bp, Human; identical to SEQ ID NO: 115532

SEQ ID NO: 116184 - DNA, 601 bp, Human; identical to SEQ ID NO: 115533

SEQ ID NO: 116185 - DNA, 601 bp, Human; identical to SEQ ID NO: 115534

SEQ ID NO: 116186 - DNA, 601 bp, Human; identical to SEQ ID NO: 115535

SEQ ID NO: 116187 - DNA, 601 bp, Human; identical to SEQ ID NO: 115536

SEQ ID NO: 116188 - DNA, 601 bp, Human; identical to SEQ ID NO: 115537

SEQ ID NO: 116189 - DNA, 601 bp, Human; identical to SEQ ID NO: 115538

SEQ ID NO: 116190 - DNA, 601 bp, Human; identical to SEQ ID NO: 115539

SEQ ID NO: 116191 - DNA, 601 bp, Human; identical to SEQ ID NO: 115540

SEQ ID NO: 116192 - DNA, 601 bp, Human; identical to SEQ ID NO: 115541

SEQ ID NO: 116193 - DNA, 601 bp, Human; identical to SEQ ID NO: 115542

SEQ ID NO: 116194 - DNA, 601 bp, Human; identical to SEQ ID NO: 115543

SEQ ID NO: 116195 - DNA, 601 bp, Human; identical to SEQ ID NO: 115544

SEQ ID NO: 116196 - DNA, 601 bp, Human; identical to SEQ ID NO: 115545

SEQ ID NO: 116197 - DNA, 601 bp, Human; identical to SEQ ID NO: 115546

SEQ ID NO: 116198 - DNA, 601 bp, Human; identical to SEQ ID NO: 115547

SEQ ID NO: 116199 - DNA, 601 bp, Human; identical to SEQ ID NO: 115548

SEQ ID NO: 116200 - DNA, 601 bp, Human; identical to SEQ ID NO: 115549

SEQ ID NO: 116201 - DNA, 601 bp, Human; identical to SEQ ID NO: 115550

SEQ ID NO: 116202 - DNA, 601 bp, Human; identical to SEQ ID NO: 115551

SEQ ID NO: 116203 - DNA, 601 bp, Human; identical to SEQ ID NO: 115552

SEQ ID NO: 116204 - DNA, 601 bp, Human; identical to SEQ ID NO: 115553

SEQ ID NO: 116205 - DNA, 601 bp, Human; identical to SEQ ID NO: 115554

SEQ ID NO: 116206 - DNA, 601 bp, Human; identical to SEQ ID NO: 115555

SEQ ID NO: 116207 - DNA, 601 bp, Human; identical to SEQ ID NO: 115556

SEQ ID NO: 116208 - DNA, 601 bp, Human; identical to SEQ ID NO: 115557

SEQ ID NO: 116209 - DNA, 601 bp, Human; identical to SEQ ID NO: 115558

SEQ ID NO: 116210 - DNA, 601 bp, Human; identical to SEQ ID NO: 115559

SEQ ID NO: 116211 - DNA, 601 bp, Human; identical to SEQ ID NO: 115560

SEQ ID NO: 116212 - DNA, 601 bp, Human; identical to SEQ ID NO: 115561

SEQ ID NO: 116213 - DNA, 601 bp, Human; identical to SEQ ID NO: 115562

SEQ ID NO: 116214 - DNA, 601 bp, Human; identical to SEQ ID NO: 115563

SEQ ID NO: 116215 - DNA, 601 bp, Human; identical to SEQ ID NO: 115564

SEQ ID NO: 116216 - DNA, 601 bp, Human; identical to SEQ ID NO: 115565

SEQ ID NO: 116217 - DNA, 601 bp, Human; identical to SEQ ID NO: 115566

SEQ ID NO: 116218 - DNA, 601 bp, Human; identical to SEQ ID NO: 115567

SEQ ID NO: 116219 - DNA, 601 bp, Human; identical to SEQ ID NO: 115568

SEQ ID NO: 116220 - DNA, 601 bp, Human; identical to SEQ ID NO: 115569

SEQ ID NO: 116221 - DNA, 601 bp, Human; identical to SEQ ID NO: 115570

SEQ ID NO: 116222 - DNA, 601 bp, Human; identical to SEQ ID NO: 115571

SEQ ID NO: 116223 - DNA, 601 bp, Human; identical to SEQ ID NO: 115572

SEQ ID NO: 116224 - DNA, 601 bp, Human; identical to SEQ ID NO: 115573

SEQ ID NO: 116225 - DNA, 601 bp, Human; identical to SEQ ID NO: 115574

SEQ ID NO: 116226 - DNA, 601 bp, Human; identical to SEQ ID NO: 115482

SEQ ID NO: 116227 - DNA, 601 bp, Human; identical to SEQ ID NO: 115483

SEQ ID NO: 116228 - DNA, 601 bp, Human; identical to SEQ ID NO: 115484

SEQ ID NO: 116229 - DNA, 601 bp, Human; identical to SEQ ID NO: 115485

SEQ ID NO: 116230 - DNA, 601 bp, Human; identical to SEQ ID NO: 115486

SEQ ID NO: 116231 - DNA, 601 bp, Human; identical to SEQ ID NO: 115487

SEQ ID NO: 116232 - DNA, 601 bp, Human; identical to SEQ ID NO: 115488

SEQ ID NO: 116233 - DNA, 601 bp, Human; identical to SEQ ID NO: 115489

SEQ ID NO: 116234 - DNA, 601 bp, Human; identical to SEQ ID NO: 115490

SEQ ID NO: 116235 - DNA, 601 bp, Human; identical to SEQ ID NO: 115491

SEQ ID NO: 116236 - DNA, 601 bp, Human; identical to SEQ ID NO: 115492

SEQ ID NO: 116237 - DNA, 601 bp, Human; identical to SEQ ID NO: 115493

SEQ ID NO: 116238 - DNA, 601 bp, Human; identical to SEQ ID NO: 115494

SEQ ID NO: 116239 - DNA, 601 bp, Human; identical to SEQ ID NO: 115495

SEQ ID NO: 116240 - DNA, 601 bp, Human; identical to SEQ ID NO: 115496

SEQ ID NO: 116241 - DNA, 601 bp, Human; identical to SEQ ID NO: 115497

SEQ ID NO: 116242 - DNA, 601 bp, Human; identical to SEQ ID NO: 115498

SEQ ID NO: 116243 - DNA, 601 bp, Human; identical to SEQ ID NO: 115499

SEQ ID NO: 116244 - DNA, 601 bp, Human; identical to SEQ ID NO: 115500

SEQ ID NO: 116245 - DNA, 601 bp, Human; identical to SEQ ID NO: 115501

SEQ ID NO: 116246 - DNA, 601 bp, Human; identical to SEQ ID NO: 115502

SEQ ID NO: 116247 - DNA, 601 bp, Human; identical to SEQ ID NO: 115503

SEQ ID NO: 116248 - DNA, 601 bp, Human; identical to SEQ ID NO: 115504

SEQ ID NO: 116249 - DNA, 601 bp, Human; identical to SEQ ID NO: 115505

SEQ ID NO: 116250 - DNA, 601 bp, Human; identical to SEQ ID NO: 115506

SEQ ID NO: 116251 - DNA, 601 bp, Human; identical to SEQ ID NO: 115507

SEQ ID NO: 116252 - DNA, 601 bp, Human; identical to SEQ ID NO: 115508

SEQ ID NO: 116253 - DNA, 601 bp, Human; identical to SEQ ID NO: 115509

SEQ ID NO: 116254 - DNA, 601 bp, Human; identical to SEQ ID NO: 115510

SEQ ID NO: 116255 - DNA, 601 bp, Human; identical to SEQ ID NO: 115511

SEQ ID NO: 116256 - DNA, 601 bp, Human; identical to SEQ ID NO: 115512

SEQ ID NO: 116257 - DNA, 601 bp, Human; identical to SEQ ID NO: 115513

SEQ ID NO: 116258 - DNA, 601 bp, Human; identical to SEQ ID NO: 115514

SEQ ID NO: 116259 - DNA, 601 bp, Human; identical to SEQ ID NO: 115515

SEQ ID NO: 116260 - DNA, 601 bp, Human; identical to SEQ ID NO: 115516

SEQ ID NO: 116261 - DNA, 523 bp, Human; identical to SEQ ID NO: 115517

SEQ ID NO: 116262 - DNA, 601 bp, Human; identical to SEQ ID NO: 115518

SEQ ID NO: 116263 - DNA, 601 bp, Human; identical to SEQ ID NO: 115519

SEQ ID NO: 116264 - DNA, 601 bp, Human; identical to SEQ ID NO: 115520

SEQ ID NO: 116265 - DNA, 601 bp, Human; identical to SEQ ID NO: 115521

SEQ ID NO: 116266 - DNA, 601 bp, Human; identical to SEQ ID NO: 115522

SEQ ID NO: 116267 - DNA, 601 bp, Human; identical to SEQ ID NO: 115523

SEQ ID NO: 116268 - DNA, 601 bp, Human; identical to SEQ ID NO: 115524

SEQ ID NO: 116269 - DNA, 601 bp, Human; identical to SEQ ID NO: 115525

SEQ ID NO: 116270 - DNA, 601 bp, Human; identical to SEQ ID NO: 115526

SEQ ID NO: 116271 - DNA, 601 bp, Human; identical to SEQ ID NO: 115527

SEQ ID NO: 116272 - DNA, 601 bp, Human; identical to SEQ ID NO: 115528

SEQ ID NO: 116273 - DNA, 601 bp, Human; identical to SEQ ID NO: 115529

SEQ ID NO: 116274 - DNA, 601 bp, Human; identical to SEQ ID NO: 115530

SEQ ID NO: 116275 - DNA, 601 bp, Human; identical to SEQ ID NO: 115531

SEQ ID NO: 116276 - DNA, 601 bp, Human; identical to SEQ ID NO: 115532

SEQ ID NO: 116277 - DNA, 601 bp, Human; identical to SEQ ID NO: 115533

SEQ ID NO: 116278 - DNA, 601 bp, Human; identical to SEQ ID NO: 115534

SEQ ID NO: 116279 - DNA, 601 bp, Human; identical to SEQ ID NO: 115535

SEQ ID NO: 116280 - DNA, 601 bp, Human; identical to SEQ ID NO: 115536

SEQ ID NO: 116281 - DNA, 601 bp, Human; identical to SEQ ID NO: 115537

SEQ ID NO: 116282 - DNA, 601 bp, Human; identical to SEQ ID NO: 115538

SEQ ID NO: 116283 - DNA, 601 bp, Human; identical to SEQ ID NO: 115539

SEQ ID NO: 116284 - DNA, 601 bp, Human; identical to SEQ ID NO: 115540

SEQ ID NO: 116285 - DNA, 601 bp, Human; identical to SEQ ID NO: 115541

SEQ ID NO: 116286 - DNA, 601 bp, Human; identical to SEQ ID NO: 115542

SEQ ID NO: 116287 - DNA, 601 bp, Human; identical to SEQ ID NO: 115543

SEQ ID NO: 116288 - DNA, 601 bp, Human; identical to SEQ ID NO: 115544

SEQ ID NO: 116289 - DNA, 601 bp, Human; identical to SEQ ID NO: 115545

SEQ ID NO: 116290 - DNA, 601 bp, Human; identical to SEQ ID NO: 115546

SEQ ID NO: 116291 - DNA, 601 bp, Human; identical to SEQ ID NO: 115547

SEQ ID NO: 116292 - DNA, 601 bp, Human; identical to SEQ ID NO: 115548

SEQ ID NO: 116293 - DNA, 601 bp, Human; identical to SEQ ID NO: 115549

SEQ ID NO: 116294 - DNA, 601 bp, Human; identical to SEQ ID NO: 115550

SEQ ID NO: 116295 - DNA, 601 bp, Human; identical to SEQ ID NO: 115551

SEQ ID NO: 116296 - DNA, 601 bp, Human; identical to SEQ ID NO: 115552

SEQ ID NO: 116297 - DNA, 601 bp, Human; identical to SEQ ID NO: 115553

SEQ ID NO: 116298 - DNA, 601 bp, Human; identical to SEQ ID NO: 115554

SEQ ID NO: 116299 - DNA, 601 bp, Human; identical to SEQ ID NO: 115555

SEQ ID NO: 116300 - DNA, 601 bp, Human; identical to SEQ ID NO: 115556

SEQ ID NO: 116301 - DNA, 601 bp, Human; identical to SEQ ID NO: 115557

SEQ ID NO: 116302 - DNA, 601 bp, Human; identical to SEQ ID NO: 115558

SEQ ID NO: 116303 - DNA, 601 bp, Human; identical to SEQ ID NO: 115559

SEQ ID NO: 116304 - DNA, 601 bp, Human; identical to SEQ ID NO: 115560

SEQ ID NO: 116305 - DNA, 601 bp, Human; identical to SEQ ID NO: 115561

SEQ ID NO: 116306 - DNA, 601 bp, Human; identical to SEQ ID NO: 115562

SEQ ID NO: 116307 - DNA, 601 bp, Human; identical to SEQ ID NO: 115563

SEQ ID NO: 116308 - DNA, 601 bp, Human; identical to SEQ ID NO: 115564

SEQ ID NO: 116309 - DNA, 601 bp, Human; identical to SEQ ID NO: 115565

SEQ ID NO: 116310 - DNA, 601 bp, Human; identical to SEQ ID NO: 115566

SEQ ID NO: 116311 - DNA, 601 bp, Human; identical to SEQ ID NO: 115567

SEQ ID NO: 116312 - DNA, 601 bp, Human; identical to SEQ ID NO: 115568

SEQ ID NO: 116313 - DNA, 601 bp, Human; identical to SEQ ID NO: 115569

SEQ ID NO: 116314 - DNA, 601 bp, Human; identical to SEQ ID NO: 115570

SEQ ID NO: 116315 - DNA, 601 bp, Human; identical to SEQ ID NO: 115571

SEQ ID NO: 116316 - DNA, 601 bp, Human; identical to SEQ ID NO: 115572

SEQ ID NO: 116317 - DNA, 601 bp, Human; identical to SEQ ID NO: 115573

SEQ ID NO: 116318 - DNA, 601 bp, Human; identical to SEQ ID NO: 115574

SEQ ID NO: 116319 - DNA, 601 bp, Human; identical to SEQ ID NO: 115482

SEQ ID NO: 116320 - DNA, 601 bp, Human; identical to SEQ ID NO: 115483

SEQ ID NO: 116321 - DNA, 601 bp, Human; identical to SEQ ID NO: 115484

SEQ ID NO: 116322 - DNA, 601 bp, Human; identical to SEQ ID NO: 115485

SEQ ID NO: 116323 - DNA, 601 bp, Human; identical to SEQ ID NO: 115486

SEQ ID NO: 116324 - DNA, 601 bp, Human; identical to SEQ ID NO: 115487

SEQ ID NO: 116325 - DNA, 601 bp, Human; identical to SEQ ID NO: 115488

SEQ ID NO: 116326 - DNA, 601 bp, Human; identical to SEQ ID NO: 115489

SEQ ID NO: 116327 - DNA, 601 bp, Human; identical to SEQ ID NO: 115490

SEQ ID NO: 116328 - DNA, 601 bp, Human; identical to SEQ ID NO: 115491

SEQ ID NO: 116329 - DNA, 601 bp, Human; identical to SEQ ID NO: 115492

SEQ ID NO: 116330 - DNA, 601 bp, Human; identical to SEQ ID NO: 115493

SEQ ID NO: 116331 - DNA, 601 bp, Human; identical to SEQ ID NO: 115494

SEQ ID NO: 116332 - DNA, 601 bp, Human; identical to SEQ ID NO: 115495

SEQ ID NO: 116333 - DNA, 601 bp, Human; identical to SEQ ID NO: 115496

SEQ ID NO: 116334 - DNA, 601 bp, Human; identical to SEQ ID NO: 115497

SEQ ID NO: 116335 - DNA, 601 bp, Human; identical to SEQ ID NO: 115498

SEQ ID NO: 116336 - DNA, 601 bp, Human; identical to SEQ ID NO: 115499

SEQ ID NO: 116337 - DNA, 601 bp, Human; identical to SEQ ID NO: 115500

SEQ ID NO: 116338 - DNA, 601 bp, Human; identical to SEQ ID NO: 115501

SEQ ID NO: 116339 - DNA, 601 bp, Human; identical to SEQ ID NO: 115502

SEQ ID NO: 116340 - DNA, 601 bp, Human; identical to SEQ ID NO: 115503

SEQ ID NO: 116341 - DNA, 601 bp, Human; identical to SEQ ID NO: 115504

SEQ ID NO: 116342 - DNA, 601 bp, Human; identical to SEQ ID NO: 115505

SEQ ID NO: 116343 - DNA, 601 bp, Human; identical to SEQ ID NO: 115506

SEQ ID NO: 116344 - DNA, 601 bp, Human; identical to SEQ ID NO: 115507

SEQ ID NO: 116345 - DNA, 601 bp, Human; identical to SEQ ID NO: 115508

SEQ ID NO: 116346 - DNA, 601 bp, Human; identical to SEQ ID NO: 115509

SEQ ID NO: 116347 - DNA, 601 bp, Human; identical to SEQ ID NO: 115510

SEQ ID NO: 116348 - DNA, 601 bp, Human; identical to SEQ ID NO: 115511

SEQ ID NO: 116349 - DNA, 601 bp, Human; identical to SEQ ID NO: 115512

SEQ ID NO: 116350 - DNA, 601 bp, Human; identical to SEQ ID NO: 115513

SEQ ID NO: 116351 - DNA, 601 bp, Human; identical to SEQ ID NO: 115514

SEQ ID NO: 116352 - DNA, 601 bp, Human; identical to SEQ ID NO: 115515

SEQ ID NO: 116353 - DNA, 601 bp, Human; identical to SEQ ID NO: 115516

SEQ ID NO: 116354 - DNA, 523 bp, Human; identical to SEQ ID NO: 115517

SEQ ID NO: 116355 - DNA, 601 bp, Human; identical to SEQ ID NO: 115518

SEQ ID NO: 116356 - DNA, 601 bp, Human; identical to SEQ ID NO: 115519

SEQ ID NO: 116357 - DNA, 601 bp, Human; identical to SEQ ID NO: 115520

SEQ ID NO: 116358 - DNA, 601 bp, Human; identical to SEQ ID NO: 115521

SEQ ID NO: 116359 - DNA, 601 bp, Human; identical to SEQ ID NO: 115522

SEQ ID NO: 116360 - DNA, 601 bp, Human; identical to SEQ ID NO: 115523

SEQ ID NO: 116361 - DNA, 601 bp, Human; identical to SEQ ID NO: 115524

SEQ ID NO: 116362 - DNA, 601 bp, Human; identical to SEQ ID NO: 115525

SEQ ID NO: 116363 - DNA, 601 bp, Human; identical to SEQ ID NO: 115526

SEQ ID NO: 116364 - DNA, 601 bp, Human; identical to SEQ ID NO: 115527

SEQ ID NO: 116365 - DNA, 601 bp, Human; identical to SEQ ID NO: 115528

SEQ ID NO: 116366 - DNA, 601 bp, Human; identical to SEQ ID NO: 115529

SEQ ID NO: 116367 - DNA, 601 bp, Human; identical to SEQ ID NO: 115530

SEQ ID NO: 116368 - DNA, 601 bp, Human; identical to SEQ ID NO: 115531

SEQ ID NO: 116369 - DNA, 601 bp, Human; identical to SEQ ID NO: 115532

SEQ ID NO: 116370 - DNA, 601 bp, Human; identical to SEQ ID NO: 115533

SEQ ID NO: 116371 - DNA, 601 bp, Human; identical to SEQ ID NO: 115534

SEQ ID NO: 116372 - DNA, 601 bp, Human; identical to SEQ ID NO: 115535

SEQ ID NO: 116373 - DNA, 601 bp, Human; identical to SEQ ID NO: 115536

SEQ ID NO: 116374 - DNA, 601 bp, Human; identical to SEQ ID NO: 115537

SEQ ID NO: 116375 - DNA, 601 bp, Human; identical to SEQ ID NO: 115538

SEQ ID NO: 116376 - DNA, 601 bp, Human; identical to SEQ ID NO: 115539

SEQ ID NO: 116377 - DNA, 601 bp, Human; identical to SEQ ID NO: 115540

SEQ ID NO: 116378 - DNA, 601 bp, Human; identical to SEQ ID NO: 115541

SEQ ID NO: 116379 - DNA, 601 bp, Human; identical to SEQ ID NO: 115542

SEQ ID NO: 116380 - DNA, 601 bp, Human; identical to SEQ ID NO: 115543

SEQ ID NO: 116381 - DNA, 601 bp, Human; identical to SEQ ID NO: 115544

SEQ ID NO: 116382 - DNA, 601 bp, Human; identical to SEQ ID NO: 115545

SEQ ID NO: 116383 - DNA, 601 bp, Human; identical to SEQ ID NO: 115546

SEQ ID NO: 116384 - DNA, 601 bp, Human; identical to SEQ ID NO: 115547

SEQ ID NO: 116385 - DNA, 601 bp, Human; identical to SEQ ID NO: 115548

SEQ ID NO: 116386 - DNA, 601 bp, Human; identical to SEQ ID NO: 115549

SEQ ID NO: 116387 - DNA, 601 bp, Human; identical to SEQ ID NO: 115550

SEQ ID NO: 116388 - DNA, 601 bp, Human; identical to SEQ ID NO: 115551

SEQ ID NO: 116389 - DNA, 601 bp, Human; identical to SEQ ID NO: 115552

SEQ ID NO: 116390 - DNA, 601 bp, Human; identical to SEQ ID NO: 115553

SEQ ID NO: 116391 - DNA, 601 bp, Human; identical to SEQ ID NO: 115554

SEQ ID NO: 116392 - DNA, 601 bp, Human; identical to SEQ ID NO: 115555

SEQ ID NO: 116393 - DNA, 601 bp, Human; identical to SEQ ID NO: 115556

SEQ ID NO: 116394 - DNA, 601 bp, Human; identical to SEQ ID NO: 115557

SEQ ID NO: 116395 - DNA, 601 bp, Human; identical to SEQ ID NO: 115558

SEQ ID NO: 116396 - DNA, 601 bp, Human; identical to SEQ ID NO: 115559

SEQ ID NO: 116397 - DNA, 601 bp, Human; identical to SEQ ID NO: 115560

SEQ ID NO: 116398 - DNA, 601 bp, Human; identical to SEQ ID NO: 115561

SEQ ID NO: 116399 - DNA, 601 bp, Human; identical to SEQ ID NO: 115562

SEQ ID NO: 116400 - DNA, 601 bp, Human; identical to SEQ ID NO: 115563

SEQ ID NO: 116401 - DNA, 601 bp, Human; identical to SEQ ID NO: 115564

SEQ ID NO: 116402 - DNA, 601 bp, Human; identical to SEQ ID NO: 115565

SEQ ID NO: 116403 - DNA, 601 bp, Human; identical to SEQ ID NO: 115566

SEQ ID NO: 116404 - DNA, 601 bp, Human; identical to SEQ ID NO: 115567

SEQ ID NO: 116405 - DNA, 601 bp, Human; identical to SEQ ID NO: 115568

SEQ ID NO: 116406 - DNA, 601 bp, Human; identical to SEQ ID NO: 115569

SEQ ID NO: 116407 - DNA, 601 bp, Human; identical to SEQ ID NO: 115570

SEQ ID NO: 116408 - DNA, 601 bp, Human; identical to SEQ ID NO: 115571

SEQ ID NO: 116409 - DNA, 601 bp, Human; identical to SEQ ID NO: 115572

SEQ ID NO: 116410 - DNA, 601 bp, Human; identical to SEQ ID NO: 115573

SEQ ID NO: 116411 - DNA, 601 bp, Human; identical to SEQ ID NO: 115574

SEQ ID NO: 116412 - DNA, 601 bp, Human; identical to SEQ ID NO: 40183

SEQ ID NO: 116413 - DNA, 601 bp, Human; identical to SEQ ID NO: 40184

SEQ ID NO: 116414 - DNA, 601 bp, Human
aacatgctttcctctctgttgtatttcattgcagtctcccaacacctccctttactcattccatataatccaactcaagcttgcctttctttgttatcttcttactcccattatcttggtctatttaagatgtccatttgtgtgtttccttagcatattaataattccaaattagagcactcacctttatttatcaattaatgaagctatgccctgggctcacaccgaagatccaagcattttgaaaggccaaggcaggaagattcctagagcccaggagtttcagaacagtctgggcaayatagtgagactaaaaatattctctaccaaaagaaaaacaaattagcttgtcatggtgtcacacacttgtagttccacctacaagtggaactagggaggctaaagtgggaggatggcttgagcccaggtggtccaggatgcagtgatctgtgctcatgcccctgcactccagcctggaaaacagagcatgtctcccaatgctttgaagcatagtgtcatcagtagaagtttgatgaatgaatgcatgaaagaatgtgattactgatttttcatgtttgattttataggactcagccaacta

SEQ ID NO: 116415 - DNA, 601 bp, Human
ttaatgaagctatgccctgggctcacaccgaagatccaagcattttgaaaggccaaggcaggaagattcctagagcccaggagtttcagaacagtctgggcaatatagtgagactaaaaatattctctaccaaaagaaaaacaaattagcttgtcatggtgtcacacacttgtagttccacctacaagtggaactagggaggctaaagtgggaggatggcttgagcccaggtggtccaggatgcagtgatctgtgctcatgcccctgcactccagcctggaaaacagagcatgtctcccartgctttgaagcatagtgtcatcagtagaagtttgatgaatgaatgcatgaaagaatgtgattactgatttttcatgtttgattttataggactcagccaactatgaagttttttgtttttgctttaatcttggctctcatgctttccatgactgtaagtatatctggaagttttaaaggatacattctcagtacttatcccaaggatctttcttattccttacgttctgccatatattcatgttcacctcaatacagctttaatatttctatgtaaagattttccttgaattaacctata

SEQ ID NO: 116416 - DNA, 601 bp, Human
gcccaggtggtccaggatgcagtgatctgtgctcatgcccctgcactccagcctggaaaacagagcatgtctcccaatgctttgaagcatagtgtcatcagtagaagtttgatgaatgaatgcatgaaagaatgtgattactgatttttcatgtttgattttataggactcagccaactatgaagttttttgtttttgctttaatcttggctctcatgctttccatgactgtaagtatatctggaagttttaaaggatacattctcagtacttatcccaaggatctttcttattccttacrttctgccatatattcatgttcacctcaatacagctttaatatttctatgtaaagattttccttgaattaacctatataagttcttaaaggacttagaataaatattcattacatacctgcgaacactcaagtacaattacttgaatataaaaataaaagaaaattaagcaagcttcataaatatgtgggactgagaactgtgaaaatatctttaaatattaaaagctctagaccacctgaagttagaaatctgaggaaagaacaaggtacacttcaatggaacctaagtattagagggtg

SEQ ID NO: 116417 - DNA, 601 bp, Human
ataggaacactttttcactggtggtgagaatgcacattagttcaaccattgtggaaaactatggattcctcaaggatctagaaccagaaataccatttgacctagcaatcccgttactgggtatatacccaaaagaatataaagcattctactataaagacatatgcctagatatgtttattgcagcactatttacaatagcaaagacatggaacaacccaaatgcccatcaatgatagactggataaagaaaatgtggtacgtatacaccatggaacactatgcggtcattaaaaggaaygagatcctgtcctttgcagggaaatggataaagctggaagccatcatcctcagaaaactaaaacaggaacagaaaaccaaacagcacatgcttcactcataagtgggagctgaacaatgagaacacatcagggaggggaacaacacacaccagggatggggggtaggaggtgacagaaggtaacatagagggctgatcaatagtgcagcaaaccaccatggcacatgtatacctatgaaacaatcctgcacattctgcacatgtatccctgaacttaaattaaaataaatcataaaataa

SEQ ID NO: 116418 - DNA, 601 bp, Human
gactcagccaactatgaagttttttgtctttgctttagtcttggctctcatgatttccatgattgtaagtatatctggaaattttaaatactacattctcagtacttatcccaagtgtctctcttattccttgtgttctggtatatactcatgttgacctcaatacagctttataagctttaatatttccctacaaggagtttctttgaattaacttatgtaagttctttaaggacttggaatagatattcatcacatacctacaaacactcaagtacaattacttgaatgtaaaagtaaragaaaatttagcgagctttttaaatatgtgggactaagatctgtgaaagtatctttaaatgtgaaaagctctagaccatctgaagttagaaatctgaggaaagaaaaaggtgcacttcaatggaacccaagtattagagggtgtcaaaataggaattttcaagtcatttcttgcacaacctactcttaaagtcagcatacaattatttaattcttcctaaaataaagctgcttattttaaaccataaaacaaatctccatatttattaagtgtcatgagttcccagctctattgtcattt

SEQ ID NO: 116419 - DNA, 601 bp, Human
tctgtccactcgttaaaccttcgcgacaaccctgtcagatcatgaggcaggtgttttccacggtcacacggtataccattaaaacctggacgggaacgcggcaaataccatgagggcccaaattccctaactgctcctttgcccagcctcacctaaagacctaaggggcctaaaaacttttgcgtccctgctggccttcagctaacgcggccgggggtaggatgggaagccgtggggcaagggaggttgcaggaagcccatccttcccctcctgcggcaggtacggtgaccctcctccagytttccagctctaatttaaaacgctgccacacagcgagcgacgctgccagctgcttcgcctacactaacccttgcgcctcacgaccagctgcattagaaaccaccaccccttttctcacgggagaaacaccggggccagataggtcaaatgacctcaccaaggtcacaatggctgtgaaaaagcgcagcgggtaccagccccgggccagctcactccgaagccagctgggttctcgagggtcccgcagcccacccggcttcggtggggccgtcgcaacccaccccggtccgtggtccgccc

SEQ ID NO: 116420 - DNA, 601 bp, Human
caacactttctcttctaaaaattttctgtccactcgttaaaccttcgcgacaaccctgtcagatcatgaggcaggtgttttccacggtcacacggtataccattaaaacctggacgggaacgcggcaaataccatgagggcccaaattccctaactgctcctttgcccagcctcacctaaagacctaaggggcctaaaaacttttgcgtccctgctggccttcagctaacgcggccgggggtaggatgggaagccgtggggcaagggaggttgcaggaagcccatccttcccctcctgcgrcaggtacggtgaccctcctccagttttccagctctaatttaaaacgctgccacacagcgagcgacgctgccagctgcttcgcctacactaacccttgcgcctcacgaccagctgcattagaaaccaccaccccttttctcacgggagaaacaccggggccagataggtcaaatgacctcaccaaggtcacaatggctgtgaaaaagcgcagcgggtaccagccccgggccagctcactccgaagccagctgggttctcgagggtcccgcagcccacccggcttcggtggggccgtcgcaa

SEQ ID NO: 116421 - DNA, 601 bp, Human
agcattgattggagctgccctgaatatacactccgattagcagcagttacaaatgaatgtttttcttttttggcagaaacagggtctagctatgctccccaggctggtcttaaactcctgccctcaagtgatcatcctacctcgtcctcccaaagtgctgggattccggcctacaagtgagttaagaaaaaatgagaggcaattcctaaactgtttatcaaaaatttacattaaaataacataagctattgactgactaaacgctgtcctttatatcacaaattcaggaataagatttggsttgagacatgggtgaggggcggcactgaagtccaatactcaggtctctgcgtcctgcatacctcatgtagctctcactactctgagctttttttccctttctcgggtaaaataataaaagaaaaactcagaaaagatatcaaaaggaattctcatgcatagtacattttactacctagagaggcacagcacgacagtggatggattcctcccacaaagcctaagctgtctcttggcttagcctgtttcatcttccccccgccccccatatactgagcgaccaccctaaataaacgcgaca

SEQ ID NO: 116422 - DNA, 601 bp, Human
catttaaagatggaggacaagctatagttcctgtcacactgaggtgagtgcagaaagggttagaaagaaacacattacaagggggagtttctttaaaagatttttcaaccaaaaacacatactttatgaccttcggcacaaagtaaaaaacatacataccttatacaaagctgcaacccccagggatagcacgaatgctacagccatatgatttcgcagacgcctggccagaaggccacgcatccgaggttttggcaaaacttcgggagccatggtagttactgtccttgatacgtatgcyaaccttaagagattcagaaaatatgattaagtacagagtttatttaagccacaaacttgagaatggccacctggaagcattgattggagctgccctgaatatacactccgattagcagcagttacaaatgaatgtttttcttttttggcagaaacagggtctagctatgctccccaggctggtcttaaactcctgccctcaagtgatcatcctacctcgtcctcccaaagtgctgggattccggcctacaagtgagttaagaaaaaatgagaggcaattcctaaactgtttatcaaaaat

SEQ ID NO: 116423 - DNA, 601 bp, Human
acaacgtggccatctctgaaacctcatctctacaaaaaatataaaaattagccagttccggtggtgtgtacctgcagtcccaggtaccgggagacagagtaagaccctgtttcaaagaaagaaaaaggaaagaaggaaagaaaatgaaaagaagggcagaaaaaggaaaggaaggaaaggtaaaggaaaagaaagggaaagaagttcagctacagatatatgcccacagaggaccctgtgaagacaaagggagccatctacaagccaacagaggcctcagaagatatcaaccctgccaacrgatttctagcctccagaactgcgagcaaatttaaggcacccagtctgtggttctttgttacggcattccagcaaactaacaagcttcatttaaagatggaggacaagctatagttcctgtcacactgaggtgagtgcagaaagggttagaaagaaacacattacaagggggagtttctttaaaagatttttcaaccaaaaacacatactttatgaccttcggcacaaagtaaaaaacatacataccttatacaaagctgcaacccccagggatagcacgaatgctacagccatatgattt

SEQ ID NO: 116424 - DNA, 545 bp, Human
cacccaataaattcagccctcctcacccttcaatgtttccatgtgcctaattcctcctggtcatgacacaagaacccaaatttagctaaactaaggagcaaaaattctgcatcacatccatcccttctacaaacatttacttcatgcccactatatatgccaggcagcaggaatctcaaggaccaaaagactttgtgtgcttgtctctccaaagagtcccaaagcataggtccacttagtgctcccactcagtgttccatctcctctttgctctcccagttctccctaactttttttttttgagacaaagtctggctctatcgcccagcctggagtgcagcggcacgatctcggctcactgcaacctccacctcccaatttttttttttttttttgagacagagtctcgctcttgttgcccaggctgaagtgtaatggtgcgaactcagctcactgtaacctccccttcctgggttcaagcaattctcctgcctcagcctgccgagcagctgggattacaggtgcccgacaccacgcccggctaa

SEQ ID NO: 116425 - DNA, 601 bp, Human
catccatctgacagagagacagccaagggtcctagcaaaaacccaccttcaagcctaaaacagcctgaaggctgaaaggccagactgttggacccagatcccacgaccctgagggagagctgcacatttgcccaccctttcaggactgattctttttgagtaatggccacaggcacactgggggaacagggtggaaccaggagaagctgcaccttgtgcagtggggaggagcctagtctcttcagctcctgtgtggtagcctagtattcaatctgtgaggtgggggcctgttagcaggacsccctcttgctttgctgagagtctgttttcttttttccttttcacccaataaattcagccctcctcacccttcaatgtttccatgtgcctaattcctcctggtcatgacacaagaacccaaatttagctaaactaaggagcaaaaattctgcatcacatccatcccttctacaaacatttacttcatgcccactatatatgccaggcagcaggaatctcaaggaccaaaagactttgtgtgcttgtctctccaaagagtcccaaagcataggtccacttagtgctcccactcagtgttcca

SEQ ID NO: 116426 - DNA, 601 bp, Human
aggtgtctattttgttttgttcgaggtttccgtacacaaagggtgggtggggttcaacagagaaagaaaaaatgaagattcaagacaaaaatggaaagtttaagtgacttattattttttttaaagatggggtctcgcctgtagtcccagctactcgggaggctgaggcaggagaatggcgtgaacccgggagacggaggttgcagtgagccgagatctcaccactgcactccagcctgggggacagagcgagactctgtctcaaaaaaataaaaaataaaaaaaaataaaaaataaaaawaaaataaaaaataaaaaagatggggtctccctctgcagaaatacacagaaatcatgctacttgatggagtaacgcagtaagaatcctttacctgaccagttttactgcttcacttctatttgaattcccaatttcttcccagtaataaaatcaagaggcagaggtcgggcgtggtggctcatgcctacaatcccagcactttgggaggccaaggggggcgaatcacaaggtcaggaattggagaccagcctggccaacatgatgaaaccccatctctactaaaaatacaaaaattagcca

SEQ ID NO: 116427 - DNA, 601 bp, Human
gtggtcattggtgctcccccacatcacaaaagtattgtgccacttattgctcatgtggacaaagatcaaaattcaaagtatggtttctaccaaatgtgtatcacttccacaccatcgtaaagtcaaaaaatcttaagtctaaacattgtgagggacagtcacctgtatttgcattttaccacaattagaaatttttttttaagtaacttcaaataaccatattacctttatattccaagattactttacactctgaaagataccagccttcctcatctcctcaaaatctttcatgacatcrtagtttctgtagaaatctgcgtatgccttctttctttgatcagccacacgaaactaaaaagcaaccatccattagagtttatttttcagattactggaaattagattccagattataatatataaagacaaggtagaacacatgtttttgttcaccctttaatttaaaccctacatttcctaaggggtggaggtggtgacagataaaaaggaagacaaagtctaagaaactgctaaatttgcaaagaaaagaatggggaataaggtgtctattttgttttgttcgaggtttccgtacaca

SEQ ID NO: 116428 - DNA, 601 bp, Human
aactaaaatagatcattcagctttaaaaagaaattctgacacatgctgtaacatggatgaaccttgagtacactacgctaagtgaaataagccagtcacaagaaaacaaatactgtgtgattctacttatgagatgcctggggtagccaaattcttagaaagtaacacagtggctgccagggtctgagtggaggtgtgaatgggttgcttaatggatatagggtttcaattctgtaagatgacgagttctggagactggttgcacaacaatgtgaatgaacttaacactactaaactgtayaattaaaaatggttaagatggcaaattttatattatagatgctccttaacttaccatcaggttacattctgataaaaccatcataagtttaaaatatcttaagttgaaaatgcatttaatacacctaacttacatcatagcttagccttccctaccttaaatgtgctcagaacacttatgttagcctacagctgaagaaaatcatctaacacaaagcctagcttataataaaacactgagtatctcacacaacactacagagtacagcatcagctgtttacccttgtgattatgtttctg

SEQ ID NO: 116429 - DNA, 601 bp, Human
ccctgttaaaaaaaaaattaacaagtgttggggaggatggaaagagtgtaaaatggtgcagccactatggaaaagggtatggcagtttcttaagaaattaaaaatcatatgatccaggaattccacttttgaatataccccaaaagaattgatagcaaggccttgaaggaatatttgcatgcctaggttcacagcatcactcacaacaatcaaaaagtggaagcaacccaagcatctactgatggatgaatggataacaatgtgacacaactaaaatagatcattcagctttaaaaagaaattctgacacatgctgtaacatggatgaaccttgagtacactacgctaagtgaaataagccagtcacaagaaaacaaatactgtgtgattctacttatgagatgcctggggtagccaaattcttagaaagtaacacagtggctgccagggtctgagtggaggtgtgaatgggttgcttaatggatatagggtttcaattctgtaagatgacgagttctggagactggttgcacaacaatgtgaatgaacttaacactactaaactgtacaattaaaaatggttaagatggcaaattttata

SEQ ID NO: 116430 - DNA, 601 bp, Human
ctcatctcttactatgtctaatttatgagttaaacgtcatcataggtatgtacgtacacgaaaaacaacataatatatacagggtttggtactatctgtggtttcaagaatccactagaggggtcttgaaacatatcttagataaaacggactactgtaatcaaaacagtgtagtactgccccgaagacagacatacagactaaagaaatagcccagaaataaactctcgcatttagagtcaaatgatttcaccaaggtaccaagaccactccatggaagaggacaatcttaaatgatttygggaaaactggataccacatgtaaaagaatacagttggatctttacaccctacacaaaaattcaagtgaatcaaagatctaaacataagagctaaaactataaaagtcttagaagaacacataaaaaagacttcatgacattggatttggcaatgatttattgaatatgacactaaaagcacacagaacaaaaataaaaataaattcgacatcaaaatttctgtgcatcaagggacacaacagagtgaaaaggcaacctatgaaatgggagaaaatatttacaaatcatatctgataagg

SEQ ID NO: 116431 - DNA, 601 bp, Human
tacagtacagcaagatattgagagatcacattcaccttttattactatacactacaattgttctattttgttattgttgctcatctcttactatgtctaatttatgagttaaacgtcatcataggtatgtacgtacacgaaaaacaacataatatatacagggtttggtactatctgtggtttcaagaatccactagaggggtcttgaaacatatcttagataaaacggactactgtaatcaaaacagtgtagtactgccccgaagacagacatacagactaaagaaatagcccagaaatraactctcgcatttagagtcaaatgatttcaccaaggtaccaagaccactccatggaagaggacaatcttaaatgatttcgggaaaactggataccacatgtaaaagaatacagttggatctttacaccctacacaaaaattcaagtgaatcaaagatctaaacataagagctaaaactataaaagtcttagaagaacacataaaaaagacttcatgacattggatttggcaatgatttattgaatatgacactaaaagcacacagaacaaaaataaaaataaattcgacatcaaaatttc

SEQ ID NO: 116432 - DNA, 601 bp, Human
taaattaggcatagtaagagagtagcaacactaaaagaaattaaagatgcaaactactgctaaaagaaattaaagatacaaataagaggaaagacatcctgtgttcatggattggaatacttaatattgttacgatgtccatactaccaaagtaatctacagatttaatgcaatccctatcaaaatcccaatggcatttttacagaaatagaaaaatccatcctaaaattcacagactcttaaggaaccacaaatagctagagcaccctccgggtggggtgaaagaaagaacaaagctagrggactcacacttactgattttaaagcatactacaaagctacagtgtagcagtcatcccttatttgtggtttaaccttccacagctttagttctacccacagtcaactgtggttcaaaaacaggtgagtacagtacagcaagatattgagagatcacattcaccttttattactatacactacaattgttctattttgttattgttgctcatctcttactatgtctaatttatgagttaaacgtcatcataggtatgtacgtacacgaaaaacaacataatatatacagggtttggtacta

SEQ ID NO: 116433 - DNA, 601 bp, Human
cgcattaaaagaatcatgtactatgattaagtgggatttatccctaggatgcaaggatagttcaacatatgcaaatcaatagatgtgacataccacactgacagaatgaaggataaaaaacacatctcaaaaaatgcagaaaaagtacttgacaaaattcaacatcctttcatgatcaaaactatcaacagaaggaatgtacttcaacccaacaatggccaaaaaggacaagtctagtatactgaacatggaaaacgtgaaagcttttcctctaatacctagaaccagacaaggatgcccrctcttgccacttctattcattgtagtactggaagtcctagccagagcaatgaggcaagaaggaataagcaacatccaaaaaggaaaggagtaagtaaaactatctgtttacagatcatataatcttacctccagcaaaccctaaagatttctaacacacaagtgtcagaatacatgaattctactaagttggaggatacaaaaatcagctctttctacacaccaacaatgaaggaaataaaggaatgcctaataaaggaaattaagaaaataattctatttataatagcaccaaaaataa

SEQ ID NO: 116434 - DNA, 601 bp, Human
tctgaacgtctataactagtaggaatttttaatcagtagccaaaaacttcaaaaaacaagagtccaagaccatatggtgaatcctaccaaacttttttgagacagggtctcatattctgttatccaggatggagtgcagtggtgtgatcatagcttatgcagccttaaactcctgtgctcaagtgaacctcctgcctcagcctcccaagtaactgagactacaggcatgtaccaccacacccagctaactatatatatatctgtgtgtgtgtatatatatgtgtgtgtgtgtatatatgtrtgtgtgtgtgtgtgtgtgtgtatatatatatatatattttttttttttggtagagatggggtcttgccatgttgcacaggctgatctctaacttctggattatagtgatcctcctttctcagcctcccaaagtgctgggattacaggcatgagccaccatgcccagccctctatgaaaccagcaccaatcctcctcaagtttttccaaaaacagtgaggaaaagggaacatttccacattcattctataaggccagcattatcctgatatcaaagacaaacacacgagaaaactataggc

SEQ ID NO: 116435 - DNA, 601 bp, Human
atttttaaaaaactgtatcaacctaagaactagaaaaagaggaattaaacccaaatgtagctgaataatattaaacaaaatagactacaatagagaaaaatcaaagccaacagttagttctttgaaaagatcaaatcaacaaacctttagtcagactaataaaaaaagagaaccaccaactaacagagggaacattacaactgattttacagatctaaaaaggagtgagaatgctatgaacaattatatgtaaacaaactggatgacctaatgaaatagaaatacataactcaaaaaaaaattttgtgggggagtggggacagcatctccctctgatgcctaggctggagtgcagtggtacaatcactgctcactgcagccttgacctcccaggctcaggtaatcttcccaggtagctgggactgcaggcgtgtgccatcacacccacattattttttgtattttttttgtagagacggggtttcgccatgttgcccaggctggtttcaaactcctgggctcaagcaattcacctgctttggtctcccaaagtgctgggattacaggccttatgagctaccacacccactctagaaacaca

SEQ ID NO: 116436 - DNA, 601 bp, Human
gaagctggaggcaaactcaggaaaactaagaaaaactgaaaggcagctgtgtataggaggaaactaaaactaatgcatatgcacaggcccagggaagatggcatccccaggaaaagtttgagaggacaccaagcctttatggtgcgctaatcagtgaaggcctttccatgcatggagccagtctgcaaagggacaggtagctggttttgcaaatgcctgaatttcacaaaagatcacaaggcacataaagaaatagggaaacacggacgattgaaagaaagaaatctccacaaaccaaccytaaagaaacagaggctgctgacttactctataaaaccttaagaacaactatctaaaaaatgctcaatgagctaaaggagagtgtggacaactaagcaaaattagataaacaatatataaacaagtgagaatataaacaaagagaaaattatttctaaaaaccaaacacactgtggagctgaaaaatgtagtaactgaatggggggagaaggggtcggaatcactagagggatttaacagcagactcaggcagaggaaagaatcaggaaacttcaagacagatcatttgaagttatcaagt

SEQ ID NO: 116437 - DNA, 601 bp, Human
gactccaagaggaagctggaggcaaactcaggaaaactaagaaaaactgaaaggcagctgtgtataggaggaaactaaaactaatgcatatgcacaggcccagggaagatggcatccccaggaaaagtttgagaggacaccaagcctttatggtgcgctaatcagtgaaggcctttccatgcatggagccagtctgcaaagggacaggtagctggttttgcaaatgcctgaatttcacaaaagatcacaaggcacataaagaaatagggaaacacggacgattgaaagaaagaaatctccwcaaaccaaccctaaagaaacagaggctgctgacttactctataaaaccttaagaacaactatctaaaaaatgctcaatgagctaaaggagagtgtggacaactaagcaaaattagataaacaatatataaacaagtgagaatataaacaaagagaaaattatttctaaaaaccaaacacactgtggagctgaaaaatgtagtaactgaatggggggagaaggggtcggaatcactagagggatttaacagcagactcaggcagaggaaagaatcaggaaacttcaagacagatcatttga

SEQ ID NO: 116438 - DNA, 601 bp, Human
ctacattgttcttttttgttaaatatacacataagattccagagtaggaagtctcatcaaggtacttcatacatgctatcaaatcagtttagatgactttccatcagcacaccagtcagtccttttctagataatagaactttaattcacactgtccatgaggcataaggaccttgtgaatacaacagaccaaaccagacctatggaaagacagctagtcactcgtggacacccacctaacaaactatactgtcccaaatacttttttttaaaaaagtgacttctaaaagtgtaacattcrtaatgccaatctagcaattaatagcataacctataaaaatgattttgaacataaaaagtagtttcatgtcagcaagatagactgtgaagctgccaggcccccaaacccccacaaaaaataatgaataaacatatggaccaaaaatttaaaaatgtttagctttatgagaactctagaaaccagttgagcagcaaccaaaggaaccacctatccaagaaaaagccacactcaaagtagcaggaaatttcatggcatttttgctcactcttgccaaatgccctcctcagtacaatagtcaga

SEQ ID NO: 116439 - DNA, 601 bp, Human
tcttaaaaatggtaaaaatctaacaaatttaaattagcctattaacatcttctgattataaaatgcatgctcactgtaaattttgaaaatttcaaagttaaagcagatatgttaagattataaacaaccattaatattttcttgattttttttccttaatacacatggtacccaacttatgatggtttgacttacaatttttttgactttctaatgggttttccagggtcttaaatgcatttttgacttacgatattctcaacatatgataaggtttattggaatgtaacccacatatatrtagtgcaactgaaatgcttatttaggaacactgcctgacaaaatagcagtttcacattctctgtgtcacagcaaactcatttacaaggcataaacccagactgaagtggcaaaaagaaactacattgttcttttttgttaaatatacacataagattccagagtaggaagtctcatcaaggtacttcatacatgctatcaaatcagtttagatgactttccatcagcacaccagtcagtccttttctagataatagaactttaattcacactgtccatgaggcataaggaccttgtgaat

SEQ ID NO: 116440 - DNA, 601 bp, Human
acaccttgatcactcaccctcagccacagaaaaagcacagttcaggctacctggactccaagtttcactctcctttacgctcctctaagctccctgaccactctgaatagcctcttttccattttgggcataccacaccttactctcattgcttgtgtgcattgaacaaattctgcttttttccttctcaattctatgcccaccaccgcccccacccccctgccattaacccttatagccacatactgtttctgttccaagccatatttttgttcctgtctccaaatatgttctctcatayaggtttttaaacataatcttaaaaatggtaaaaatctaacaaatttaaattagcctattaacatcttctgattataaaatgcatgctcactgtaaattttgaaaatttcaaagttaaagcagatatgttaagattataaacaaccattaatattttcttgattttttttccttaatacacatggtacccaacttatgatggtttgacttacaatttttttgactttctaatgggttttccagggtcttaaatgcatttttgacttacgatattctcaacatatgataaggtttattggaa

SEQ ID NO: 116441 - DNA, 601 bp, Human
tgtgaagagaaacacaaaggctaagttagagataaacactctctcaatactcaccatctttgaggatcaactgaggtctattcctactagtagacttcacaccttgatcactcaccctcagccacagaaaaagcacagttcaggctacctggactccaagtttcactctcctttacgctcctctaagctccctgaccactctgaatagcctcttttccattttgggcataccacaccttactctcattgcttgtgtgcattgaacaaattctgcttttttccttctcaattctatgcccamcaccgcccccacccccctgccattaacccttatagccacatactgtttctgttccaagccatatttttgttcctgtctccaaatatgttctctcatacaggtttttaaacataatcttaaaaatggtaaaaatctaacaaatttaaattagcctattaacatcttctgattataaaatgcatgctcactgtaaattttgaaaatttcaaagttaaagcagatatgttaagattataaacaaccattaatattttcttgattttttttccttaatacacatggtacccaacttatgatggt

SEQ ID NO: 116442 - DNA, 601 bp, Human
gtgctagaacaatgaaattttaacaaaacacggaaatcaagttagcttcataaacagttaaatcccaaaccaattcttatgctagtaagtgccctgcattatcattaagaactgagaaagacttactgtccaaagtatttgttaattgtttatttatcaagaggaactatttcttagcccacatattcatgtgtcatagttcaggaacacaagtcagtgacaaacttctaggtaattcaacctgaagaaattctgtgaagagaaacacaaaggctaagttagagataaacactctctcaayactcaccatctttgaggatcaactgaggtctattcctactagtagacttcacaccttgatcactcaccctcagccacagaaaaagcacagttcaggctacctggactccaagtttcactctcctttacgctcctctaagctccctgaccactctgaatagcctcttttccattttgggcataccacaccttactctcattgcttgtgtgcattgaacaaattctgcttttttccttctcaattctatgcccaccaccgcccccacccccctgccattaacccttatagccacatactgtt

SEQ ID NO: 116443 - DNA, 601 bp, Human
tgtacctctgcgcctccctgggtttggggaaacaacacatcgtgtcctctgaagacctcaggctttgggatctcatggtccagcttccagttcacttcgttgccgcgaccttgggcatatcattgtcacttctctaaccatggtgacccggggttttgtgcttggcttccaggtcccctcgggttattgaggacgattgaggtcatgcctccgagagcaccgcgccctgggcgcaggaggagctgttgctcagtgttgtctgtgttgtaaggtggactttgtagaaacttggctttgaggtttttttttttttttttttttggccccttctaagcgaaagccttggacttattgcccaggtttctctggcccctgagaagccatatctcaccttccccgcgccttcggattgggtcttagactcagcccatgagactgtgggttgtttattaattgtgtggtcaccaaccatgcatttcaccactggtgggggggtggggttgccaggtttaaccagataaaaatacagcacacccagttaaatttgaatttcagataaacaatgaaagatttttttaaaaataaatgtttttgagtatgt

SEQ ID NO: 116444 - DNA, 601 bp, Human
cagataaaaatacagcacacccagttaaatttgaatttcagataaacaatgaaagatttttttaaaaataaatgtttttgagtatgtctcatgcaatatttgggacacacttatactaaaacattatctaatttatctgaaatgcaaatttaacagggcaccctgtattttacccagagggaagccgaagtgtttggcagatcatttggccccatgagccttgggtgggtttctcctcagccctagtgacccctaaaattacccccccgacccacccactgtcccctgatgcttcccccamccccggaaaaagctgtggcctccctctcatttggggcaggctgcctcctgttctctttttctggtgtttcagcaaggcaggccagtggaggtgaggtgaccagaagatggctaaagggaaaacaaaatggtgggcctctttttgggaaactgggccagggtttgggggccctgtgctggtggaggagagaagaccccagggcgatggtaggagacgaaagcttgggctgcagcgtaagcttggaggcccgctgcggtggctcacgcctgtaatcccagagctttgggaggctgagacagg

SEQ ID NO: 116445 - DNA, 601 bp, Human
gtgacagggactagccatgaggagtgagtacaaggacagggagtagagctttcctggagggagtcagcagggtccccttgagtggtgggtaaccctaagatggtcttgttggctaacccttggacctggacacaggagaacattcgaaattggccttagcctggagaatctgggatggattcttgtagtttatataggagtccgtgctggggaggagcagttggggctatattcctactgctgggacctcattttttcctttcctcccagaagctcaagtgtaatgggaagggaaaggtgytgaagtcagggtaaggtgacggggccgccaagacaggaggcgcggggcacacccagggccagctttgcagcaagttgggctgcagcctggtggttgtggggatttctgcacctggtgcttacaggtgtcaagagtgagggcatctgaggggggccagagagcccatctggggcaagctgtcgctccctggggcatgtgggcccaggtcatgttttcaagagtagccagaagtctggattcttatgcaaagcctgttttgttgtttgtttgtttgtttgtttgaagtttggcagcagattt

SEQ ID NO: 116446 - DNA, 601 bp, Human
agcactttgggaggccaaggcgggtgggtcacctgaggtcaagagtttgatgtcagcctggccaacatggtgaaacccgtctctactaaaaatacaaaaattagccgggcgtggtggcatgtgcttgtagtcccagctactcaggaggctgaggcaggagaatcgcttgaacccgggaggcggaggttgcagtgagccgagattgtgccactgcactccagcctgggccacagagcaggagtccgtctcaaaaaaataaaaaaaataaaaaaataagaaagtgatgagtatagcttaataccctcattggggaagaggagcaacgcccttttttgggtaggggtatgtgttctgtggtgatggttttggggggcaattgtgggaaacctcagctgctccgctgaacccgtgtgcccacccagtgtgtctgtggctgtgaaatcccatgtcctcctgggtgctcacttggtgccttaaacttgagctccatggcccctccgggtggctgcttagctgagcataggtccagctcagaggtagaattcttaatgttcttgcctctgtcccagagtcccctcaatgtccacacctagaaatacag

SEQ ID NO: 116447 - DNA, 601 bp, Human
gccaattttttcgtatttttagtagagacgcagtttcaccgtgttggccaggctcgtcttgaactcctgacctcgggtgatccacctgcctgggcctcccaaagtgctggagttaaggcgtgaaccagtgcgcccggcctgcaagttgtgtcttctgggccgagcgccccccccagggcttggcactgtgttttggggcaggtgtggtggtgcccacagttaggcacgttctccccacctttgtggttctgttcctgagcctctgaccatctgccaggccctgggctgatgcctcacatgyggcatctccgttatttttcctactcagcctgtggagttgatctttttaacctctcctctgtacaagtgagggcacaggctcagagaggtgaagccacttcacatggctcacctcagagctgtgaatggagctcaggtctgtctgactccaaagcgcaggttctctctgcgcttggagaggcttctggtgagtggagctgctggtgacaggggtccccggtgctaggaaagcctggtgtagggatgcggggctccaggagggctccaggaggggtggcgccatcccgacttccaccactag

SEQ ID NO: 116448 - DNA, 601 bp, Human
acaggggctaagtttctcgcccccatcttcagttatctgcccggcaagtcttgggtctctgggcagggctgtggctccattcttcaccccgtgatcacatgctcacccctgaacttgggcctttgttgtcccttctggttctagcctgggctcccggaatcaccagggctgctttccccaaagggactgagccttggtctctctccgcatctcccagggaagagcagggcaagctcctcgaaggcagttcctggctccggcccatgtctgtgccttgcccgccattaggtgtagaaatgcyggttgcatttgagaagatgtggtccctgctctcaaggaatttctaatctcgtttggggaagataattatagaatagcatgaaacagatatcagggaagtgccaaatggaatatgatcaaggggaaaacgtaagccctgggccatcgggaaggaccgggcagctctaggcttcaagggaccgtttgatttggaggcagacagaccagccccgattaacctgtgatgttaggcaggtgaccccacattgctgggccttagttccctcttttgtgtaatggagcagtaacatccaaatcgcgg

SEQ ID NO: 116449 - DNA, 601 bp, Human
atatgatcaaggggaaaacgtaagccctgggccatcgggaaggaccgggcagctctaggcttcaagggaccgtttgatttggaggcagacagaccagccccgattaacctgtgatgttaggcaggtgaccccacattgctgggccttagttccctcttttgtgtaatggagcagtaacatccaaatcgcggtttctgcaacagagcaaaagcaatatatcaccacggagaatacttagcactgtgccggctgtgcagacggtgccgagaaatgcaaattccctcttcatctgtgagccatkatgtgccatgtgccactcccccaccccctttccctctagggcgatggttctcggcctggctgagcaccttcagaagatgcagattcctgggcccatcaccagccgctgagtctctgcaggttgaggctgggaatctgccttgtggagggagagctttttattgttttaaacactcagtatctatatggttatatccatttgttactttagaactcttgaaaatttcatccttttaaataggtaaaatatgttacaaaattcaaattcaaaacaattttttgattaagacaatttacatat

SEQ ID NO: 116450 - DNA, 601 bp, Human
ccactcccccaccccctttccctctagggcgatggttctcggcctggctgagcaccttcagaagatgcagattcctgggcccatcaccagccgctgagtctctgcaggttgaggctgggaatctgccttgtggagggagagctttttattgttttaaacactcagtatctatatggttatatccatttgttactttagaactcttgaaaatttcatccttttaaataggtaaaatatgttacaaaattcaaattcaaaacaattttttgattaagacaatttacatatcatagaagtcactttttttttttttttaagagacagggtctctgttgcccagtctggagtgcaatggcaggatcatagctcactgcagcctcgacctcctgggctcaagcaatccttctatctctgcctcctgagtagctgagactgcaggcatgcatacctggctaatttatttattatttttatttattcatttatttttttgagacagagtctcactctgttgccagactggagtgcagtggtgcaatcttggctcactgcaacctccacctcccgggttcaagcaattcttctgcctcagcctcccaag

SEQ ID NO: 116451 - DNA, 601 bp, Human
cagggtctctgttgcccagtctggagtgcaatggcaggatcatagctcactgcagcctcgacctcctgggctcaagcaatccttctatctctgcctcctgagtagctgagactgcaggcatgcatacctggctaatttatttattatttttatttattcatttatttttttgagacagagtctcactctgttgccagactggagtgcagtggtgcaatcttggctcactgcaacctccacctcccgggttcaagcaattcttctgcctcagcctcccaagtagataggactacaggcgcgygccaccacgtccagctaatttttgtatttttaatagagacggggtttcaccatgttagccaggatggtcttgagttcttgacatcatgatccgcccgcctcggcctcccaaagtgctgggattaccggcgtgagccaccacgcccagccacacacctggcttatttatttatttaatagagacagggtctggctgtgttgctcaggctggtctcaaactcctggccccaagccatcctcctgcctgagcctcccaaagtgctgggattacaggcgtgagccaccatgcctggccagaagt

SEQ ID NO: 116452 - DNA, 601 bp, Human
gcagatcacgaggtcaggagttcgagaccagcctggccaatatattggtgaaacccgtctctactaaaaatacaaaaattagccgggtgtggtggcaggcacctgtagctccagctatttgggaggctgaggcagaagaatcgcttgaatctgggagttggagttggagcttgcagtgagccatgatcacgccactgcactctagcctgggtgacagaacgagactctgtctcaaaaaaaaaaaaaagaaaaaaggaatggcacgaaaagcatccccatcctccctcctttctcccggggycctccctcctttctcccggggtcttccttcctaactcctcttgcgcttttgtgctggaggtcagtggagtacactttgagaaaggctgccccagggggcctgcagctggtggaagtgagtgacctctgggtcacctggcattactttgtacctgggctgatggtagcctcttccccagatactctccctaaaagaggaggcaggtcctgccagccagggtgtttccacactgctgctgacagccccagaaacaggcaggcttattttccagggtgccggagctgggccagcctcagaacc

SEQ ID NO: 116453 - DNA, 601 bp, Human
ttgctttggctgctgggaatctccaaactggattttgtttgtttgttttgttttgttttgtttttgagatggagttttgctctgttgaccaggccagagtgcggtggcgtggtcttggctcactgcaatctatgcctcctgggttcaagcaattctcctgcctcagcctcccaagcagctgggattacagccatgcaccaccatccctgaccgatttttgtattttttagtaagacggggttccaccatgttggcaaggctggtctcaaactcctcgcctcaagtgatctgcccgccacgrcctcccaaagtgctgggattacaggcatgaaccaccgtgcccggcctccaaactggatttctgatttcatgttaatcccaccaggaccttgggaactgcccttccacgtctacacctaacttcctttgctgtttaatttcaaatgttgtaacttagccgggtacaggaaacacgcacctgtagtcctggctccttgggaggctgaggtgggagggtcgcttgagcccaggagttcaaggctgcagtgagctatgattgcacctgagagtagctgctgcactccagcctgggcaatacagt

SEQ ID NO: 116454 - DNA, 601 bp, Human
gctgaggtgggcggatcacctgaggttgggagttcgagactagcctgaccaacatggagaagccctgtctctactaaaaaatttacaaaattagccaggcgtgggggcgcgtgcctgtaatcccagctagtcgggaggctgaggcaggagaatcgcttgaactcaggaggcagaggttgcggtgagcggagattgcgccattgcactccagcctgggcaacaagagtgaaactatctcaaaaaagaaaaaagatacaaaaaattagctgggtgtagtggcgggcacctgtaatcccagctrctcaggaggctgaggcaggagaatcgcttgaacctaggaggcagaagctgcagtgagccgagatcgcaccactgcactccagcccaggcaacagggtgagactccgtctcaaaaaaagaaaaaagaaacgcacagtgggagccaggcacagtggctcacgcctgtaatcccagcactttgggaggctggtgtgggcgggtcacttgaggccaggagttcaagaccagcctggccaacatggcaaaaccccatctctactaaaaatataaaaattagctgggcatgatggcgtgtgcctgt

SEQ ID NO: 116455 - DNA, 601 bp, Human
ggaggctgaggcaagagaatggcgtgaacctgggaggtggagctttcagtgagccaagatcacgccactgcactacagcctgggcgacagagcaagactcagtctaaaaaaaaatagattaaaaaaaaaaataataataataataaatttaaattagcaggttgtggtgatgcgcacctatagtcacagctactctggaggctgaggatcatttgaacctgggagttggaggctgcagtgaacagtaattgcaccactgcattccactctgggcaacagagcaagaccccatctcttaaaaatatatatatataatatatatattatatatattatataatataatatataatataattatagtaaatattttattttgggccaggtgtggtggctcatgcctgtcatcccagcactttaggaggccgagatgggaggatcatttgaagtcaggagttggagaccagcctggtctctatggtaaaatcccatctctactaaaaatacaaaaattattgggtgtggtggcacacgcctgtaatcccagctacttgggaggctgaggcaggagaatcacttgaacctggaggcaaaggttgca

SEQ ID NO: 116456 - DNA, 601 bp, Human
attttcattttagtgcacgtgcagccgaaagccagtcagactgcagagtgtgtaaatgggaaggtcagggaaaggtgtgggccgggcaagttttctggaaggcttcaagtgggaggatgggtacagcaggggatgaaggagagggcggtgccccgggccctttagtccacaagactcagctgaagttagcccaagtatcagggtcacgctgttaccaggctaccaggctagaccagacgttaaacattagtgctcattgtcattcattaacagagcctcaggaacctacggggccagcttattgtgcgtgtgcttgccataggaaggaagtctagtttttctcaagggagaaatcggggagcacacatccttcttttttttttttaagtcccagaattcacaagaggatgcttttgtgtaacgagcaccccagagtacagttaaaatcagatccaggttacccgtgtggggccgcctgactgcctggtgcttcctcggcaggttgaggtagaggaggggcgtggggctgggagttgggcagatgggtccggcaagtggctctgctgctcccagcctcagtttccccctccggaaagtgaag

SEQ ID NO: 116457 - DNA, 601 bp, Human
tgtctctctctcccttttatttcctatcaagtggaactcagctccaggctggatgcagtcagacagaacgccttggcaatcccgcctcacggaccatgccgtgtcttctgtatcgcttccctgccagacacacaagacgtctggtttctacacccagaatgaggcctcaaatgtccccccaggattttaaatatgttaggccaccatccccagctggctgcctccagacgcagggtacagttggctcagtgtggggaaggtcaggccagtgccggaattctttgcctctctggacacatgkgatggctgtggtgcttgggtgggtgggtgggtgggggtcagggggcgggagtgagctcaggggtcccaggaggaggcgtatccagtatccagacccctaccacacggccgggtgcagtggctcaacgcctgtaatcccaccactttgggaggccgaggcaggaggattacctgaggtcaggagttcgagacgggtctggccaacatggtgaaaccccatctctactaaaaatacaaaattagccaggcgtggtggcaagtacctgtaatcccagctactcgggaggtggaggcagtgagc

SEQ ID NO: 116458 - DNA, 601 bp, Human
ctcacacctataatcctaatgctttggaaggctgaagcaggaggatcacttgaggccaagagtttgagaccagcctggatagcatagcaagaccctgtctctacaaaaaaatgctttaagatgagctgggcatggtggcatgtgcctgtggtcccagctactcaagaggctgaggcgggagtatcccttgagctcaggagttggaggctgcagtgagccgtgatcacacaactgaactccagcctgggtgacagagtgagaccctggctcaaaatataattatattaataaattttaaatrtatttaaaaatcagacaacctagtattaggaagataagtgtggcagagaattataaagtaggaaaggggtggggggtcttgctgaatgacctggagagttgcagttttaaatggggtggtcggggcggcctttgaataagacaaggctcaaactgggcgactgagcaagccatgtggggatctgggaggagagcagtgtgggcagaggtaagagtgagtgaggagctggaaaataagatgggcaccaggcgcggtggctcacgcctgtaatcccagcactttgggaggccgaggcaggcg

SEQ ID NO: 116459 - DNA, 601 bp, Human
tcttgctgaatgacctggagagttgcagttttaaatggggtggtcggggcggcctttgaataagacaaggctcaaactgggcgactgagcaagccatgtggggatctgggaggagagcagtgtgggcagaggtaagagtgagtgaggagctggaaaataagatgggcaccaggcgcggtggctcacgcctgtaatcccagcactttgggaggccgaggcaggcggatcacttgaggtcaggagttcaagaccagcctggccaacacggtgaaaccctgtctctactaaaaatacaaaaatyagcagagtgtggtggcatgtgcctgtaattccagctagtcaggaggctgaggcaagagaatcacttgaacccaggaggcggaggttgcagtgagccgaaattgtgccattgcactccagtctgggcgatagagcaagactctgtctcagaaaaattttaaaaagttaataataatacggggtcagacagcaggcagcgcctcaggtgtggggggctcgtaaggccactgcctggcctgggttttcatggtaagacgggagccactgggggcttgggtgacatgatctgaaggattaagaa

SEQ ID NO: 116460 - DNA, 601 bp, Human
taaaagaatggcataatactgtcctatatatccacctgctgaacttggcaattgttggcttttgggtttcttttgctttgtattttttctgggaccatttgaaagtaagttatagatctcaggacatttcatccctaaacatgtcagcacgtgtcttttaaaaataaagacattctgggctgggcacagtagcttatgcttataatctcagcactttgggaggctgaggcaggaggatcttttgagcccaggagttcaagaccaccctaggcaagaagacgaaaccccgtctctacaaaamatataaaaatgagcccggcatggtggcatgcgcctgtagtcccaggaggatcgactgaacctgagaggtcgaggctgcagtgagccatgattgcaccactccagcctgggtaacagggtgagaccttgctaaaaaaaaaaaaaaaaaaaaaaaaggcattctcttacagatttacaaataccgttactgcatctaagaaaatgagcagcattccggatggtctaacatggaggtatattttgaaggtgaggggagagcctgtgttgggcagtacataggggtgagtgcggacctgagggc

SEQ ID NO: 116461 - DNA, 601 bp, Human
atataaaaatgagcccggcatggtggcatgcgcctgtagtcccaggaggatcgactgaacctgagaggtcgaggctgcagtgagccatgattgcaccactccagcctgggtaacagggtgagaccttgctaaaaaaaaaaaaaaaaaaaaaaaaggcattctcttacagatttacaaataccgttactgcatctaagaaaatgagcagcattccggatggtctaacatggaggtatattttgaaggtgaggggagagcctgtgttgggcagtacataggggtgagtgcggacctgagggcractctgggcacctggagggacagcagtggctgagcgggtctggggagggcaggccaggtctggagcgccttgcacacccatgaggagctggcgagcatggaatgtggaatggcaaatgtgaccagcctgcagctagggccaccccagggctcagggcgtgtgtgtcctgggagcagccagtgtggttctaggagaaaggctgtcccctgctgcagagctgatccgcacccctgtgcaaggaggctctgggctggcgccagggccccagtcatagctgcactctgcttcctgcaccccaag

SEQ ID NO: 116462 - DNA, 601 bp, Human
gtggaatggcaaatgtgaccagcctgcagctagggccaccccagggctcagggcgtgtgtgtcctgggagcagccagtgtggttctaggagaaaggctgtcccctgctgcagagctgatccgcacccctgtgcaaggaggctctgggctggcgccagggccccagtcatagctgcactctgcttcctgcaccccaagaacccataggtcagcaggggagacagacactggaacgaaggactcattggcagagatgcagacagactctatccagcccgtggtgtgagaatctggctatacaraaccctgcagtatcattttttaaatttgaatgtgatgtcaaaatttaaaaattgagcttaaaacaggattgatttctagcttcttttgaagaatcagctttgacaataccgggcctgctcttccctggggcagttaccagctgaagcagaagagacccttccctgttgtctctaaaccaaggccaaagggcgcttgccttgtgttacctcatggccactgttgtttttcttattgtagattttaaaaggaaaattaagatatttcttgggttttttttttttttttccagacggagtctt

SEQ ID NO: 116463 - DNA, 601 bp, Human
ctctgcaggctgcgtccctggaagtggaaccgtttagtcagaggctgcatatgcactcagaatgtcacaggttctgcctggcttttccccccgagaagtcatgggtaggatgacaccactagcacaggggttctcagcctcagcacccctggcatttggagacggatcattctttttgtttttctgagacggagtctcgctgtgtcacccagggcggagtgcagtgatgcaatctgggctcattgcaacctctctgcctcccgggttcaactgattcttctgcctcagcctcacgagtagytgggactacaggcgtgcatttgccatcacacctggttcatttttgtatttttagcagagacagggtttcaccatgttggccaggctggtctcaaactcctgacctcaggtgatccacccgcctcagcctccaaagtgttgggattacaggcgtgagccaccacaaccagtcttggatccttctttattgtgggggggtgggccatcctgtgcattgtgggacattgagcagcatctctggcctccaccaaaatgtttccagttgttaaccaatgtccccaggataggggcaggggtaaaa

SEQ ID NO: 116464 - DNA, 601 bp, Human
gaggagggtctgggagctgcagggttgccttgtccacccttctgtcgggggagcgattgcggggttcccaaggacggacatgggcttcgtgtgcagccgcgttcctgcttctttcccatcctggtttctttctggccgtggccttgtttctcccacgttgggggtgtgtgtctcctttgctctagaagcccgatttgagctccgcagcaggaattatgttttgagttagtgtgtccagttggttgctactttctcgccactaccaccagatgctaaattggtgggacgcaggtgggacctmcaccagggtcctctctggccaccccaggcccctgggcctgcacggctgccctgcactgctcagccaggatccacctgcctgctgcccgagctgcccgtgggaagggcacaaggacagacccgtgtggccttcccaggtgggtgcgtgctgtctgccgggatggggcaggtcggccaccagctgttgaccttgctttgaacttgtttactgctgtgtgagttcagggaatgacataattcctgtccaagctccctggactaaatttaggtcccaggaaaataattttccctgggtgagttc

SEQ ID NO: 116465 - DNA, 601 bp, Human
tcactctgtcacccaggctggagtgcagtggtgcgattttccgctcactgcaacctccgcctcctggggtcaagcgattctcctgcctcagccacccgagtagctgagattacaggcacctgccatcacacccagctactttttatatttttagtagagacggggtttcaccatgttggccaggctggtcttgaactcttgacctcaagtgatctgcctgccttggtctcccaaaatgctgggattacaggtgtgagccaccacgcctggcctggcctggcccctctcttttaaaaaaaawaaataaataaactagagatgagatttcactatatttcccaggctgttcacaaactcctgagctcaagctatcttcccaccttggccttccaaagtgttgggagtacaggtgtgagcaactacacctgggtgatttttctttttattgagatgaaattcacataaaattaaccaggttaagtgaataattcactgacagtacactcacaaggttgtgcaaccaccacttctatctggttccaaaacattttaatcaccccagaaagaaaccttgcacccagccgcaatcattctccacttc

SEQ ID NO: 116466 - DNA, 601 bp, Human
cggagtttcgctctgtcacccaagctttagtgcagtggcgcgatctcggctcactgcaacctccgcctcccgggttcacgccatcctcctgcctcagcctcccgagtaggtgggactacaggcgcccgccgccaccacgcccggctaattttttgtatttttagtagagacggggtttcaccgtgttagccaggatggtctcgatctcctgacctcgtgatccgccagcctcggcctcccaaagtgctgggattacaggcctgagccaccgtgcccggccaaatacccatattattaagaraaatgtttacaaaaggttaggacgaagccaccttggctgcgggagagaggaattgacagccatgattgttggtgcgcactgcggccgccagggggtgctgggtgcacgcagcacagagactgcagcctcctccagtcgcctcccagggccctcagcagctaagtgtgcaggagagggttgcagacgccagggtccgtgtgtgacctggctgctggaaacagcgccactgaaaaatcaacaggagactccccagccctccagccccccagctcattgtagccttcaaagaccactggcccc

SEQ ID NO: 116467 - DNA, 601 bp, Human
cccatattattaagagaaatgtttacaaaaggttaggacgaagccaccttggctgcgggagagaggaattgacagccatgattgttggtgcgcactgcggccgccagggggtgctgggtgcacgcagcacagagactgcagcctcctccagtcgcctcccagggccctcagcagctaagtgtgcaggagagggttgcagacgccagggtccgtgtgtgacctggctgctggaaacagcgccactgaaaaatcaacaggagactccccagccctccagccccccagctcattgtagccttcraagaccactggccccaaaactacccgattcaaggtattttcagtatttggccccaccggccccgcctctcacgtgtctgaaaacagctcctgtcgtcttgctcttccctcagatgcttctgatgagcagaattcacagtcctcgatggaacattcgatgaacagctcagagaaagtagatcggcagccgtctggagactcgggtctggccgcagagacgtctgcaatctctcaggtacctcgctcgaggtctcagaggggcagccagatcggccgggagcccattgggttgtcgggggta

SEQ ID NO: 116468 - DNA, 601 bp, Human
caactacagaccctttcccccagaataacacacacacatatgtgtatacccagcaaatgctgagagtccagcccagaccaggcactgtgcccagccctgcaggagcaggagtctacatggcagagtgggtctgggcctctgggagatggcctagaacttgcagagattgccaggcatcatggctcacacctgtaatccaagcagtttgggaggctgaggcaggaggatcccttgagcccgggagttcaagaccagcctgggcagcatagcaagaccccatctctacaaaaaacttaaaaaraaaaaatcatccgggcatggtggcacatgcatatagtcccagctactcaggaggctgaggcagggggatcctctgagaccaggaagtcgaggctgcagtgagctatgatgaccactacaccccagcctgagcagcaaagcaagactctgtctctaaaaaaaattataaaaagaacttggaaaagctggtgcggtggctcacgcctgtaatcctagcactctgggaaggtgaggcgggcagatcacctgaggtcaggagtttgagaccagcctggccaacatggtgaaacatggagacatg

SEQ ID NO: 116469 - DNA, 601 bp, Human; identical to SEQ ID NO: 22639

SEQ ID NO: 116470 - DNA, 601 bp, Human; identical to SEQ ID NO: 22640

SEQ ID NO: 116471 - DNA, 601 bp, Human
aggaaagcaagttctccacctgccttgctttccactgaattctaggaaattgcaccatttctggcaataagtaattgttacttaggtgaatgaataaatggaggagagtctaaaagtgaatttagaaaactgcaattggaagaggaagagaagacacagagagaggcagagatggagagactggggagaatctggtagcagagaccccaggtgagggaggtggcttagagacaaagtggtcagtggcctgacccggactcctctgctctcagccctcagtctgcagggctccataatgacrgtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtgg

SEQ ID NO: 116472 - DNA, 601 bp, Human
aaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaacyctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcagcccactgcctgcccagtgccatcaggatgagcagtcccggccaagcataatgacagagagaggcagacttcggggaagccctgactgtgcagagctaaggacacagtggaga

SEQ ID NO: 116473 - DNA, 601 bp, Human
aaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactmtcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcagcccactgcctgcccagtgccatcaggatgagcagtcccggccaagcataatgacagagagaggcagacttcggggaagccctgactgtgcagagctaaggacacagtggagat

SEQ ID NO: 116474 - DNA, 601 bp, Human
gtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagcmttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcagcccactgcctgcccagtgccatcaggatgagcagtcccggccaagcataatgacagagagaggcagacttcggggaagccctgactgtgcagagctaaggacacagtggagattctctggcactctgaggtctctgtggcaggcctgg

SEQ ID NO: 116475 - DNA, 601 bp, Human
agaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcwgcccactgcctgcccagtgccatcaggatgagcagtcccggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctag

SEQ ID NO: 116476 - DNA, 601 bp, Human
ttcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcagccmactgcctgcccagtgccatcaggatgagcagtcccggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtg

SEQ ID NO: 116477 - DNA, 601 bp, Human
cttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcagcccactgcctgcccagtgccatcaggatgagcartcccggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagt

SEQ ID NO: 116478 - DNA, 601 bp, Human
gccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcagcccactgcctgcccagtgccatcaggatgagcagtccyggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaact

SEQ ID NO: 116479 - DNA, 601 bp, Human
gagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaycaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcac

SEQ ID NO: 116480 - DNA, 601 bp, Human
cattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatcttyacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagctttggttccaagaaatatcacatttctgtatttttgtaaatcaaatgaactctgactctgagcccccacttgc

SEQ ID NO: 116481 - DNA, 601 bp, Human; identical to SEQ ID NO: 32278

SEQ ID NO: 116482 - DNA, 601 bp, Human; identical to SEQ ID NO: 21112

SEQ ID NO: 116483 - DNA, 601 bp, Human; identical to SEQ ID NO: 21113

SEQ ID NO: 116484 - DNA, 601 bp, Human; identical to SEQ ID NO: 21114

SEQ ID NO: 116485 - DNA, 601 bp, Human; identical to SEQ ID NO: 21115

SEQ ID NO: 116486 - DNA, 601 bp, Human; identical to SEQ ID NO: 21116

SEQ ID NO: 116487 - DNA, 601 bp, Human; identical to SEQ ID NO: 82465

SEQ ID NO: 116488 - DNA, 601 bp, Human; identical to SEQ ID NO: 82466

SEQ ID NO: 116489 - DNA, 601 bp, Human; identical to SEQ ID NO: 82467

SEQ ID NO: 116490 - DNA, 601 bp, Human; identical to SEQ ID NO: 82468

SEQ ID NO: 116491 - DNA, 601 bp, Human; identical to SEQ ID NO: 82469

SEQ ID NO: 116492 - DNA, 601 bp, Human; identical to SEQ ID NO: 82470

SEQ ID NO: 116493 - DNA, 601 bp, Human; identical to SEQ ID NO: 82471

SEQ ID NO: 116494 - DNA, 601 bp, Human; identical to SEQ ID NO: 82472

SEQ ID NO: 116495 - DNA, 601 bp, Human; identical to SEQ ID NO: 82473

SEQ ID NO: 116496 - DNA, 601 bp, Human; identical to SEQ ID NO: 82474

SEQ ID NO: 116497 - DNA, 601 bp, Human; identical to SEQ ID NO: 82475

SEQ ID NO: 116498 - DNA, 601 bp, Human; identical to SEQ ID NO: 82476

SEQ ID NO: 116499 - DNA, 601 bp, Human; identical to SEQ ID NO: 82477

SEQ ID NO: 116500 - DNA, 601 bp, Human; identical to SEQ ID NO: 82478

SEQ ID NO: 116501 - DNA, 601 bp, Human; identical to SEQ ID NO: 82479

SEQ ID NO: 116502 - DNA, 601 bp, Human; identical to SEQ ID NO: 82480

SEQ ID NO: 116503 - DNA, 601 bp, Human; identical to SEQ ID NO: 82481

SEQ ID NO: 116504 - DNA, 601 bp, Human; identical to SEQ ID NO: 82482

SEQ ID NO: 116505 - DNA, 601 bp, Human; identical to SEQ ID NO: 82483

SEQ ID NO: 116506 - DNA, 601 bp, Human; identical to SEQ ID NO: 82484

SEQ ID NO: 116507 - DNA, 601 bp, Human; identical to SEQ ID NO: 82467

SEQ ID NO: 116508 - DNA, 601 bp, Human; identical to SEQ ID NO: 82468

SEQ ID NO: 116509 - DNA, 601 bp, Human; identical to SEQ ID NO: 82469

SEQ ID NO: 116510 - DNA, 601 bp, Human; identical to SEQ ID NO: 82470

SEQ ID NO: 116511 - DNA, 601 bp, Human; identical to SEQ ID NO: 82471

SEQ ID NO: 116512 - DNA, 601 bp, Human; identical to SEQ ID NO: 82472

SEQ ID NO: 116513 - DNA, 601 bp, Human; identical to SEQ ID NO: 82473

SEQ ID NO: 116514 - DNA, 601 bp, Human; identical to SEQ ID NO: 82474

SEQ ID NO: 116515 - DNA, 601 bp, Human; identical to SEQ ID NO: 82475

SEQ ID NO: 116516 - DNA, 601 bp, Human; identical to SEQ ID NO: 82476

SEQ ID NO: 116517 - DNA, 601 bp, Human; identical to SEQ ID NO: 82477

SEQ ID NO: 116518 - DNA, 601 bp, Human; identical to SEQ ID NO: 82478

SEQ ID NO: 116519 - DNA, 601 bp, Human; identical to SEQ ID NO: 82479

SEQ ID NO: 116520 - DNA, 601 bp, Human; identical to SEQ ID NO: 82480

SEQ ID NO: 116521 - DNA, 601 bp, Human; identical to SEQ ID NO: 82481

SEQ ID NO: 116522 - DNA, 601 bp, Human; identical to SEQ ID NO: 82482

SEQ ID NO: 116523 - DNA, 601 bp, Human; identical to SEQ ID NO: 82483

SEQ ID NO: 116524 - DNA, 601 bp, Human; identical to SEQ ID NO: 82484

SEQ ID NO: 116525 - DNA, 601 bp, Human; identical to SEQ ID NO: 27199

SEQ ID NO: 116526 - DNA, 601 bp, Human; identical to SEQ ID NO: 27200

SEQ ID NO: 116527 - DNA, 601 bp, Human
attggaatggacgattccgtcaagagataacaacaaatgttatgcaaaaataatctgtaatactaaagacaatgtaagtttaattctcaatcctttccagtaattttatttagttgttgttttttgttgttgttttttttttagatggagtcttgctctgttgcccaggctggagtgcagtggcgctatctctgctcactgcaacctccgcctcccgggttcaagtgattctcctgcctcagcctcccaactaactgggattacagacttgcgccaccacactggctaatttttgtagacrggggtttcaccatgttggccaggctggtcttgaacacctgacctcgtaatctgcctgtctcggcctcccaaggtgctggaatgtacaggcgtgagccaccatacccggctttagtttttaatatatagcttagttggtcacatggtgcagatggcattccttcagtatttcgcgtgccagttgtctcagctaatagatatcagcagctggcaaggaccttggctgcactgcctgctgccccctcatcttcactggcacagggccctacacttagtcaacaggcagccaaaacttactgag

SEQ ID NO: 116528 - DNA, 601 bp, Human
gtgtttatagaagaggaacaataaagtcatcgactatctaaatataatgaataacaaaaaagaacaggagcaatgcacgtttgatcctcagcagctggcactactaagaaagagctcttaattgagttctaagatttcattgcctgatgctacatgtaatgctagtctggtgttattacgtgtaaatctaatgtattttaagtgctttttagtagtcctcccacagatatactttattcataccataaacccccaactgtccaggtgaataagagtacaatatgcaatatattacagtcctttttttttttttttttgagacggagtcttgctctgttgcccaggctggagtgcagtggcgtgatcttggttcactgcaaccttcgcctcccaggttcaagtgattttcctgcctcagcctcccaagtagctgggattacaggcacccaccaccatgcccagctattctgtatttttagtagagacggggtttcaccatgttggccaggctggtctcgaactcctgacctcaggtgatccgtctgccttggtctcccaaagtgctgggattacaggtgtgagccactgcgcccggcctatt

SEQ ID NO: 116529 - DNA, 601 bp, Human
tttcctaccaataaacctgtcagtagttgaggtcataagtagggtgacagtgttttcggttattttcatagataaagatagtaatagagaagatgaatatctgttactgctcttttgtcatgagtaatctgaggtaaaagcttgtagaacttcactatccctggggcgtgctttattcattttgaatcagtcacttgacttcagtgtctaaatgtccttgattctaaattgtacttacaatgtttattatctgctggcttttgttctctgctattttatttttttttacataaaatatttrtaataaagatgaagaaggtactcaccatccaaagtcaaggaatgttaacatttttgctgtatttgtttcagggcttttttcttataagagataaaccatcatatatgcagtttataacagcttatatttattgagcacttactgtgtaccaggcactatagagctctacaggtattaacttatttaatccttacacagtcctgtgaggtatatatgctattgtttccccctttttatagatgaggaaactgaagcacatggaagttaagtaactgtgctcaaatcatttacctagggaag

SEQ ID NO: 116530 - DNA, 601 bp, Human
ggcagatctgtacatttattctcacacaatgtagataccatgctattaactattatcttatgcctatgcagtcttctgtcttccttcacttcaaaaggtaaaactttgaagtcgaagggtctcatgcttacgttcttatgtttgccacctatttatgaatgcatacacattatacagtgttcgtggtttaattgcaggtggcatcctcattatgtagagctctgcaactttttaataatctcttgttttttgagaccctttccacattattacatggaaatctattttaagtgctttttartagttcctcctatggatacgctttattcataccataaacccggaatcgtcagggcgaatatgtgtaagagtaccatatgcaatatattacagtccttttgtcaacagaacaacctcctgattgtttccagggagtgatggaaccttagacaagctctgcaccccacagcctgagttgcctcatctgttatgacgagattgcactagatagtctagtcagagtctgcgctgaaaatctatcagctcaacagtagagtgcatcagatttctctgcttttggcagaggtagccagagtttgag

SEQ ID NO: 116531 - DNA, 601 bp, Human
ggaggggagaaaaatcagcttaattgcattattgtatttttttttgccttaggaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtgggtcatctacacttatacagtttaaaatgtttaaaatgtgccacatagaagcacaccacccagcttatacatggcagatgtaggaccctgagtttgatgatgattcctcaraagagggctttgtctctaaaaattagtttttgtctttcaatactgattgctcatggtatgaactggaggcttccgtcatgtcgttaagtggtaaaaattatgagagtgatttatagagctgtgccttaaatattttatttatcatatcttctaaattattttcatggcaatcagttaatgatggaagagcttcaatcttagttattccacagctatcttgaggctaattgatactgtctgcctcttcagcttatggtatcagtgaatgagatttgaaaatgatgctttcaaaagatcaaa

SEQ ID NO: 116532 - DNA, 601 bp, Human
agctataaagtcaaggggttcccatgataaattgctagcatggctcacagaactcaggaataaactttacttatatttacttgtttattataaaggttgcaactcaggaacagccaaatggaagagatacacagggcaaggtggttgtggggaggcgggggacaacagagcttccatgtcctctctaggtgtggcatcttcccagcaccttgatattcaccaacctggaagttctccaaaccccttatttaggggtgtttatagaggtcccattatgtaggcatgattgattaatcattgrccattggtaattacccaatctcctgctccctccccagatgtaggggaccagaactggggctaaaaattctacctctgatgacatggttggttcctctggcaaccagctgccatcttgaagctatctagggccccaccaagagtcacatcattagcataagctcaggtgtggttgaaaggggctcattatgaatagcaaaagatgctcatctcactagtgtcactcgggaaattccaagggttttagaagctcccttgccaggaaccagggacaggatggaagaccaaatacatatttctt

SEQ ID NO: 116533 - DNA, 601 bp, Human
gtgtggttgaaaggggctcattatgaatagcaaaagatgctcatctcactagtgtcactcgggaaattccaagggttttagaagctcccttgccaggaaccagggacaggatggaagaccaaatacatatttcttctcatttcacaatatcgtaggatgttggggcaggatgattctggagggagttcttacctaagactagaacaatgtgtgagtgttagctagtgagagaacactgtacaaaaggcctgggtgggaaagcggatggctcattcaaggaactgaagaagaccctcaataytggcatagcttaaagagcttagagagttaaaaatatatatttattttttatttttttgtatatatatgctggagaaacaggtgggtaagtgatggtcttgtaaactaaggaagggtattttgactgcctttggggcattgtgattcagccaaaaggtctaaagcagggagtaatatgatcaggtacattgttcagaaacattcctccagctgcaccgtggaagcgggactgagcgagcaagtgaagtggcagatccagttatgtggctggtgaggtgcatgagaggagatgatagtggcc

SEQ ID NO: 116534 - DNA, 601 bp, Human
catagcttaaagagcttagagagttaaaaatatatatttattttttatttttttgtatatatatgctggagaaacaggtgggtaagtgatggtcttgtaaactaaggaagggtattttgactgcctttggggcattgtgattcagccaaaaggtctaaagcagggagtaatatgatcaggtacattgttcagaaacattcctccagctgcaccgtggaagcgggactgagcgagcaagtgaagtggcagatccagttatgtggctggtgaggtgcatgagaggagatgatagtggccggargtgtggcagtggaaatggagtgacacggttatatttgagggcagagttgatagtacttggcagctggctgggaatgggaagagggagagctgaagaccactcaggtttgtgtcctgcagcaggaagtaatagcaagagcagactcgaggtgacagcgaggacgaaaccactgatgtgtgtgagggcctgctgtgtgctgggtactgtgtccctgcctgttgactaacttagtcgttgtgagcaccccatgcggtggatgcggtagtatatctatttgacagacgaggaaaccaaggacaa

SEQ ID NO: 116535 - DNA, 601 bp, Human
ccacctactcgggaggctgaggcaggagaatcgcttgaacctaggaggcagaggttgcagtgagccaagattgtgccgctgcactccagcctgggtgacagagtgagactgtctcaaaaataaaaataataataaaataacgatttcaaggattttagcatatctttgctaacaatgatgagcctctttcttcttataatgatttttttttttggatatgaattatccatattttctaatgcatttgtattttaaaactttttaagatactggccattagtatttggtctggatttttttsagaagtaaaggctttgtcaccctctgaggctaaaacagactaaagacttttctcagtattgttcctcccttacacaaaactgttttcccccttattcacaagtatttttgtttttacgtacaggcaatcttgagcagtagcaagtaaagattgtctaaaactgtcaagtccacaaccatcaaatgtttgcaaggatatgaaacaaggagaacttgttagtcactgcaaatgagagtataggttggttcaggtaccttgaaaatctagtcaagccaaagtttcacctgccctctgactcag

SEQ ID NO: 116536 - DNA, 601 bp, Human
atttgcaggtaaagcttcttaaaaaaacaagagaaatgcaggaagaaatgcctaggaatgataagaccaactcggtggagggaaaggaggaaaaggccaatggggtggcacacacagggctaactgggcactttatacccttctttatatccaaaatattttatggtgaatttcttttagagggttgacaagcacctgtgggtacctgatctgttttaatcatcctcatgctaacaaaattcttcagtagatataacctaaattttttttctctttcatcttggttttaaaatgtcttccyccttttattctctggagaaatagaagatatccttgatcatactacttctctgttttattcattttggtagtcgcctaagatggttttaatgcatatggcattatctgaactgttccctgttacctcatttgctcaggcatctgaagatgttgtgctttctcttcccctgcaggtattcacaacattgtctgtgaccaagcgctctggggcaagcatcctccaggctggctgctgaggttaagccccagtgtggatgctgttgccaagactgcaaaccactggctcgtttccgtgcccaaa

SEQ ID NO: 116537 - DNA, 601 bp, Human; identical to SEQ ID NO: 27201

SEQ ID NO: 116538 - DNA, 601 bp, Human
gattaagtaatttgtccaaggtaacaaagatagttagtaaatagattagggacaaattctctgattattggttggatccttaattggttagccacagatatacttagcaaaaaacagtatcagggagaagaaaataatttaggagatagagttctcattattacccagttcaatgaacatttattgaacacttactaggaattcatacacctagactacaaagacttgtgtttgacttggcagatcgaagttatgaactttggataactggtcatgtcactgagaagcttttatgactgaycaaatattactcttcaatgcaggcagaacattcacctttatctggctaatcaagattcttttacagtgaatcacttctcttactttacaacctaactcagaaccccttaccttgcactccaatcagaaccagcaagatgatgcccaagaggaaaagaacaccacttttcttcatagtgatagaatggagttccaagtcactcctgtattggattttgagcctgagaaattctttagagaacacattttggggatcatatttatttaggatattcatttctctcctaaactctgattggct

SEQ ID NO: 116539 - DNA, 601 bp, Human; identical to SEQ ID NO: 24975

SEQ ID NO: 116540 - DNA, 601 bp, Human; identical to SEQ ID NO: 24976

SEQ ID NO: 116541 - DNA, 601 bp, Human
ggcggaacaaaactgaaggcggttatggaagacaggacagcgcctgtgatgcttgggagcaagaagtatgctccccagaaaactgtggagggatttaaccaagccaaagaatctgcaccttcatttggagggtgagaaacgagttaaagaatgtgcaccctcacttgggttctagcggggcgagggtgttacctgatgcttgtgagaatgcagttccctcaatcagcgggccaagaaccaagaataaagtttcatttgccgactagaaatacccgtattattacatgaaacgctacagcasattagcagacaaatgccaaactggccataaaacaacataagcaacacctgctctcaggtttttcaaactgacgccgtcccagcgcccctggtaaagagaatgattaagcttccactctggggccgcagctcatctttcaccaagaaacctcggcgaacctgcgactgacgcgttgccagcctccgcaagaacaactctgcccagcaagtggagctggggatgagggaaaacttcatgataagggtaaagaactcgaacccaggctctgcggacgtccccaagctgtccgggtccctggac

SEQ ID NO: 116542 - DNA, 601 bp, Human
aagttcaacagaataggtgtgacttgacaaagtcctttctaccatttacaggtagaagagaggcggaacaaaactgaaggcggttatggaagacaggacagcgcctgtgatgcttgggagcaagaagtatgctccccagaaaactgtggagggatttaaccaagccaaagaatctgcaccttcatttggagggtgagaaacgagttaaagaatgtgcaccctcacttgggttctagcggggcgagggtgttacctgatgcttgtgagaatgcagttccctcaatcagcgggccaagaaccragaataaagtttcatttgccgactagaaatacccgtattattacatgaaacgctacagcagattagcagacaaatgccaaactggccataaaacaacataagcaacacctgctctcaggtttttcaaactgacgccgtcccagcgcccctggtaaagagaatgattaagcttccactctggggccgcagctcatctttcaccaagaaacctcggcgaacctgcgactgacgcgttgccagcctccgcaagaacaactctgcccagcaagtggagctggggatgagggaaaacttcatgat

SEQ ID NO: 116543 - DNA, 601 bp, Human
aacaccatgggctagagaaccttgggaaagttcaacagaataggtgtgacttgacaaagtcctttctaccatttacaggtagaagagaggcggaacaaaactgaaggcggttatggaagacaggacagcgcctgtgatgcttgggagcaagaagtatgctccccagaaaactgtggagggatttaaccaagccaaagaatctgcaccttcatttggagggtgagaaacgagttaaagaatgtgcaccctcacttgggttctagcggggcgagggtgttacctgatgcttgtgagaatgcarttccctcaatcagcgggccaagaaccaagaataaagtttcatttgccgactagaaatacccgtattattacatgaaacgctacagcagattagcagacaaatgccaaactggccataaaacaacataagcaacacctgctctcaggtttttcaaactgacgccgtcccagcgcccctggtaaagagaatgattaagcttccactctggggccgcagctcatctttcaccaagaaacctcggcgaacctgcgactgacgcgttgccagcctccgcaagaacaactctgcccagcaagtgga

SEQ ID NO: 116544 - DNA, 601 bp, Human
aatatagctagtacaagaaattgagaaaaaagctgaaaacaataactatttttgacaaaaaacccacttttaaaaataataaagctctatccaatgcatcacaaaatattcccagaaagcttcctgtacaccaagtattgtgtaggataaaaagcacagtccttttcccatccagagccattagagaagattaaaaacaagttacattaatacaaaaaaaaatagttaacatcagaagtgatgccacactgttatttggcaaagacatggcataactaagagctgcgagttgaaaaatgarcaacaccatgggctagagaaccttgggaaagttcaacagaataggtgtgacttgacaaagtcctttctaccatttacaggtagaagagaggcggaacaaaactgaaggcggttatggaagacaggacagcgcctgtgatgcttgggagcaagaagtatgctccccagaaaactgtggagggatttaaccaagccaaagaatctgcaccttcatttggagggtgagaaacgagttaaagaatgtgcaccctcacttgggttctagcggggcgagggtgttacctgatgcttgtgagaatgc

SEQ ID NO: 116545 - DNA, 601 bp, Human
actatatcatgtgaattatacctaaataaaactgttctttaaaaaacctattatacccaaggcaattaaaccttatccttacatttaaatttggtctaagaagctcttataataaatataatgctatgatgtaaaaaaaaaaaaattaaccaaatgtttaaaactattaagtctgcaatttataacttggaagccattaagtcagtagttcaagaaatcaaaagtcctgggctgagcgcggtggctcatgcctgtaatcccagtactttgggaggccaaggctggcagatcaggaggcggrcaaactgctgaggtcaggagttcgagaccagcctggccaacatggtgaaaccccatctctgctacaaatacaaaaataagccgggtgtggtggcagaagcctatagtcccagctactcagaaggctgaaacagaagaatcgcttgaacccaggaggcgaaaattgtagtgagtggagatcacgccactcactccagcctgggcgacagagcaagactctgtctaaaaaaaaaaaaaaaaaaaaaaaaaaaaaagaattcaaaagtacatagtcccctcgtctgaggatgcttttacctag

SEQ ID NO: 116546 - DNA, 601 bp, Human
aaactgcttttgtgtctatactatatattttttgtttgtttgttttgagatggagtctcactccatcactcaggttggagtgcagtggcactatctcagctcactgcaacctccgcctcctgggttcaagtgactctcctgcctcagcctcccgtgtagctgggattacaggcgtgcgctactacacccggctcatttttgtatttttagtagatatgggtggccaggctggtctcaaactcctgacctgaagtgatccacctgcctcggcctcccaaagtgctgggattacaggcgtgarccaccacacctggcctgtgtctatatgttttaacattaacagtcctgactcgtacttggcccatacttaacataacatgatatttattgatgaattaaaagtgacttcctaaagaaagaatccaacttttacttctttctctgtaagactttataagtcaaatcctaacactgcaagtaacaacaatcctgcacaactcaaaaattgtaaactgaagtcaataatccattccttttaagcaatactttatatgataaaaatacactatatcatgtgaattatacctaaataaaactgttc

SEQ ID NO: 116547 - DNA, 601 bp, Human
cttttccaaacatagcatctcattatatattactagggtattcgaaatgcacatgggctgaggcaggaggatcgcttaagtccaggagttggagaccagcctgagcaacacaggggtctctacaaaaatttttttaaaaaacaaacaaaaaaggaagcagagagaggagctcaaggttataacaagctttggttgtgccactgcactccagcctaggggacagagggagaccctgtctcttttttttttttctttttttaagacagtgtctcgctctgttgctcaggctgaagttgcagtsgtgcaatcttggctcactgcagcctctgcatcctgggttcaagtgattctcctgcctcagcctcctgagtagctgggactacaggtgcccgctgccacgcccagctaatttttgtatttttagtagagatgaggtttcaccatgttggtcactcagactggtctcgaactcctgacctcatgatccacccgcctcggcctcccaaagtgctgggattacaggcataagccaccgcgccctgctgaccctgtctctttaaaaacaaatgcaaatgttattagcaatgtttttcccctacga

SEQ ID NO: 116548 - DNA, 601 bp, Human
aatcctcaaggaggtgattatctaatgagtagatgaacaaatcaaacttacaagacagcaaaacaagtactatgtcactaatctgtgacaagggcatctaactttaagtgagtgattaggcagtaggaatagagatacattaggaaaagctcttcagaagagagtcttaagctaattcctgaaggataaggaattggagggtgaggtgaggcagggaaaaggctaaaaattggcaaagaatttgcttatctaagtaactgtaatcaggtaggtgtggttgagaagacagatgcacctgaaraccagtgagagaaaacgcttgaggaacttatgaaataagctgctaagtaaatcaaagtttcatcctcaacacgggagaaaaattacacgtggacgtgcatagctgcaagcacacacaaatgcacagatggcttctggaagcatgatacttgccattccattgcctcatcaaggccggtgcctttggttgctgacgttttgaatatctgccattttcggtccttcaaggcaggtaacccaagtgaatttgccatctctgaggaagtcatggcctgttccatgtcctgtttatttgcaaaca

SEQ ID NO: 116549 - DNA, 601 bp, Human
tattgttcttttctaaatttttaagttagacacttagcattaattttcagtctcttttttgctaattgggccttgatggttttatttatatatatatgtttatatatttcctttgggttatatatagtaggtttttctttagaggatgcaggaaggtctaagaaaaggagctgaaggttttctctccctttgaagtccggagacaaaagccaaacactaggccgactgactgaaacataagtgactggtgccagctctggagtgtgaaaggtatgctactttcagccccaatatgaattaytggatgctaccaccatcttcaatgagttccaccaaaaacattacagatcaaagtgcagtgttatgaaaagagacttaccccgcagacgacctgctctttgaattgcttgatttactgctttgaggtttcccaacagctctgtgtgattgttacagcgaattttatatccatttagcaagtctctattaaggtcatagagttccatataacgactcttcattgttttcctgtgcaaatcagtagaaatttgacatcatttcatgttgatatggcaagcttaagaaaaacttgcaaatttct

SEQ ID NO: 116550 - DNA, 601 bp, Human
tcaggaaccaaaagattgttagacatgaaattataaaattagacgtcagttttaaaacaacataaaaccaggagggaaaagagttatacttgaaatatgatttatcttaccattccctaaaaaaaataacttggtgagggaattattgaaaaaactgacttagagactgtctcaaacctagaaaccaacagtcagttttacagaaaaggatcaaagctcatagtcacctagcaaagattatttctaaagaagtcaaagcatcgacccaaaacagcagaattcaggtataaatctctggctrtatttctgcttccttgggtttatcctattgttcttttctaaatttttaagttagacacttagcattaattttcagtctcttttttgctaattgggccttgatggttttatttatatatatatgtttatatatttcctttgggttatatatagtaggtttttctttagaggatgcaggaaggtctaagaaaaggagctgaaggttttctctccctttgaagtccggagacaaaagccaaacactaggccgactgactgaaacataagtgactggtgccagctctggagtgtgaaaggtatg

SEQ ID NO: 116551 - DNA, 601 bp, Human
aacctttttccttaggcttagtcctttagtgaactcaggtagaaaagtttgtcctaggggatgacagagccacatgattaaaggaacctgggtccctgcataactatggagaaatccttacataataaatgaaaaatgagtcattatgattttgaggtctatttgttacagcagctaacattagcccaacaaagtaatcactctaaattgactcttccttaatgtaaatttgttgtttgcacccatctttcagtgattaaaaagcacacaaatccaaatatccacatttttttttttttttgagacagagttttgctcttgtcacccaggctggagtgcagtggtgcaatcttgctcactgcaacctccacctcctgggttcaagcaattctcctgcctcagcctcctgcatagctgggattgtaggtgtccaccaccaaacctggctaattttttgtatttttagtagagaccaggtttcatcatgttggccaggctggtctcaaactcctgacctcaggggatccacccgccttggcctcccaaagtgctaggattataggtgtgagccactgagctcagcccaaatattttttttttt

SEQ ID NO: 116552 - DNA, 601 bp, Human
tagggtcaactatataactaattgctttttattttaagagacggaatgctaaaaccacatcagaatgccaagaggctgtgcatcttgttaatttttttcttgaactgttccagggagttacatcataattacctgtgtgtgggtatgcatgggtggatgaaagatgctgttctcattccatcccaatagagtcttctgtttcctttctcttttttacatttatttttagcttttgcagtagtgtttagtgtgggttttactaattaatagaaaaagcactgggcctttaaacttcttaacyactcttctctttcatctcctaaaacttttgagtattcattcttttctgaagtttgcatttaaatgaaaatgactttcgctttggcttttaggtttagtttcaaaaaggtttaattctgcaccctagccagttaagaaatgttttagcaggtatgcccttgatatggatatttatatattttacacatgtagtaatattatttctataacttactgttataaaacactaatttttaaatgatgagataaaaagaaatatctagaactagttctaacattgtcttcccctatgcatatggta

SEQ ID NO: 116553 - DNA, 601 bp, Human
tacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccatacyttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggc

SEQ ID NO: 116554 - DNA, 601 bp, Human
acagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctamgtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccata

SEQ ID NO: 116555 - DNA, 601 bp, Human
ccctcctgagaaattccaaattaagagccatgtggtgcattcccacaaatcttacaatgtagtaagaaataaatgtaataggtaagtacctttctaggtatatgctggaatagggcttgttggaaaatggcttgacagccacccctagtaagtgttcattcagaggacccctctatccccagattaagtgcttgatatggaaaccatctgttccatggttaatcatccaagatttgagaataagttctgtgttctgatgtgtcactgtatttgtctttttcagctgctaacagtgaatccrgaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctc

SEQ ID NO: 116556 - DNA, 601 bp, Human
gtctgtctcaaagggattttttaaaaaacttatccacttctgtttgtttgtttgtttgtttgttttgagacacggtcttgcactgtcacccaggctggagtgcagtggtgcaatcacagctcactgcagccttgacctcctaggctcgagcgatccttctgcctcagtatcccaagtagctgggatcacaggcatatgccaccacacccaactaattttcttgatttttttttttttgtaaagatgggatcttgccatgttgcccaggctggtctcaaacccctaggctcaagtaatcctmctaccttgtcctcccaaagtgcagtgattacaagcgtgaccaatcacacctggccaaaacttgtccagttctattccttttttggtttcatttttacgggaacctgcaacttaggataaaatctatatgggcagccaaaagatgctttattccattgttgagcacctactgtatacagggggccttgggtgaaagcagagtagggaatacaaaagtgaaagagaaaagtcactgtttacgaagtttaccatcttgaagaaaagctataaagcttggcaaaagctatcaaattgctgggca

SEQ ID NO: 116557 - DNA, 601 bp, Human
catgttaattgatactggcatttatgcctagaccctaagaggaaccagagtcagtatccatggagtctgtctcaaagggattttttaaaaaacttatccacttctgtttgtttgtttgtttgtttgttttgagacacggtcttgcactgtcacccaggctggagtgcagtggtgcaatcacagctcactgcagccttgacctcctaggctcgagcgatccttctgcctcagtatcccaagtagctgggatcacaggcatatgccaccacacccaactaattttcttgatttttttttttttgtaaagatgggatcttgccatgttgcccaggctggtctcaaacccctaggctcaagtaatcctcctaccttgtcctcccaaagtgcagtgattacaagcgtgaccaatcacacctggccaaaacttgtccagttctattccttttttggtttcatttttacgggaacctgcaacttaggataaaatctatatgggcagccaaaagatgctttattccattgttgagcacctactgtatacagggggccttgggtgaaagcagagtagggaatacaaaagtgaaagagaaaagtcactgtt

SEQ ID NO: 116558 - DNA, 601 bp, Human
caaaatcagtggtttgagatgctaactgaaagcaacataactcattctgtggccttccaaaactgactgaacagtcactttggccactgcagatatttagtaaaaccagacccaggtggctttttctgtgctatcttaatacacagggtagcctttctttgaaagattagttttccatgttaattgatactggcatttatgcctagaccctaagaggaaccagagtcagtatccatggagtctgtctcaaagggattttttaaaaaacttatccacttctgtttgtttgtttgtttgttttttttgagacacggtcttgcactgtcacccaggctggagtgcagtggtgcaatcacagctcactgcagccttgacctcctaggctcgagcgatccttctgcctcagtatcccaagtagctgggatcacaggcatatgccaccacacccaactaattttcttgatttttttttttttgtaaagatgggatcttgccatgttgcccaggctggtctcaaacccctaggctcaagtaatcctcctaccttgtcctcccaaagtgcagtgattacaagcgtgaccaatcacacctggccaaaact

SEQ ID NO: 116559 - DNA, 601 bp, Human
gctggcaacatgaccccgtgtctattaaaaaaaaataagtaaataaaggccgaggcgggtggatcacttgaggtcaggaattcgaaatctgcctgaccaacatggtgaaaccccatctctacttaaaacacaaaaattagcccggagtggtggcacgctcctgtaatcccagctactcgggaggctgaggcaggagaatcgcttgaacctgggaggcagaggttgcagtgagccgagagcgccccactgcacttcagcctgggcaacagagcgagactgagtctcaaacaaaacaaaaagaaaaaaaaaaattagccgggcgtggtggcgggcgcctgcaatcccagctactcgggaggctgaggctgagaatcgcttgaagccgggaggcacaggttgcagtgagctgagatctcgccactgcactccagcctgggcgacagaggcagatcttgtctcaaaaaaattaaaataaaataaaatgttgcctttaaactttttagaaacggatgccacaataaccgctcctgcaggcagaatttagctctggacccctggcctgggtgccagttgtgtgtgacggtcccgctacaatcgccca

SEQ ID NO: 116560 - DNA, 601 bp, Human
aaaccctgtccctactacaaatacaaaaaaattagcagggtgtggtggcgggcgcctgtagtcccagctactcgggaggctgaggcaggagaatggtgtgaacccaggaggcagagcttcctgggcaacagagcgagactccgtctccaaaaaaaaaaaaaaaaaaaaatttttggaatctagagcagtggtccccaacgtttgtggcaccagggaccggctctgttgaagacaattttttcatggactgggtggggtgaggatggtttcaggatgaaactgttccacctcagatcatgargcattagattcttacaagaagcacacaacctagatccctcgcacgtgtagttcacaataggtttcgtgctcctatgagaatcccatgccactgctgatctgcccagaggcagagctcaggcagtaatgctcacctgcccaccactcacctcctgctgtgcagcttgcttcctaacaggccacagaccagtaccagcccaggggttggggacccctaatctagagaatacacccgacaaccaatccatcagcaactcctgctaactacgttgagctaaattctccccacctcttctgcttg

SEQ ID NO: 116561 - DNA, 601 bp, Human
ctgaaaatacttgtaatacatggaattaatcttccttttgtgatgaacacacacgttaagtggcaggaatattttgctgaaatggagcttgctggtttcctctctagctcttccccataaagcatataagctatgatttttttaaatgaagtgccacttttatatcaactacttaattgacagctccacctagatgtttcctagacatcttagaaatgacatttccaaaaaatttttttcctttcaaaacccactcctctccatcctactaaatggcatcgccattcattcagttgctaakgcctttaaaaaatcttggaatctggccaggtgcagtggctgacgcctgtaatcccagcactttgggaggccgaggcaggtggatcacgaggtcaggagatcgagaccatcctggctaacacggtgaaaccctgtccctactacaaatacaaaaaaattagcagggtgtggtggcgggcgcctgtagtcccagctactcgggaggctgaggcaggagaatggtgtgaacccaggaggcagagcttcctgggcaacagagcgagactccgtctccaaaaaaaaaaaaaaaaaaaaatttttg

SEQ ID NO: 116562 - DNA, 526 bp, Human
gagtatgtatgagctacactgggggcatgcagaagggagcaatcagttctatgttgagtgctaatagcttagaaaaggcttcacaagtttgatgaggattaagctgagtctaataaagtgggccaggcatggtggctaacgcctgtaatcccaatagtttgggaggccgaggcgggtggatcacaaggtcaagagatcgagaccagcctggccaacatggcgaaaccccaactctactaaaaatacaaaaaaaaaaaaattagctgggcatggtggtgggcacctgtagtcccagctactygagaggctgaggcaggagaatcgcttgaacccaggaggtggaggttgcagtgagagccaagatcgtgccacttcactccagcctgggcgacagagcaagactctctcgccaaaaaaaaaaaaagtggatgggggagggcaattctgagcagaatgaagcagtacagtgttgatggggggacctcggttattttatttttttttttgagacagagtctcactctat

SEQ ID NO: 116563 - DNA, 601 bp, Human
ataaattgtggcggggtacggtggctcacacctgtaataccagcactttgggaggctgaggcaggcagatcacgaggtcaggagattgagacgatcctggccaacatggtgaaaccccgtctctactaaaaaaatacaaaaattagctgggccgtagtggtgtgcgtctttaatcccagctactcgggaggctgaggcaggagaatcgactgaacccaggaggcagaggttacagtgagccgagactgccactgcactccagcctgggtgacagagcaagactaaaaaaaaaaaaaaaaaagtgccgggcacggtggctcacgcctgtaatcccagcactttgggaggctgaggcaggcagatcacgaggtcaggagattgagacgatcctggccaacatggtgaaaccccgtctctactaaaaatacaaaaattagctgggcgtggtggcacacgcctgtagtcccagctacttgggaggctgaggcagaagaatcacttgaacccaggaggcagaggttgcagtgagccgagattgcaccactgcgctccagcctggtgacagagcgagactacatctcaaaaaaaaaacaaaaaacca

SEQ ID NO: 116564 - DNA, 601 bp, Human
ttcaatcaaataccaacatgggtatcagacacaatttggttgtgagccattatttgctaaaccatggtttagaagatcaagagttaagaggagacataccttagtatattcagtaatagcttcaatcaacgcatatgtggtctgagagagaaaggtagaggtgctatctgttaccaaagacactgctctcctcatcaatgcttcactactaagggaatgaggctctgatttctgaaagacacaaacattgtcactcaacctctaaagctcaaactgagaactttttcaccaataggcaagyaaaaaacgtaattgtcatgctgcttagtgttttaggctgaaactgcactatatttctttgggttatattttttaaggccttattttggcaatttaagacaatatagagaaataattccggagtatgctttctaccaactttcattctctgctccaaaaagcaaattatttctttacatataaaataaattgtggcggggtacggtggctcacacctgtaataccagcactttgggaggctgaggcaggcagatcacgaggtcaggagattgagacgatcctggccaacatggtgaaaccc

SEQ ID NO: 116565 - DNA, 601 bp, Human
gctgctggaaaatatatgtaaaacaaatgcacaaatgagacttcaatacttttgattatccatatacgctaaaaaatttttattggccgggtgcagtggctcatgcctgtaatcctagcactttgggaggctaagacacgtggatcacctgaagtcaggagttcgagaccagcttggccaacatggcaaaaccccgtctctactaaaaatacaaaaaaattagccgggcatggtggcacacacctgtaatcccagctactcaggaggctgaggaaggaaaatcgcttgaacccaggaggcrgagattgcagcgagctgacatcactccactgcactccagcctgcgtaagcaagactccatctcaaaaaaaaaaatttattattttttacaaacaggatgctatgtcacccagacggaagtgcactggcatgttcatagctcactgtaatctcaaactcctagactcaagtgatcctcccacctcagcccctggagtaactgggactacaggcacacaacacaccatgcctggctaagtttaaaattttttttctgctagagatggggcttgctacattgactgggttggtcttgaactcc

SEQ ID NO: 116566 - DNA, 601 bp, Human
aaactggctcttccatcctgctgcctcaatgaaattgcactattatcctatgaagtaaaggtatcaggacattagtatctccatctgtaaacttctgtgtttttaaaagcttgtcagcaattcagacacagaaagagaaaacaatgcaagggaaaactttaaaggttgaggggaaaaaagctgctggaaaatatatgtaaaacaaatgcacaaatgagacttcaatacttttgattatccatatacgctaaaaaatttttattggccgggtgcagtggctcatgcctgtaatcctagcacwttgggaggctaagacacgtggatcacctgaagtcaggagttcgagaccagcttggccaacatggcaaaaccccgtctctactaaaaatacaaaaaaattagccgggcatggtggcacacacctgtaatcccagctactcaggaggctgaggaaggaaaatcgcttgaacccaggaggcggagattgcagcgagctgacatcactccactgcactccagcctgcgtaagcaagactccatctcaaaaaaaaaaatttattattttttacaaacaggatgctatgtcacccagacggaagtg

SEQ ID NO: 116567 - DNA, 601 bp, Human
gttttgggcatatgttaagtggtttttctcctttaatctatggatatatcatctcaaacagtgaattatatttgtttgagaaggagtctcactctatagttttttacagtgttgaactatcattctattttgagggtaaatggctacgtttgatttacggctacattttgaagtgatactgagcttttcgttttggtgctgccctagtccagtttgggatcggggctatgctggcttcatacagtagtaagaggaggcttgtcattactttctttgcgctggtacacttacagtaacatargtattatagttttggaagatttgataaaactctcccacgaaacatcctaggccctggtgtccattttggggacatcaaaatcttcgaataccatttctacctttttttttttttttttttgagatggagtctcacttatcacccaggctggagtgcagtggcgcgatctcggctcactgtaagctccacctcccgggttcacgccattctcctgcctcagcctcctgagtagctgggactacaggtgcccaccaccatgcctaatttatttattttttttttttattttagtagagacgg

SEQ ID NO: 116568 - DNA, 601 bp, Human
cacaagaggctgagcggggaggactgctcgaggccaagaagccaaggctgtagcgtgttatgaccgcacctgtgaacagccactgcactccagcctgggcaacaaagtgaaaccctgtctctctctcttttttctcgagacagagtttcactcgttgcccaggctggagtgcaatggcacaatctcagctcaccgcaacctctctcccgggttcaagctattttcctgcctcagcctctcaagtagctgggatcacaggtgtgtgccaccaggcctggctaattttgtattttaggtagasacggggttctccatgttggtcagggtggtctcgaactcccaacctcaggtgatccgcctgcctcagcctcccaaaatgctaggatcacaggcgtgagccactgtgcctggccaaccctgtctctttttaaagagagagaaaagaaatatggataacacttgagctattaggtcaaaatggttaagagtagacaaattaccactgctttgttttaaacagaaaaaaagaaaaaaacccttaagtcaaactgcaccacagaaattcttagcattaacttcttttaattaaggaaaggccaac

SEQ ID NO: 116569 - DNA, 601 bp, Human
aagaaatcaaggctgtgacttgcccaagatctcatggctttaaagcagaaaaacaagggtttgaactcagataggcttttaaggacaaagactcccaaactaagttttcccaaaggcctaggcttagaactgattctggccctcatctgggatcacagggaactatctgcagtgagccaaaagggcagacatgaaagtggacacgaccccccttttctgccagtctaagctctcatgtgcctctcagaacctgaagctcaacacatgaaatgtggcaaatagccaggcacggtggcaggcrcctgtattcccaaatccacaagaggctgagcggggaggactgctcgaggccaagaagccaaggctgtagcgtgttatgaccgcacctgtgaacagccactgcactccagcctgggcaacaaagtgaaaccctgtctctctctcttttttctcgagacagagtttcactcgttgcccaggctggagtgcaatggcacaatctcagctcaccgcaacctctctcccgggttcaagctattttcctgcctcagcctctcaagtagctgggatcacaggtgtgtgccaccaggcctggctaatt

SEQ ID NO: 116570 - DNA, 601 bp, Human
gggggtctcccgcgtcccctccgcctcgcccggagctagcgccttcgctcagccgagctcccaccccacccccttttttccgaaggcgctgggcggcgccaccctccggccggagccaggcactgcccaaccccctccgactttcaatgttccacactccccggccaggccagagcctcctcagcttctttttgtctctcccccctcccctcccccaacagctgcgtccatttccttaaggaagggtttttttttctctctccctccctcacaccgtagcggcgcgcgagcgggccgggckggtggccggccgagttttccaagagttagcttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaaaaattcagaaggagctagctgaaataacccttgatcctcctcctaattgcagtgctgggcctaaagga

SEQ ID NO: 116571 - DNA, 601 bp, Human; identical to SEQ ID NO: 34287

SEQ ID NO: 116572 - DNA, 601 bp, Human; identical to SEQ ID NO: 34286

SEQ ID NO: 116573 - DNA, 601 bp, Human; identical to SEQ ID NO: 34285

SEQ ID NO: 116574 - DNA, 601 bp, Human; identical to SEQ ID NO: 34284

SEQ ID NO: 116575 - DNA, 601 bp, Human; identical to SEQ ID NO: 34283

SEQ ID NO: 116576 - DNA, 601 bp, Human; identical to SEQ ID NO: 34282

SEQ ID NO: 116577 - DNA, 601 bp, Human; identical to SEQ ID NO: 34281

SEQ ID NO: 116578 - DNA, 601 bp, Human
gtgcctgggagatacaaatgaagtgattggaaatattgatttgaaccttgggaattttaacttaaattattattattattattatttgcttaaatgagaaatctaacagagtcaaaaagttttagtttactttcaagtttgcagataaagaggaaagtgtaataattatttctggatttggcaaggaaaactcacaagcacttataactttcagtaaacagaaatgtttatttaaatattattccagaaaaaaaaattcactaagataaccagtcagaattacacttttctgaggttaaagttactgtcatgtggcagagcaatctctaaaatccaggaacgactcctttgttagaaaaaacatttgcaaggtcagttttgtcacgtagattatcatctgcttttttgcagctgcagaggaaaagagttcctccttattttacagagatttatttcattgcctttagaaagacgtaatttgagcaccagaatttaactagttagcaaccagagtaaagaagacaagcctgaatagcttaaaacttacacggaggaaggaataagacagaataaaataattattaacaattgaatttatgga

SEQ ID NO: 116579 - DNA, 601 bp, Human
aactcccctttgattcccactattgagtatctacccaaaggaaagggactttttcctaacacaaacttaggatatgttgtgttctccaaagggaatgggaagtggtgatgaagattaaaaaaaaaagtccttactaattttgctttaaacaagtctatatagtctgatttaaaaataaaagtgcatttgccatgtatatttttcatatatatatatgtgtgtgtgtgtgtttatgatcatttttcaaaactgcaaattgcttcatggtttattgcctttgtcaatagttctcacaaggaamtcccaatacttctatacggcgactcaactctttctctctatcccatcattttcctgcctttttgttttttttttttttttttatgtttgtacctttcttttaagtcctctgtcatttctttgttagatcatctggccaattgcaagtcttctcactcaacctccctgtttctttcctctaatccctttaatttatcttgtgcatgtctgccataatgatcttaaagcataataattatgtcattcctcagcttaaaaacaaacattcacatcaaaaacaagcacttttattccccaagga

SEQ ID NO: 116580 - DNA, 601 bp, Human
gttaagatttttatgcttcaagggctccatgcttcttcctccatatcattcaaaatcaaacagatgtaaaaaaaataaattaaaaatgttatttttacccatttcccagccaccctgtttcccttccctgaggcaaccaaagttatataatgttatttgaatacaataatatgtttctgttgaggcaacttgtagtgacttctgactttgcacagatgcatttgagtcagcagatatggggagtcaggttggtgaagttcatgtctttcttctttttcagataaattatcccatatgtagyagagaagggaaaaaaattctgccttttatcattattgtttattgttatcattgtcattatcatttgtgaacaaatatatattactgatcactcactaggtgtattgaacagagagtataataggagttatgatttttcttgactagagatcattcttgaaaagaacgatccctgctctaaacatcacacttcagaaacaataagatgctgtgtcccaaggtataagttttggtgctccttctcattttggtgtccaggcaattgtggtcctccacccactttatcatttgctgccccgat

SEQ ID NO: 116581 - DNA, 601 bp, Human
ttgaatcttgctttattgtttacttatcaatgtatactggagatatttccatgtttgcgcatagagagtttcctcattaatttctttttacaactgcatagaatgttgttgtgtagttgtgtcatggctttgccgtccttgtgatggatccatggatgtttctaatcttttgctattctgaacaatgctctgaagtattctcttgtatgtgtgtcattttatacatatgtagttacatctgcaggatagcttcctagaggaggcctttctggctcaaagagtatgtatatttgaaaatttraaagatattgtcagactgctttccctaagggtttcatggttttgcagagtatgtaaatgtctgtctctccacaaactctccaactgtgttgtcaaactttcgaaaacttgtcaaatttttgaatttttcccaatgtaagaggtgaaaataaaatctcactatagtttcactgtacatttctcttattgtcagggaggttaagtatagttttatatgtccaggggatgtttgtatttatttgtgcactagttagcatgtctgatgcctggttgttgtttttttttccttaacttgttgaac

SEQ ID NO: 116582 - DNA, 601 bp, Human
gtttctgttacttattccatattctctttgccctcagcaagcacttcatctgacgttggttccttgcccaatggggtcacctaaacttttattcttgaatggtctgggccatcagcagtcctgcctgatttgggttattatagttttttgttgattttaattatagggcattggagtgtaagggggtgcacccagtatgtctgggtgccctgcattccagacatactcatctttaccatcactgtgcagaagcaatctaatttttcccttcattatcaggattagtcacaccaaccatcaragtggactccttctttgccttaccttcacttgcatgagggtccagagttgacaggtctcaacctccaagcttaatttagggttttcaggtaaaatacaggatgcccagttaaatttgattttcgggtaaacaacaaataattttagtgtatgttccatgcaacatttggatcacacttaaactaaaaaaagtgttcattgtttacatgaaattcacatttaactaggcaccctgtatttgtatgtgctaaatccagcaactctaatttttggaactcttgctgtgtcccccagtagaagc

SEQ ID NO: 116583 - DNA, 601 bp, Human
tgcagaagcaatctaatttttcccttcattatcaggattagtcacaccaaccatcagagtggactccttctttgccttaccttcacttgcatgagggtccagagttgacaggtctcaacctccaagcttaatttagggttttcaggtaaaatacaggatgcccagttaaatttgattttcgggtaaacaacaaataattttagtgtatgttccatgcaacatttggatcacacttaaactaaaaaaagtgttcattgtttacatgaaattcacatttaactaggcaccctgtatttgtatktgctaaatccagcaactctaatttttggaactcttgctgtgtcccccagtagaagcattcttccactgaagacttccaaactgactgggccaggtgcagtggctcacgcctgtaattccaacactttgagaggttgaggtgggaagatcacctgagcccaggagttcaagaccagcctgagcaacatagcgaaacccatctctaaagaataaaaaaatttaaaaaacagaaaataaaagaaataaaaagacttctagattaaccaagaatgttacttatttttatgttttaaaatttaca

SEQ ID NO: 116584 - DNA, 601 bp, Human
tctaatttttcccttcattatcaggattagtcacaccaaccatcagagtggactccttctttgccttaccttcacttgcatgagggtccagagttgacaggtctcaacctccaagcttaatttagggttttcaggtaaaatacaggatgcccagttaaatttgattttcgggtaaacaacaaataattttagtgtatgttccatgcaacatttggatcacacttaaactaaaaaaagtgttcattgtttacatgaaattcacatttaactaggcaccctgtatttgtatgtgctaaatccrgcaactctaatttttggaactcttgctgtgtcccccagtagaagcattcttccactgaagacttccaaactgactgggccaggtgcagtggctcacgcctgtaattccaacactttgagaggttgaggtgggaagatcacctgagcccaggagttcaagaccagcctgagcaacatagcgaaacccatctctaaagaataaaaaaatttaaaaaacagaaaataaaagaaataaaaagacttctagattaaccaagaatgttacttatttttatgttttaaaatttacagttgttttatg

SEQ ID NO: 116585 - DNA, 601 bp, Human
gtcacaccaaccatcagagtggactccttctttgccttaccttcacttgcatgagggtccagagttgacaggtctcaacctccaagcttaatttagggttttcaggtaaaatacaggatgcccagttaaatttgattttcgggtaaacaacaaataattttagtgtatgttccatgcaacatttggatcacacttaaactaaaaaaagtgttcattgtttacatgaaattcacatttaactaggcaccctgtatttgtatgtgctaaatccagcaactctaatttttggaactcttgctgygtcccccagtagaagcattcttccactgaagacttccaaactgactgggccaggtgcagtggctcacgcctgtaattccaacactttgagaggttgaggtgggaagatcacctgagcccaggagttcaagaccagcctgagcaacatagcgaaacccatctctaaagaataaaaaaatttaaaaaacagaaaataaaagaaataaaaagacttctagattaaccaagaatgttacttatttttatgttttaaaatttacagttgttttatggcgcatcatgatatacaatcaactttcat

SEQ ID NO: 116586 - DNA, 601 bp, Human
tcaaaatctttaacatataaagtacccattgtgtgtcatttaataatcttggttctgatgtccaacttatgggatattaaaattattatctttggttttcttttgatttgaatttgcttggtataattttatgctgtcttttatttttaatctgtctgaaacacttttaggtttgtctcctgtatataacagagctgaattttctccaattaaaagctgtttttctttcattaggagtttacatttattgatgtgagtgatacttatagacttggttttgtcatattatttcatattttgktatatatgtatgtgtatatttattttctattaaaaatatatggtggtatttaggaaggttcaaaatttgtttctagtggtgacctatatacatttaaatttatataatatcattattcctctttatctttagacagtttaaattggttccttgttataaacaacaagaaacttatcttgtattcttccccttccttcaccccttctatcttccctaccagtaaatttgtatcatttgtattatcttagtgtttactttgtatttaacattaatgtgaaatattcatatgtgtctatggtt

SEQ ID NO: 116587 - DNA, 601 bp, Human
tattcttccccttccttcaccccttctatcttccctaccagtaaatttgtatcatttgtattatcttagtgtttactttgtatttaacattaatgtgaaatattcatatgtgtctatggttgctttcactctcaactttgcaaatgatcaggcaataagggaatttattttaccctctcttccctgtctctattttttcttagttatactatttcagtgctgtctgagcatataacatttatatttccttcagtcacacttaaaatcacatttgttttttcttagatctgcatgtacaatrtttgctaccatttttgtttattttggctaaagttgccattgtcatctcttggttggctgtagtttgtcctatggtggtttccaaaaaaaagtcccaagtgaaaattattctttgagttcttgcaggttcagataatatatctgaggcattgatacctagaagataatggggcttgatatagtccttggctcatcctttcttttcttggatgtcttataggtactgctgcactatcttttgctagtgaatactactgatctgaaatttcttctcatatggcttgatctttgtttgactatc

SEQ ID NO: 116588 - DNA, 601 bp, Human
tcatctcttggttggctgtagtttgtcctatggtggtttccaaaaaaaagtcccaagtgaaaattattctttgagttcttgcaggttcagataatatatctgaggcattgatacctagaagataatggggcttgatatagtccttggctcatcctttcttttcttggatgtcttataggtactgctgcactatcttttgctagtgaatactactgatctgaaatttcttctcatatggcttgatctttgtttgactatctaaattattattctttatctttgaaacctaatacttttactyttagttgttttggtagaaatcacttggtttaattttttgctactatgtgatgtgcaattttaatatgtagattgatgtattgttttattttagtaacatttacttgaaatatatatattttttgagtcaaggtctcactccctttgcccaggctggagtgcagtggcacgatcatagctcactgcagcctcaacttcctgggctcaagcaatcctcccacctcagcctctcaagtagctgggactacaggacagcaccaccatgcccagctgatttttgtatttttaatagagatggggt

SEQ ID NO: 116589 - DNA, 601 bp, Human
tcttgcaggttcagataatatatctgaggcattgatacctagaagataatggggcttgatatagtccttggctcatcctttcttttcttggatgtcttataggtactgctgcactatcttttgctagtgaatactactgatctgaaatttcttctcatatggcttgatctttgtttgactatctaaattattattctttatctttgaaacctaatacttttacttttagttgttttggtagaaatcacttggtttaattttttgctactatgtgatgtgcaattttaatatgtagattgaygtattgttttattttagtaacatttacttgaaatatatatattttttgagtcaaggtctcactccctttgcccaggctggagtgcagtggcacgatcatagctcactgcagcctcaacttcctgggctcaagcaatcctcccacctcagcctctcaagtagctgggactacaggacagcaccaccatgcccagctgatttttgtatttttaatagagatggggttttgtcatattggccaggctggtcttgaactcctggtctcaaagaattcacctgcctcagcctcccaaagtactgg

SEQ ID NO: 116590 - DNA, 601 bp, Human
gtcttataggtactgctgcactatcttttgctagtgaatactactgatctgaaatttcttctcatatggcttgatctttgtttgactatctaaattattattctttatctttgaaacctaatacttttacttttagttgttttggtagaaatcacttggtttaattttttgctactatgtgatgtgcaattttaatatgtagattgatgtattgttttattttagtaacatttacttgaaatatatatattttttgagtcaaggtctcactccctttgcccaggctggagtgcagtggcaygatcatagctcactgcagcctcaacttcctgggctcaagcaatcctcccacctcagcctctcaagtagctgggactacaggacagcaccaccatgcccagctgatttttgtatttttaatagagatggggttttgtcatattggccaggctggtcttgaactcctggtctcaaagaattcacctgcctcagcctcccaaagtactggtattacaggtataagccaccacacctggcctgaaacaaatttttaaaaagctattttgttctacttggattccttctttaggttatccaatta

SEQ ID NO: 116591 - DNA, 601 bp, Human
aatatgtagattgatgtattgttttattttagtaacatttacttgaaatatatatattttttgagtcaaggtctcactccctttgcccaggctggagtgcagtggcacgatcatagctcactgcagcctcaacttcctgggctcaagcaatcctcccacctcagcctctcaagtagctgggactacaggacagcaccaccatgcccagctgatttttgtatttttaatagagatggggttttgtcatattggccaggctggtcttgaactcctggtctcaaagaattcacctgcctcagcstcccaaagtactggtattacaggtataagccaccacacctggcctgaaacaaatttttaaaaagctattttgttctacttggattccttctttaggttatccaattaagcctatgttgattctcttttgcttgttacctatatctattagttttctcttatcttttccgtttgtttcatttttgttgattttctcatttttatcctctgttttccttattgtgtatggcttccataagggaaagtgaaaagaatcagaactaagatgctgttgaaacactaaggtgttcccattgaaaca

SEQ ID NO: 116592 - DNA, 601 bp, Human
atttttaatagagatggggttttgtcatattggccaggctggtcttgaactcctggtctcaaagaattcacctgcctcagcctcccaaagtactggtattacaggtataagccaccacacctggcctgaaacaaatttttaaaaagctattttgttctacttggattccttctttaggttatccaattaagcctatgttgattctcttttgcttgttacctatatctattagttttctcttatcttttccgtttgtttcatttttgttgattttctcatttttatcctctgttttccttaytgtgtatggcttccataagggaaagtgaaaagaatcagaactaagatgctgttgaaacactaaggtgttcccattgaaacaaccagaaacaatattttgcacttagtctctgggctaggttggaaaaactacattttaaagaaattttaaagtaaagaaatacttaattgtagttgtagttgagatatattttcttgaagttattattcaataaattccacaggctcttagattgctgaaggtgacatttgctttagtgttctatcacattgtaagtttattccttgatgatgctacaat

SEQ ID NO: 116593 - DNA, 601 bp, Human
gtctcaaagaattcacctgcctcagcctcccaaagtactggtattacaggtataagccaccacacctggcctgaaacaaatttttaaaaagctattttgttctacttggattccttctttaggttatccaattaagcctatgttgattctcttttgcttgttacctatatctattagttttctcttatcttttccgtttgtttcatttttgttgattttctcatttttatcctctgttttccttattgtgtatggcttccataagggaaagtgaaaagaatcagaactaagatgctgttgraacactaaggtgttcccattgaaacaaccagaaacaatattttgcacttagtctctgggctaggttggaaaaactacattttaaagaaattttaaagtaaagaaatacttaattgtagttgtagttgagatatattttcttgaagttattattcaataaattccacaggctcttagattgctgaaggtgacatttgctttagtgttctatcacattgtaagtttattccttgatgatgctacaatttgatatcattgatgattatcaatatccttgatgatgctacaatttgtaatcatt

SEQ ID NO: 116594 - DNA, 601 bp, Human
taacaattctatttgctcagacctctttaatttaatttagggtaggaggaattccattaaaatctttgatctatcttattcagatttttcttaattggctcaaccactagtcgttgtgaagtccaagatagaggagttggctggagtcatcctctcccacaatgtgaaagtaagtaaagactcttctgacttgactatcaatttaaactctgttaggtaataaagtccctgtgcatctttacaggtatgtgtaccttccattagaatttgcatgaattttagatttatcatgatgccttcsctgagtatttctttctcttcactcacttacctcagttgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggcgtttggagaccaagccctcctacctgtgaaagtaagtcataatgatgaattctgcatcaaaatgtttgctctcttttgtttaaaagagaaagaaaggtaaattt

SEQ ID NO: 116595 - DNA, 601 bp, Human
atcaatttaaactctgttaggtaataaagtccctgtgcatctttacaggtatgtgtaccttccattagaatttgcatgaattttagatttatcatgatgccttcgctgagtatttctttctcttcactcacttacctcagttgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggygtttggagaccaagccctcctacctgtgaaagtaagtcataatgatgaattctgcatcaaaatgtttgctctcttttgtttaaaagagaaagaaaggtaaatttattggggggcaaatggaaaattcaaagataaactaactatcgctctgatgcaatcatttatttggccacctgatacttattgcatgtttgtttagaatataaaagccataaaaatgggagtggtgaactgggagctaacagtatatgggaacaaacagcaacaacatctcactggtttggtgaagtaaaagtttat

SEQ ID NO: 116596 - DNA, 601 bp, Human
gtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccagtaagtatggactgtgacagaatttcaatgtttggcatctaaaggtaccccgtactgttaatacgggtatacttgcatgcataggcctactatgaattacagtaaaaatttacatctagatcaataatttcctttattttwttcttgttggaaagaagaatgattttagtgcactctgcaaggtcatatattgtcacacaaaactgccacataccacaagactgtgcacattccaaccttaaagggaggtgttaacattgtagatactatggatttgtatatttatttcaataattttatggaatttgatagaaaattgtcttattctaacaaaatcattatattattataattactttgaaagacaaataataaattgtcctgaggaaaaatgccttttataacttgtacaaaagtattgtgtgaactggttatgattcc

SEQ ID NO: 116597 - DNA, 601 bp, Human
tatgtcactaaacaaacaagaaaatgaggaaacaacaacagatcccaaaggtggtaagggagaatcaatatccaaagttgctgcaatgtattatctaacatgttctgttttcaaaaaaaaaattgtcagatgtgcaaagaaacaggaaagagtgacccatgtaaagggaaaaagccaacaatagaaactgtttttgagggagcccagagaatggacttagcaggaaagttcaaagaatcacaaagcagctattataaatatgtcccaagaactaaaggaaacaatatttaaagaattaagyaaatgtattatgacagttttatcaaatagaaaatattgataaagatagaaattattttaaaaagaaatggaaattctagagttgaaaaacacagtaagtaaaatgaaaaattcaaaagaggaactcaacagtagatttgagttggaaaaagaatcagtgaatttgaagataaattgagattatgcaatttgaagcacagagatgaaaagaatgaggaaaaataaatggcatcagagaaatgtgggacaccattaagtgtaccaacatatgtataatgagagtcccagaaagatgagagaa

SEQ ID NO: 116598 - DNA, 601 bp, Human
aaccaagaatccaacaacatattttgcacttacatatattacaaactgcacaataaatttttataattattgttttatataatttcatgtttcatgtcttttatagtagctgagagaagaaaggagggcaagtatatatttagagagtttattatgttaatcttcttattcttcatttctggcgctctttatttcttcctgtagattcaagttaccatctggtgtcatttctgtactataatacagctttgttccctcctacctttcttgtgatgttattgtcaaatatattgcatttctktatgttataggcttaataatgcaattatatacatattgttttatgcaattgctgtttaaatcagctaagagaaggaaggagtagtaatatatattatactgtggttcaaattactgacataatgacctctgctgatgctcattgttttactgtgtggattcaaattaccgtctggtgtcaattgctttcagtctgaacaatttcctttagcatttcttgtaaggatagccttctagtaacaatcagataccacttcacatccagcagaatggctgtaataaaaaagatagacaataacaa

SEQ ID NO: 116599 - DNA, 601 bp, Human
ttgggaagagcacaggaatcaggatcaataatccagcaaaaagacatgagaatggggaaatctaataagggttctctgacagcacatgatatgccaagtgaatctgttttcttttttcttccagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgctgtragttagatctttctgtatctttgcccatattgatatcctgttttactccttcacatcctacttcctataggctgtggtaaaactttataagaaaacaaaaattctcaatttctaggagacctcttttaaagcactccagtggaggagcttctcttggaagctctatgatcagatcttgatcagtattaattcagttgaattaacagaatcaattccctctatgggaaagaaataatttcttccagatattagaactaatttttttttgctataatttgtttaaccttatattgctttaaa

SEQ ID NO: 116600 - DNA, 601 bp, Human
actgggaccttagagatgatattatttaacctgcttatctgataatattaggaaggaagccaagaggagcaaaatggctttagtgctacatagctagtggaagagccagtatcaagactcacaactcctaacacgtcatcctgctttctttccacagttccacagactcgtcctcttcccttccagccatgttctcccctatttctttttcttttgagacagagtcttgctctgtttcccaggctggagtgcagtggcagaatcttggctcactgcaacctccacctcccaggttcaagcrgttctcatgcctcagcctcccaagtagctgggattacaggtgcgcacccacgctgggctaatttttgtatttttagtagaaactgggtttcaccatgttggccaggctggtctcaaattcctgacctcaggtgatccacccccttcagcctcccaaagtgctgggattacaggtgtgagccactgctcccaccttctcccctttttctgatactctctttgatatagtttggatgtgtgttcctgctcaaatctcatattgaattgtaatctccagtgttggaggtggtgcttggtggga

SEQ ID NO: 116601 - DNA, 601 bp, Human
agtgctacatagctagtggaagagccagtatcaagactcacaactcctaacacgtcatcctgctttctttccacagttccacagactcgtcctcttcccttccagccatgttctcccctatttctttttcttttgagacagagtcttgctctgtttcccaggctggagtgcagtggcagaatcttggctcactgcaacctccacctcccaggttcaagcggttctcatgcctcagcctcccaagtagctgggattacaggtgcgcacccacgctgggctaatttttgtatttttagtagaractgggtttcaccatgttggccaggctggtctcaaattcctgacctcaggtgatccacccccttcagcctcccaaagtgctgggattacaggtgtgagccactgctcccaccttctcccctttttctgatactctctttgatatagtttggatgtgtgttcctgctcaaatctcatattgaattgtaatctccagtgttggaggtggtgcttggtgggaggtgactggatcatgcgggtggatttctcatgaatggtctagcaccatctccctaggtactgtcctcatgacagcgagtga

SEQ ID NO: 116602 - DNA, 601 bp, Human
aggctggagtgcagtggcagaatcttggctcactgcaacctccacctcccaggttcaagcggttctcatgcctcagcctcccaagtagctgggattacaggtgcgcacccacgctgggctaatttttgtatttttagtagaaactgggtttcaccatgttggccaggctggtctcaaattcctgacctcaggtgatccacccccttcagcctcccaaagtgctgggattacaggtgtgagccactgctcccaccttctcccctttttctgatactctctttgatatagtttggatgtgtgytcctgctcaaatctcatattgaattgtaatctccagtgttggaggtggtgcttggtgggaggtgactggatcatgcgggtggatttctcatgaatggtctagcaccatctccctaggtactgtcctcatgacagcgagtgagttctcatgagatctggttgtttaaaagtgtgtaacgcctcctccctctctcgttcctgcacctgttatgtgagatgcctccctccccctttgccttctgccatgattgtaagttttccgaggcctccccagaagccgagcagatgccagcaccatgtt

SEQ ID NO: 116603 - DNA, 601 bp, Human
cagggatgggtatcatggaagatgacttttccacggatgggggtggggagagtggggatggtttggggatgattcagatgcattacatttattgtgtactttatttctattattattacattgtaatatataataaaatgattatataactcaccataatgtagaatcagtgggagccctgagcttgttttcctgcaactagagggtcccatctagttaggagtgatgggaaactgacagattatcaggcattagattctcatctgggagtgttgggaaacagtgacagatcatcaggcaytagattctcatctgggagtgatgagagacagtgacagatcatcacacattagaatctcatctgggaatgatgagagacagtgacagatcatcaggcattagaatctcatctgggagtgatgggagacagtgacagatcatcaggcattagattctcatctgggagtgatgggagacagtgacagatcatcaggcattagattctcatctgggagtgatgggagacagtgacagatcatcaggcattagattctcatctgggagtgatgggagacagtgacagatcatcaggcactagatt

SEQ ID NO: 116604 - DNA, 601 bp, Human
ttgaactgtagtcgtgagttctttctggttagggaggggataaaagggggagaggcgtgagccagggccggctgtggctccccagcagtcacccagcggttgcctctctccacagagccacagtggccctgcagcttagatgggaaggagattccctccccccagcaatttctggagtccaggtggggcacggagtccctgcagctgcagggagccttgggcccttaggacaacacagggcaggactagtggctgctcacatgtcctaaatctatgatccctcacatccgctcttctaggsctggaccattgtaacattcttctgggggagtaaagccaggccctgtaggaagtcacatggccacctccctcattcccagctgcctctgcctctcctgggaagtggcaacctgtcattctgggtatgcaagacctgttcccagatacccgggagggcagctgtcctgacggattcccatggtgatggtgcccagactcctagtccaaacctggggctctcccttgttctcaaaatcagcgctgccactaaggggcactctgtggcttctccaaggggtttttgtttcattcattcattcaa

SEQ ID NO: 116605 - DNA, 601 bp, Human
tttgaaacactgaagttattaactaggcccccctcccactcctctcctagatctgtctggagcctatgctgccctcaccaagctcccctcccctcctcacacactcaccagagaatctgtccagggggcactgtaggcccagctgcccagaagatctggctgggcctgaacgagccctccctgacagcctctctcccacctgccttgtttgctatggggagtgggtggttctgagctccttggagttcctgctggggccaccctgcctggctggtgagcaggctctggcccctggggaggmtgagaggccccagcctgagcctctcctccaccctgacctcccccattgggccatacctagagtagtgtccttgctggtatcccctcatcccatggagtgggggctaggggctgaagggacacaggcagcacccagggatggcatctttgtacaatggggtcctgtagggcagaagggcagccagatcctgaggtcagtactgggttctgggcagacccctcttctcccctcaagactacaggagcaaagggctctggaacctgtgctctgcctggccctgccaggctcctcgctattggg

SEQ ID NO: 116606 - DNA, 601 bp, Human
ttggctatccagccatgctgccctgagagaacagcccagcttgaccacaacacctgggacgcaaagaggattgggttcatagagctggtctgggccccactttccgacgaggtggttgtattagatgaggcagctggggcccagtgatgctaggacactttcccaaggtcacacagcaaattaggaggcagaagggagactggaggccagaccctttggtcccttggtgctaagccatggctttcctgcccactgagtttctgggcaggcctggctgggtattcctgaggacaatgaccakctggagaagtgagcagggctcccaaagccctttaagcgttttcttctgcatcactcctctgggaaccgaatagtagcagctgcagcttctagggctcctaactggcctcctctttgagtcaaaggccagtactgtttagagtggtggctggcatgattggtggggtcactgagggcctggccagtcactgggtaggcagctttctcactgggaagcatgggttggaacatgaggggcctatggctgtgtccgccccagcaaagacaagaccttcccactcattatgttcattggctgcca

SEQ ID NO: 116607 - DNA, 601 bp, Human
tctgactgcttggaggcaggaaaaagttgccgtaagtacagtttgtccactcctctccagggtgtcccagggctggtcaggcgtgctgagtagacagtacaaacttgacaattctcaaagaaccctggcgcacctctcactgagtagttaatgctgtggcccagggacccttcaggcagctggagagctcacattgtttggctatccagccatgctgccctgagagaacagcccagcttgaccacaacacctgggacgcaaagaggattgggttcatagagctggtctgggccccactttscgacgaggtggttgtattagatgaggcagctggggcccagtgatgctaggacactttcccaaggtcacacagcaaattaggaggcagaagggagactggaggccagaccctttggtcccttggtgctaagccatggctttcctgcccactgagtttctgggcaggcctggctgggtattcctgaggacaatgaccagctggagaagtgagcagggctcccaaagccctttaagcgttttcttctgcatcactcctctgggaaccgaatagtagcagctgcagcttctagggctcctaact

SEQ ID NO: 116608 - DNA, 601 bp, Human
ccctctgagcccctgcctctctcctcatgtcatatgcctggacacttgagctatggaggagcctcccggtgcaaagccagagagccagaaacactaaccccataaagtcccttctagcccaaggagtcttccgggggccagagggtggtagtagcaggtggcaggaggacatatgtaagattctgagctgggagacaaggggcaggtactagaggccagccccacccagaccctggctggtcttgccaatgtggggtcagatcatggagggagtgacagcctcaagcagatggcaaagccrggcagacagacacagggcagggacagagataaatagagagttatcagctgctggcctggtgcaggatgaaaagcaatgaacatggaaatggggaatggaaagaagactaaagtcaaatggaaagggatgcctctctgcacaactctccaaaccaggcttctgtggttcctggacaccagcccttcaaggggccatgttcacacatggggcctatctcttgtccagccagcctgcgggtctgcactcagctcaggagggggccctcccctctgagctctcctagcaataaatctcccctat

SEQ ID NO: 116609 - DNA, 601 bp, Human
ctgagatcccaccccactggagcccccaccctctgagcccctgcctctctcctcatgtcatatgcctggacacttgagctatggaggagcctcccggtgcaaagccagagagccagaaacactaaccccataaagtcccttctagcccaaggagtcttccgggggccagagggtggtagtagcaggtggcaggaggacatatgtaagattctgagctgggagacaaggggcaggtactagaggccagccccacccagaccctggctggtcttgccaatgtggggtcagatcatggagggartgacagcctcaagcagatggcaaagccaggcagacagacacagggcagggacagagataaatagagagttatcagctgctggcctggtgcaggatgaaaagcaatgaacatggaaatggggaatggaaagaagactaaagtcaaatggaaagggatgcctctctgcacaactctccaaaccaggcttctgtggttcctggacaccagcccttcaaggggccatgttcacacatggggcctatctcttgtccagccagcctgcgggtctgcactcagctcaggagggggccctcccctctg

SEQ ID NO: 116610 - DNA, 601 bp, Human
tgtcacctcctcagataaatcttccctgaccacttcgctacactagcaccccactccagccaggcactatcccattacctcattttattttctgtgcagcactgaacaccacctgatgtctttcctgtttgcttgttgtcacctgtgaatgtgagcccaggagggcagggactgtgtgtctggtaaattctgttccatagatgtttgttgcattggtgagtgagtgaatatacagaccagccttatagacattgacatatctgcacactcacactcatctccacgccctcacagttccacytgcacagtgctcaaaccttaacacaaaggcattcacagcccctccacctgctgacatcttgccctgacagacctcacaaggtgtatactctcaacaacacacacgtacctgcagattcacgcctgtgcaccctgccaccatcacagaccccacacggactcaatgcctctcccacaaccccatcacagccagtagctatagacagatgcactcttacacacaaactttgcaatctatcttctactgagaacagctgatagaggataggtggtggggctaggaggcctccccaaatcagcc

SEQ ID NO: 116611 - DNA, 601 bp, Human
tgaggtcacttgcttccttcccagctgctctcctccttctggggcccactccccctgggctttggaatggttcttctctctgtcctacttcattggctgacctgtctctgtcttagccatgctttcttcttttctaccgactgggaagatagacgggcctgggctcaggtttctttctttcctgcacctgccctctctcccttagtgatttaactcagactcagactttgtataccgtctatttgcagactctcaaatttttatgtcctgccctgactgctccctgaagtatgatcgtgcyagatggccctccatcgagtctgcacctattggcagcctctgtcccatcagacatggatgagaggactggttcccctcactccatggtgttatcagacttgttgagtttaccagtccagggggtgaactgtgcttgtctcagtgtcgtttttatttccattttactcatgagtgaggttgagcatttttcctattgcagtcatctgtgatccctttctgcttgctattcatgtccttttctctgcaggcatttaatcagttgcatcctacttgggctgtgttgggcaccagactcatgcat

SEQ ID NO: 116612 - DNA, 601 bp, Human
cttgcagtaggccaccacacagacgatgcccacgaccagcagagccacgcagatgcccgtgatggtcaggaccctcttctggtacagctcctcggcttctgcagaggtagggtagatgtgaggggtggggcaggaggcaaaccccatagggatagtggtgcagagacccctttgcccccaaagccataggctctccccagctcaggtcctgcccagctcctttccatcccttttctccagccagttccttccctcctacatgctctgttttgccttccacttccctgcagctcccacccayccatggatctggtcacacacaactcctcctgagttcccctccccaagccccatgcctgcccagagcacatgagtggaaaatgcaggggaatgggaagggatggagtggaggcaaagctcccgaggctgtagagcaggggaggacagctcagtctggccggtgaccctgccctgctccacagtggcctggtagctgcaaagaaccttggtgggccaagaggagttgttcttcctggcagtgatcatgggaatgcctttgtttacccctgcagcctggtcagggagtggccctggccccctc

SEQ ID NO: 116613 - DNA, 601 bp, Human
ggccttggtggtgcctacctgtggctggaggtgggtgtggctgtggagcagtggtgagaaggagaacaggagtggctcccagagaaggtggtctcagtttctctcctgatgacatggtctgtggctggcacgttcttggaaatatactggaacagacagagttgggcgagagttagtgactggggcccaaatgaactctttcttgttggggacagggaagtgatgagcactgactgagctcctggttggggagacccactgtgtgagagtgacttgatgttggggcagcgatggctccagmaaatcaacccccaccccttcctcatggaagtgagcaaaccaaggccagccatcctggtgaggcagtgcctagcaggcaaggctggccatgggataggctggctgctgccctggcccatccttgcagggggcatgagaaggctggctgtccactgagggctcagaagggggccccaggaaagccactcacatctgccatctggatctcctctgggtccagccgggggtggctgggcccattggccaagctccggttctgatgggccgggcacatgttctgccggaggtggttgtgcatctg

SEQ ID NO: 116614 - DNA, 601 bp, Human; identical to SEQ ID NO: 116604

SEQ ID NO: 116615 - DNA, 601 bp, Human; identical to SEQ ID NO: 116605

SEQ ID NO: 116616 - DNA, 601 bp, Human; identical to SEQ ID NO: 116606

SEQ ID NO: 116617 - DNA, 601 bp, Human; identical to SEQ ID NO: 116607

SEQ ID NO: 116618 - DNA, 601 bp, Human; identical to SEQ ID NO: 116608

SEQ ID NO: 116619 - DNA, 601 bp, Human; identical to SEQ ID NO: 116609

SEQ ID NO: 116620 - DNA, 601 bp, Human; identical to SEQ ID NO: 116610

SEQ ID NO: 116621 - DNA, 601 bp, Human; identical to SEQ ID NO: 116611

SEQ ID NO: 116622 - DNA, 601 bp, Human; identical to SEQ ID NO: 116612

SEQ ID NO: 116623 - DNA, 601 bp, Human; identical to SEQ ID NO: 116613

SEQ ID NO: 116624 - DNA, 601 bp, Human; identical to SEQ ID NO: 116604

SEQ ID NO: 116625 - DNA, 601 bp, Human; identical to SEQ ID NO: 116605

SEQ ID NO: 116626 - DNA, 601 bp, Human; identical to SEQ ID NO: 116606

SEQ ID NO: 116627 - DNA, 601 bp, Human; identical to SEQ ID NO: 116607

SEQ ID NO: 116628 - DNA, 601 bp, Human; identical to SEQ ID NO: 116608

SEQ ID NO: 116629 - DNA, 601 bp, Human; identical to SEQ ID NO: 116609

SEQ ID NO: 116630 - DNA, 601 bp, Human; identical to SEQ ID NO: 116610

SEQ ID NO: 116631 - DNA, 601 bp, Human; identical to SEQ ID NO: 116611

SEQ ID NO: 116632 - DNA, 601 bp, Human; identical to SEQ ID NO: 116612

SEQ ID NO: 116633 - DNA, 601 bp, Human; identical to SEQ ID NO: 116613

SEQ ID NO: 116634 - DNA, 537 bp, Human
agttgcagtgagccgagactgtgccactgcactcaggcctggtgacagagcaagactccatctgaaaaaaaaaaaagatttctgacccaactgcaaaactttttactcattcaaaaacatgtttgggccagcacgcggtggctcatgcctgtaatcccagcactttgggaggccgagtcaggtggatcacctgaggtcaggagttccaagaccagcctggccaacacggtgaaaccscatctctactaaaaatacaaaaattagccaggcatggtggcgtgtgcctgtaatcccagctaccagggaggctgaggcaagacaatcgcttgaacccaggaggcaggggttgcagtgagctgagatagcgccactgcactcctgcctggaccacagagcgagactgtctcaaaaaaaagtttggccccacaggtaaaaaatcaagttttttttcttgtgacatatacaatttaaaattgtacacacatttctgtttcaccttttagttgggttcaaaaaaaccaaaaatcttaaactgat

SEQ ID NO: 116635 - DNA, 601 bp, Human
tttactctctgatgctacttctagtatttgcattctgatttattctaatcccaccattcttacataatgttctttataaacttaaaaccccagcaggggtttaaaaaaaaaagacacaaaagcaaactaaagagagaaaacctagcatctcccttgtactactaactgaatggtgaaagcattttagttgctaagcaatagagttcaagatctttaacagaacacaatattggagaaaacatccaactcttcccgcatcttttttctagctgtctacttggctaaaaatagaaaaatgctkataacagagggtagagggtagtcctaatgttacactgctaaatatcctactatactaaccatgtatgcagaagttctgtctacagattaaaagtcacccttgtaaataatttcttcccctcccccaagttacacattcctttaaaaaaaaaaaaacctacctacagctttttttcccagttgactttaaaagcttaattagcataataaatttttcttgtcattagtgcatattttatgagtagcaaaaaaaaaatttttttaattttaagcaatgagtatcacatatgctaaatcattt

SEQ ID NO: 116636 - DNA, 601 bp, Human
aagattgagcctgggaagtcaaggctgcagtgagctgtgatcaagccattgtgctccagcctgtgtgacagagcaagaaaaaagtttgatgactttaaaatctgtcagttatctttctcttatactttactttatcatgggtttaattctatggttataaacaataaagcatcaaaaacagggtaggaagcactctcacaaccatttctgacaaagataccttataatctttagcttggcttttattctagtcttttttaaaacaatcgtatgctcgggtgggcaccgtggctcacgcctktaatcccaacactttgggtggccaaggtgggtggatcacgaggtcagaagttcaagaccagcctggccaacatggtgaaaccccgtctctactaaaaattcaaaaattagctgggcatggtggggcgtacttgtaatcccagttactcaggaggctgaggcaggagaattgcttgaaccaggacccggaaggcggaggttgcagtgatttgagatcacaccactgcactccagcctgggctacagagtgagactctgtctcattacaaaaaaaaaaaaaaagaaagaaattatatgctta

SEQ ID NO: 116637 - DNA, 601 bp, Human
agataccttcctcaaagtttatgactggaagaaaagaaataacagattttaaaaccaccacttgcttactttcgtattcatattctgagaaaattccaaaattgtgtcgactcttgtccaagcatcaggatgctcctttaaatgtgtcagtacttcttgagccattctttgctaaaatattattaaaaaaaacaaaacttaagctaatgtattcttttgaatcattcattaaaatgaaaactactgagcaaggcacaaattctaattggacagagattctattattgatgttcagaaataytcaaaaattagaccttacagaaatagaaataaaattatataaatatgactcccaattttttttttttttttttgagacagagtcttggctctatcacccaggctggactgcagtggtgcgatctcagcaccctgcaacctctgcctcctgggttcaagcgattctcccgcctcagcctcctgagtagctgggattataggcaggtgccaccacagccagctaatttttgtatttttagtagagatggggtttcaccatgttggccaggctggtcttgaactcctgacctcaggtgatctg

SEQ ID NO: 116638 - DNA, 601 bp, Human
tcagcctgagcaacacagggagaccccacttctataaaaaaattggtaagttagcgaggcatggtgacacgcacctgtagccctagctactcagaaagttgaggcagaaatgtcacttaagcccaggagtttgaggttacagtgagctataatcacaccactgcactccagcctgggcaacagaggtcctgtctcttcaaagaattttttttctttttttttttagtatttttgctcaaaaatctgaagtgacagtcaaatctgaaagccaatgataaatcactacaatccaaacattctraagaattatacttttgccttacatctccaaacttgagaaatccactgctgagttatgaagatgagggacagataacagcaaagactaaatgaaaaaataaatgcatgaaatgatccctatggtagaaatttctactgagcccttagaaatacttattttatgcattgaattcccctttcccctcccaccgcccatgaaacaaaaacaattgatgaacagaattcagttaaagggaatcaaaagggtagaccttgtggaggcctgccgtcaaagcctagctgtgtcagttgcacaggaaga

SEQ ID NO: 116639 - DNA, 601 bp, Human
aaaaactttcaaaataaaaacaaggccaaagcaaaattctaaaattacaaatttgatgctattaaaatgtttcataatcagcagtaaatagtgatgctttctaacctgttcacttttaaaaacatatctatttattatgtctaggtctgagaaatatgtaaaaaaaagagagttgtccaaatgcctgaagttcttaattagcttttaaaaacatactaccctaagcattttctttaattttataggcacaaaatcagattgtcaagactcagtaagtcaaagcaatgcactgcttacaatrtatcctcttgccaaaaatcaattaaaaagcctttaaaacactaagaaacaaaacccaccataaatatagttacaaataaaaatcttaaagataacttcatcttatttaaccaaacttttttacatttttaatggaaagacactgtcctttcttttttatttacttcttcctatttgatactgttacctaaaattactatttactaacctgtattttctacaactgtataaaggtagcataagcttgatgaagatacaattcatatttcatctttctgccaagggggttgaagcagggagc

SEQ ID NO: 116640 - DNA, 601 bp, Human
agctcaccaggatctcagccagctcctcttcctcacactcccatggctccttcccatacacctctctggttttctgccaggacccaaaatggcaggggaaaaaaaataggttacaacatgcctccgcgtttccattcccatttatctccttcctccaaagtccttgcaacagaaccaccagctcaaagaggattccatttaacatccattgatgcacaaggtcctgggctttagagccatagagacctgcattcaaattcaagctctaccacttactagccgtgttattaatgcttctgakcttcagtttcctcatctgtaagttgaggataataaacatacttaactggtgaattaaaatttaattgtgaaaagtcattctcaagtaacatatgtaaaattaaataatccatataaagcacttagcacagtgcttggcgcatagtaagcactaacataaattaatgttgttgttgatagtttcattgttactattactgactgggagtaaggaggccttggacatagtcctagttcttcctctcatttactgtgtaacttgaggcaagttccttctctctctgggcctgtgtccccatgt

SEQ ID NO: 116641 - DNA, 601 bp, Human
tgttttgacctcacctcttgtggaatgtgaaatttatccaccactttgagctcataatacatctgtattccacattttaccagctccagttctgttaggggtaagtcactgaagtgaaatttattaatttcgtatttatctgcatctggcagctccgcttgctgtataaggaatagagtcaggtgattaggaaacatgaagtgtttctgggtgcccacctcctgtccagccctgtccccatcctgggtctgctggaaggatcagaacagagtgatggggaacatgctttgcaaggagaaamccctgcatgctcaggagcactttgcacttgttatacatcggggctcgtgctgccccggttcagctcaccaggatctcagccagctcctcttcctcacactcccatggctccttcccatacacctctctggttttctgccaggacccaaaatggcaggggaaaaaaaataggttacaacatgcctccgcgtttccattcccatttatctccttcctccaaagtccttgcaacagaaccaccagctcaaagaggattccatttaacatccattgatgcacaaggtcctgggctttagagcca

SEQ ID NO: 116642 - DNA, 601 bp, Human
gagcaactatccttggagaagctaacaagggctctacagggaaaaaaaaaacaaaaacaaaaggactcttttatccagtggttctcaaacttgcgtgtgcatgagactcacttggaggacttgttaaaacagtttctgatttatcagagctgggagtgtgtgtgtgtgtgtgtctgtgtgtgtgagagagagagagaaagaggagagagagagagagaaaaagaagaatgtgaatttctgataagttcttaggtggtgtggatgtggtctggggtaacactttgagaaccactgctttaawcaaaatcaaacaagttcaggcaattctgcatatcatatcccactgcctcccacacataccttctctgccgtcccccatgaccctagactcacagcaaaccttagtaaggaatcctgcagggaatgagccctgtttaaatgggtttagcccacattttctgccctcatttaactataggacccattttttgcagcatatctattcccagccttcagggcttagtacctcagaacccactgcaagaaaccaacgcacccaaaacatcacacttcacaggacacagaggaacagcgtgtctct

SEQ ID NO: 116643 - DNA, 601 bp, Human
aatgctaaatactaagaagatgttgttgttgttgttaggaaacgaggtgagcatgcatcattcctctgactgagcttcatcagtaattcccgaactgtgccctggagagcaactatccttggagaagctaacaagggctctacagggaaaaaaaaaacaaaaacaaaaggactcttttatccagtggttctcaaacttgcgtgtgcatgagactcacttggaggacttgttaaaacagtttctgatttatcagagctgggagtgtgtgtgtgtgtgtgtctgtgtgtgtgagagagagagrgaaagaggagagagagagagagaaaaagaagaatgtgaatttctgataagttcttaggtggtgtggatgtggtctggggtaacactttgagaaccactgctttaatcaaaatcaaacaagttcaggcaattctgcatatcatatcccactgcctcccacacataccttctctgccgtcccccatgaccctagactcacagcaaaccttagtaaggaatcctgcagggaatgagccctgtttaaatgggtttagcccacattttctgccctcatttaactataggacccattttttgcagc

SEQ ID NO: 116644 - DNA, 601 bp, Human
ttgcaaatactaaatgctaaatactaagaagatgttgttgttgttgttaggaaacgaggtgagcatgcatcattcctctgactgagcttcatcagtaattcccgaactgtgccctggagagcaactatccttggagaagctaacaagggctctacagggaaaaaaaaaacaaaaacaaaaggactcttttatccagtggttctcaaacttgcgtgtgcatgagactcacttggaggacttgttaaaacagtttctgatttatcagagctgggagtgtgtgtgtgtgtgtgtctgtgtgtgygagagagagagagaaagaggagagagagagagagaaaaagaagaatgtgaatttctgataagttcttaggtggtgtggatgtggtctggggtaacactttgagaaccactgctttaatcaaaatcaaacaagttcaggcaattctgcatatcatatcccactgcctcccacacataccttctctgccgtcccccatgaccctagactcacagcaaaccttagtaaggaatcctgcagggaatgagccctgtttaaatgggtttagcccacattttctgccctcatttaactataggaccc

SEQ ID NO: 116645 - DNA, 601 bp, Human
atttctctggggaaaagaacacatgatgtgtttatgggagcagctaacaggtggtttggaggcatctcgaatggtgaatggcaaacttttctatttcaaggttttctaatctttatttatttattttaagtggatttccacattactatgacttgcattgccaggctaactacagaaatggatacctctttataacaggccatttaaaaatgaaatatgttcctaattgtcattatgcccccaagcaaagactataaccatgaccaattgaactgttgaatttttttttttttttttttttgagacagagtctcactctgtcaccaggctggagtgcagtggcgcgatcttggctcactgcaacctctgcctcccgggttcaaggaattctctgcctcagcctcccaagtagctgggattacaggtgcccgccaccacgcccagctaatttttgtatttttagtagagatggggtttcaccatcttggccaggctggtcttgaactcctgacctcgtgatccacccgcctcggcatcccaaagtgttgggattacaggcggccctgttgaactacttttatacttgtgacatggttacccc

SEQ ID NO: 116646 - DNA, 601 bp, Human
attctaattaatataaggatatattaacatatattaatatatatttctttatttagaattcttaacacataattaatatgttatttataatatattaataactaataattaatatattattaataaaataataagggaaacaattctataagcaattatacaagagggcaaaaactgcttttggtaagaaaaagctataagatatgaggatgttttattttgttaagggtgaaaagagaaacttttgtcctaatgtaggataactggttactccaaaatgagaagaggaaaaagtataggcaaaagttgaatggataagaaagttgtagaaggcttgtggaagataaatcttgtgaaagtaattgtatgtgtgatgaagctggctaagattggaagaaaatggctgggtgcggtggctcacgcctgtaatcccagcactttgggaggccgaggcgggcggatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgt

SEQ ID NO: 116647 - DNA, 601 bp, Human
gatattgtcctatgtaaaggaatacgttaaaaattaagcctatatgttttgaataacacattaactatcactcaaactttaattcgggccgggcatgatggctcacgcctataatcccagcactttgagagacagaggtgggtgtatcacttgaggtcaggagtttaaaaccagcctaggcaacatggcaaaacccggtctcgactaaaaatacaaaaattagctgggcgtggtggtgggtgactgtaatcccagctactaggcaggctgaggcaggagaattgcttgaacctgggaggcrgaagttgcagtaagccgagatcgcaccactacactccagcctgggcgacagagcgagactctgtctcaaaacaaaaaacaaaacaaaacaaaaaccccttaattgctatagtgctttccgttgtatcaaaaacttaaaagttatatcagtttaccacccaaatcttagatattatgattgaactacttcaaataacatatttttttattcagataaataaaacaataatacactgtcttgcatttttagtgctaaaataaagattaaacatgtggcttgtgcaattggaatttggcataa

SEQ ID NO: 116648 - DNA, 601 bp, Human
tgacttaatcaagcctcatttccacagaagcatctggggataaacaaataacccaatgcttcctaggcaactagtcagccttgtctcccctgcaacttttcctgaccattgccttcaatgcccaggacccatcacagaggagccaggggaccatttggcttgggccacatattcataaaaggcctcaaatttacacttctcaccccattgtcaattgaggtgaatcatggaagcacactgagaaaactgaaaaaagacattcaccagacaacttaaatttgagtcccattaccaaccatgmcagaccatgcactgtaaatttcataccaaccataaccaatttgtgactagcacagctatattgtgggatattgtcctatgtaaaggaatacgttaaaaattaagcctatatgttttgaataacacattaactatcactcaaactttaattcgggccgggcatgatggctcacgcctataatcccagcactttgagagacagaggtgggtgtatcacttgaggtcaggagtttaaaaccagcctaggcaacatggcaaaacccggtctcgactaaaaatacaaaaattagctgggcgtggt

SEQ ID NO: 116649 - DNA, 601 bp, Human
gctgggattacaggtgcaagccaccatgccctgctaattgttttttgtattttaatagagatggggtttcaccatgttccccaggctggtcttgaacctctgagctcaggcaatctgcccgtctcagcctccccaccatgcccagttcctatttttaaatttaaataagcatgttacaatacatccaacttatcttttatttttaattctaagaaaggtaaaggtacatggagggtatgtaggtagactagacagacagatgatgatagatgatgagagatgatagatagatagatagatgcatagatagatagatgatagatagatagatagataatatgattctgttgagagactattgaccaaataaaaaagaaagaaaaaaaattgtaaagacagatgatagaaagaagacagtgaagtggattaaatcagttgctaccatcttcagtacgtattactgatgtgcctttgccctagtgtcatggtccctggacagtgatacattttctgaaagaagtaagatatttaaatgaaaaatctttcacctgctgcccccctataaaaccccacccactggctgggaatgggggtggggttc

SEQ ID NO: 116650 - DNA, 601 bp, Human
cccaaatgtcaacagggctgagactgagaaacgctgcattacaggtctcccaatatttttcgttaaatccctacctaaagaattttgaaaagtgctaccttcttgcacatttttaagttgacatcttaaactattacaagtttaatattttcaaaggatctaatttatagcacattatacatactgactatttttttttttttttttgagtcggaggagcctcgctctgtcacccaggctggagtgtagtggcaccgtcagggctcgctgcagcctcaacctctcgggctcaagcagtccytccacctcagcctcctgagtagttgggaccacaggtgcgtgccaccacacccagggaaatttttattttttatagagacaaggtctcgctatgttgcccaggctggcctcaaacccctgagctcaagccatcctctcgcctcagctttgcaaagtgctaggattacacatgtggccactgtgcctggccatactgactttttaaaataaatttgttacatcattctttacccacaataaaagcacatgagcaagcttttctttaagagtctagagttttacatctttccttgtctctgta

SEQ ID NO: 116651 - DNA, 601 bp, Human
gaataagagctcaaagagaaagtccagattatcttttcacaattacttttggcctatgatgtttccaccagctagggaacttagaaggacatatgtctactatgtttccccttcctctgtgaatccatgcttagtcatttgccccacaattatgtattaagcaactaggatgtaccgtacgctggagcctggagctgcaatcacatgagacccatagagctgtcctgagaatcgaatgccattagagatgagaagcgctttgtaaagtatcacccactggtcacctgctagggtttattaytcctgctgttgtctggaaatcccaggtttatcaaagacatcttgttgcggctgaggaagccaagggcctaccttgtagacgaaggtgcaaacaaagtcaatgaagccgacttgaagcttagggagttcatctgctttgtttctgtccatcatgggctgtcatgggggagaaagagttaattgcactggacagtaagagaaacctaccctatctatgaagcattcttactaaaatcaaactgtaaactcatcatgtttccagacctgatgagcattttgcaggaaataggagaatagagaa

SEQ ID NO: 116652 - DNA, 601 bp, Human
gctgggcaccatggctcacgcctgtaatcccagcactttgggaggccgaggcgggtggatcgtttgaggccaggagtttgagaccatcctggccaacaaggcaaaaccccgtctctactaaaaatacaaaaattagcccggtgtggtggcacatgcctgaagtcccagctgcttgggagactgaggcaggagaatttcttgaacctgggaggtagaggttgcagtgagctgagatcgcaccactgcactccaacctgggtgacagagtgagattctgtctcaaaaaaaaaaaaaaaaaaaatttagctggatgtggtggtgtgcacctgtggtcccagctactcagaaggctgaggtgggaggatcatttgggcctgggaggtcaaggctgctgtaagctatgatggtgcctctgtactccagcctgggtgacagaatgagacctgtctcaaagaaaaaaaaaaaaccagcaaaaaactcatgtcctcaatgaaaaaaaagaaatattactgatgatagtggcaagcatcagccactgtgtcccgtgggtcagagcaccccagttagtctgagttgtatctcagatgctcttgttgccttc

SEQ ID NO: 116653 - DNA, 601 bp, Human
tcccgttttcttccttgaggcctccacttatatgtcacttcctccaagaagcctcttctggccccctagtggagtcccccattggaagctcccaaagccctctcttaccacatcttgcttccttgtcatgactccctttgcttgtctccccgagaggctgagaacctggagagggcagggacattggcagcctcattccctggggtggccctggcctagcacaaggtctgggacacaaggatactcagtaaatattttctgagtgaaatcgggatgttgagaagatgatttttttttttttgaaactgagttttgctctgttgaccaggctagagtgcagtggtgcaatctcggctcactgcaacctccgcctcccaggttcaagtgattctcctgcctcagcctcccaagtagctgggattacaggcatgcaccaccaacccagctaatttgtttttttggatttagtagagatggggtttcaccattttggtcaggctggtctcgaactcctgacctcaaatgatccacctgccttggcctcccaaagtgctgggattacaggcatgagccacctagaagatgattcttaaaggctctt

SEQ ID NO: 116654 - DNA, 601 bp, Human
gggtggcacagctggaaacgtccaacactggaatgagctgcttcggagtagcaggcctcccgccaccgtgctgatactgcagggcctccggtctacaccagcccatgcctcacctgcttagaagcctcctgtggcgcccctgtccttcagcatgaagtgaaaaccccttactatggctttcaaactccatgacccagtgtcctcctgcccttgaccatcttgcattctccaagcaatccaaatctcttagttcctggagtgtgtcctccattctgtgagcctcacacaagctgctcttttcttttttttttctttccaagacagggcctcactgtcatccaggctggagtgcagtggcacaaacatagctcactgcagcctcaaactcctgggctcaacccatcctcccacctcagcctcccaagtagctggaactacaggctcatgccaccacacccaggtaattttttttatttttgtagatacagggtctccctatgttgcctaggctggtctcaagctcctggcctcaagtgattcttctgccttggcttctcaaagtgctgggattacaggcatgagccaccatgctcaacccaag

SEQ ID NO: 116655 - DNA, 601 bp, Human
tttactacttgcccaaaagacaatttgtacaaattagaaaaatgcacttatttcccaggatacctcactgccatttttctggaaaatcaaaatagctatacacatctgtgatgtacaggacactccccggagttgtgcaaagcataaactacaaaactctaagtggcccctacatttgcagctgcccatttagaatcaacccacgctgcccagagcagagctgaggccctgacattttccatgtgtaagagccatgggtgaagagggatgggtgtgcaaaggagggcagtcagggtgaggsagggacaagatgccatgtcctgtgaggaaacagatcacacaatcagtaaaagaaatgacttgggggaggggcagtgctgtcagtagtaaagagttagaacaaacaaatcccatttgattctgaaggcagaaccatgaccactaagtggaagcttcaacaaggaacaatttgagttctaggaagacctttctaatagtggtactgaatgaggatgtcatataagatagtgagacctctgtcactggtggtatacaagcataagctcatgatggtatagataggattcaaacatcagacaga

SEQ ID NO: 116656 - DNA, 601 bp, Human
aaaaaaatgttggtactgattctctagctataagaaaaaaaagaaggagaaaaaaatgtaagccaaatctgtatttttttatctgaaggccacaaatttgcactgatttactacttgcccaaaagacaatttgtacaaattagaaaaatgcacttatttcccaggatacctcactgccatttttctggaaaatcaaaatagctatacacatctgtgatgtacaggacactccccggagttgtgcaaagcataaactacaaaactctaagtggcccctacatttgcagctgcccatttagartcaacccacgctgcccagagcagagctgaggccctgacattttccatgtgtaagagccatgggtgaagagggatgggtgtgcaaaggagggcagtcagggtgagggagggacaagatgccatgtcctgtgaggaaacagatcacacaatcagtaaaagaaatgacttgggggaggggcagtgctgtcagtagtaaagagttagaacaaacaaatcccatttgattctgaaggcagaaccatgaccactaagtggaagcttcaacaaggaacaatttgagttctaggaagacctttctaat

SEQ ID NO: 116657 - DNA, 601 bp, Human
tgcaccccctgggctggggtttccccccggctgatttcctgcggctgctgcaatgaaacaggaaaaagaacacaccaggtgacaagaggctgcagtgggcttcccctttgacctaatttggaccaagagttgcaaactcaaaggctttcagtggccaacagataacaacacatgcagaaggcaaaccaggtgtgaggagaatcacggaaacagaacatttctctaagaaaaatagcagcacgaggatgatgataagtgagaaccagtactcggcaccaacgtctgggagaccaggggagcwgtgaacatgacaaactagagacagcctctgtctcatctaaagggggcagttgccactcggcttcagccaattgttgtcatgcaaaaatgatagactggtgtggccagatcttacctttttactcttttagaaagaaaagctgggccaggcacagggctcacgcctgtaatcccaacacttcaggaggctgaggcaggaaaatcacttgagcccaagagttggaggccaacctgggcaacatagcaagacctggtttctacaaaaaaatacaaaaattggccaggcatggttgcatacacc

SEQ ID NO: 116658 - DNA, 601 bp, Human
tctcttaagccagggaagcagaggttgcagtgagccatgatggcgccactgtactccagcctgggtgacaaagcaagatcttgtctcaaaaaaaaaaaaaaaaaaaaaattatttttgtgaagtcattcacattaccaatgtttaatagagttctggtttttttacagaaaaattttgaaagacttatcttctgaagatacacggggcagaaaaggagacggagaaaattctggagtttctgctgctgtcacttctatgtctgttccaactcccatctatcagactagcagcggacagtayagtatgtataggaatcagtttccacattataaacacacaaaacctgacttttctgtagaaagaaatggtgttaggaaaactgtaatactttgatagtgatgattattaaaggatgttttcagccaggaataatgcgaagtactgtttcagcattatttactccttataacaactttgtgacataggcaattatcaatgtatgagggaactgagacctacaacattagatactgttttgttttgttttgttttgttttgttttgagacagagtctcgctcttgttgcccaggccggagtgc

SEQ ID NO: 116659 - DNA, 601 bp, Human
taagccagggaagcagaggttgcagtgagccatgatggcgccactgtactccagcctgggtgacaaagcaagatcttgtctcaaaaaaaaaaaaaaaaaaaaaattatttttgtgaagtcattcacattaccaatgtttaatagagttctggtttttttacagaaaaattttgaaagacttatcttctgaagatacacggggcagaaaaggagacggagaaaattctggagtttctgctgctgtcacttctatgtctgttccaactcccatctatcagactagcagcggacagtacagtaygtataggaatcagtttccacattataaacacacaaaacctgacttttctgtagaaagaaatggtgttaggaaaactgtaatactttgatagtgatgattattaaaggatgttttcagccaggaataatgcgaagtactgtttcagcattatttactccttataacaactttgtgacataggcaattatcaatgtatgagggaactgagacctacaacattagatactgttttgttttgttttgttttgttttgttttgagacagagtctcgctcttgttgcccaggccggagtgcagtgg

SEQ ID NO: 116660 - DNA, 601 bp, Human
ggagtttctgctgctgtcacttctatgtctgttccaactcccatctatcagactagcagcggacagtacagtatgtataggaatcagtttccacattataaacacacaaaacctgacttttctgtagaaagaaatggtgttaggaaaactgtaatactttgatagtgatgattattaaaggatgttttcagccaggaataatgcgaagtactgtttcagcattatttactccttataacaactttgtgacataggcaattatcaatgtatgagggaactgagacctacaacattagatacggttttgttttgttttgttttgttttgttttgagacagagtctcgctcttgttgcccaggccggagtgcagtggcacaatcttggctcactgcaacctctgccttcccgattcaagtgattctcctgcctcagcctccggagtagctgggattacaggcgtgtgccaccacgcccggctaatttttgtatttttagtagagaggaggtttcaccatattggccaggctggtctcgaactttgacctcaggtgatccgtccaccttggcctcccaaagtgctgggattatagacatgagcca

SEQ ID NO: 116661 - DNA, 601 bp, Human
ttcctggcttttttttttttttttgaggtggagtttcgctctgttgcccagattagagtgcagtgccatgatctcggctcactgcaacttccacctcccgggttcaagtgattctcctgcctcagcctcccaagtagctgggattacaggcgtgcaccacttcgcttggctaatttttgcatttttagtagagacggggtttcaccatgttggccaggctggtctcaaactcctcctgacctgaagtgattcacccaccttggcctcccaaagtgctgggattacaggcgtgagccaccaygcctggcccctgcctattcgttaaaaatatttattgtttgatttatatacagtaaaattcactctttggggagtttaagtctatgagttttgacaaatgtgtagaatagtataacaccgccaatcaagattgagttctgtcaccctaacgaatttacttgtgctgcccatttgttatctccccctccactcctaacattaatctgtttcattcagtcttgccacaaaatatatgtcccatctgaccacctcttgccgtctccaaccaccaccgccttggtttaggctctcatcttaatta

SEQ ID NO: 116662 - DNA, 601 bp, Human
tctaataatcagttttccatactgtggccaaagtgatttatttaagatgtcaactagatcacatcgctcctgcccaaaatcctctagtgacattttatcacacttagaataaaatccggatcttacaaggcattacatttaggatctgcctaccactctgacctcatctcctgccacttggtggcattctgaccaccccagacttccttactgtacctcagacacacgagcttgtttctgcctcaggatctctggagttgtcattgctcatgcctggcatgttcttcccccagatccttaygtggctactctgcttaagtgtcacctccacaaagagaccactctcttcaaatatgtggctcctccctttagtttcccttaacctcctatatttttctttatagcatttacatataactaagtcagtacatattagtttaattatagattgtatgtatgtaattatagattagcttattcatgatctgttttccccactagaatataagatccttaagggaaagaaccttttgtttcattcacaactacatccttgacatataggacctggcatatagtaggctttcagttgtttgttatg

SEQ ID NO: 116663 - DNA, 601 bp, Human
ctagaaaatgaagctaagaaaccatataaagatgacttattttctcattatataaccttttattctattgaattttttccataagcatgttatctattcagaaatattttaaagtaataatatttttaatgcttttgactcaaaattacaaactatgtttatgtttcctttttattttttcttaaaaattaactatcatggggccaagtgcagtggctcatgcctgtaatcccagcactttgggaggctgaggcgggtgaatcacctggggtcaggaatttgagaccagcctggccaacayggagaagctccgtctctactaaaaatataaaaatcagctgggcatggtggcgcacacctgtaatcccagctccttgggaggctgaggcacaagaatggcttgaacccaggaggcagaggttgcagccagccgagatcgtgccactgcactccagcctgggcggtagagcgagactccatctcaaaaaagaaaaaaaaaaagaaatgctgttttattccttttacatgtagttcacctaaagtaaagtagtctgcagttaccaagtagaagtgcattcatacctgttttagtaaatagtgt

SEQ ID NO: 116664 - DNA, 601 bp, Human
tacagtcatgggctgcatgacaatgtttaagtaaacaatggaccacataaatgaatgacggtggtcccataaaattataatggagctaaaaagtcctgtgctaatgtcatagtgcaacacattactcacgtttgtggcaatgctggtataaacaaacctattgtgctgccaatcatataaaagtgtagcacatgcaattatgtatagaacataatacttgatactataataagttaatatgttactggtttatgaatttactatacttttaatcattattttaaagtgtataccttctactttttttttttttttttttaaagttaactgtaggccaggcatggtggctcacgcctgtaatcccagctgaggcgggcagatcacgaggtcaggagatcgagaccatcctggctaacgtggtgaaactccatctctactgaaaatacaaaaaaattagctgggcgtggtggcgggcgcctgtagtcccagctacccgggaggctgaggcaggagaatggcatgaatctgggagccgaagcttgcagtaagctgagattgcgccactgcactccagcctgggcaacagagtgagactctgtct

SEQ ID NO: 116665 - DNA, 601 bp, Human
tgtgctgccaatcatataaaagtgtagcacatgcaattatgtatagaacataatacttgatactataataagttaatatgttactggtttatgaatttactatacttttaatcattattttaaagtgtataccttctactttttttttttttttttttaaagttaactgtaggccaggcatggtggctcacgcctgtaatcccagctgaggcgggcagatcacgaggtcaggagatcgagaccatcctggctaacgtggtgaaactccatctctactgaaaatacaaaaaaattagctggkcgtggtggcgggcgcctgtagtcccagctacccgggaggctgaggcaggagaatggcatgaatctgggagccgaagcttgcagtaagctgagattgcgccactgcactccagcctgggcaacagagtgagactctgtctcaaaaaaaaaaatttttttaactgtaaaacagcctcaaggcagcccctacaggaggtattccagaagaaggcattgttatcataggagataacagctccctgtgtgttattgcccctaaagaccttccagtgggataaggtatggaggtggaagacaatga

SEQ ID NO: 116666 - DNA, 601 bp, Human
ttttttttttttttcttgtagaggtggggttttgccatgttgcttaggctggtctcagacctgggctcaagtgatccatccacctgcctcagcctcccaaagtgctgggattacaggcatgaaccactgcacccagcccccaaaaatttaaaattagctagtacaaccactatgaaaaccagtatggagacttctcaaaaaacgaaaaatagaaatctacccaaaggaaaagaaatcaatatatcagagggatacctgtactcataagtttacttgcagcactattcacgcacaatagctratagaatcaactatgtgtccatcagtggataaatggataagaaagaattaaatcatgtcatttgcagcaacatggatggaattgaaggtcagtatcttaagtgaaataagccaggcacaaaaagaaaaaatatcacattctcacttatatgtgggagctaaaatatttgaacacatggaagtagagagtggaaaaatagggctgggcgtggtggcttatgcctgtaatcccagcactttgggaggccgaggcgggaggatcacttgagcctaggagttcaatgcaagcctgggcaacata

SEQ ID NO: 116667 - DNA, 601 bp, Human
cgaaaaatagaaatctacccaaaggaaaagaaatcaatatatcagagggatacctgtactcataagtttacttgcagcactattcacgcacaatagctaatagaatcaactatgtgtccatcagtggataaatggataagaaagaattaaatcatgtcatttgcagcaacatggatggaattgaaggtcagtatcttaagtgaaataagccaggcacaaaaagaaaaaatatcacattctcacttatatgtgggagctaaaatatttgaacacatggaagtagagagtggaaaaatagggstgggcgtggtggcttatgcctgtaatcccagcactttgggaggccgaggcgggaggatcacttgagcctaggagttcaatgcaagcctgggcaacatacccattgctacaaaagataaaaaattagccaggcatggtggcgtgtgcctaaaatcccagctactcgggaggctgaggtgggaggattgcttgagcccagggggttgaggcagcatgatcgcaccactgcacttcagcctgggcaacagagcaagaccctatctcaagaaaaaagagagaatggaaaaataggtaacagaga

SEQ ID NO: 116668 - DNA, 601 bp, Human
tttccaatttgtcttgaaaaatggaaacactcgggcccacatgtaacgggtggagtaatgactgcccccttttgacaagtcatgccttttccagcttgttatagtccataccactttctattacttgccccacctcctcatttatacagccactgccacgtctatttcatattgatttgttagcaacctggttttgtaactttgttttctgcttcttggctcatcagagaatgagtagctacagaatgggtcagatcaggctatgcctcagggcacaagatcctcatttgtttctcatcartgaggcccacaacccaggtatccattttatagttggatgaacaaagaaaagtaatgtgcaccaggggatgtagcaagtcaagaccgagtcaaggctagaacccaggactccagcctcctatccacttcagaatgattttcagtacatgacaccacttccccatgaatcggaggtctcctatatgcttggctttagcaggccctgagcaatgatattttccacccccaaagccctctgttggtctgtgctcttgaagagcacttggctctacatggtacctcctagatgactgttttatgg

SEQ ID NO: 116669 - DNA, 566 bp, Human
cagcactttgggaggccaaggtgggcagactgtttgagcccaggtattcaagatcagcctgggcatccgagatggcaaaaacccgtctctacaaaaaatacaaaaattaaccaggtgtggtggcacactactacagtcccagctactggggaggctgaggcagaaggattacttgagtatgggaggttgaggctgcagtgaactggaatcacaccactgaactccagcctgggtgacagattgataccctgtctcaaaaaaaaaaatcagatttcaaataaaactattaatttccaatttgtcttgaaaaatggaaacactcgggcccacatgtaacgggtggagtaatgactgcccccttttgacaagtcatgccttttccagcttgttatagtccataccactttctattacttgccccacctcctcatttatacagccactgccacgtctatttcatattgatttgttagcaacctggttttgtaactttgttttctgcttcttggctcatcagagaatgagtagctacagaatgggtcagatcaggctatgcctcagggcac

SEQ ID NO: 116670 - DNA, 601 bp, Human
tctacccagaggaaaagaagtcattataccaaaaagatacttgcacactcatgtttatagcagcacaatttgcaattgcagaatcatggaaccaacccaaatgcccatcaatcaacgaatggaacagaaattgtgatagaatagaatactactcagccataaaaaggaatgaattggccaggcattggtggctcacgccggtaatcccagcactttgagaggctgagacagtcggatcacaaggtcaggagatcaagaccatcctggctaaaacagtgaaaccccgtctccactaaaaatmcaaaaaaaaaaaaaaaaaaaaaagttagccaggtgtgctggcaggcacctgtacagctactcggaggctgaggcaggagaatggcgcgaacccgggaggcggagcttgcagtgagccgagatcacgccactgcactccagcccgggcgacagagccagactccgtctcaaaaaaaaaaaaaaaaggaatgaattaacagcatttgcagcaacctagatgagattggagactattattctaagtgaagtaactcaggaatggaaaaccaaacatcgtatattctcactgatatgtgggagc

SEQ ID NO: 116671 - DNA, 601 bp, Human
tgttatcccagctactcgagaggctgaggctggagaatcacttgaacccaggaggcggaggtttcagtgagccgagatcaagccattgcactgaagcctggggcacaagagcgaaactctgtctgaaaaaaaaaaaaacaaaaaacaacaagccagacgcagtggctcaaacctgtaatcccagcactttgggaagccgaggtaggcagatcatgaggtcaagagattgagaccatcctggccaacatggtgaaaccccatctccactacaaatacaaaaaattagctgggcgtggtggcrtgtgcctatagtcccagctactgaggaggctgaggcaggagaatcgcttgaacctgggaggcggaggttgcagtgagccgagatcatgccattgcactccagcctggtggtgacacagcaagactccatctcaaaaaaaaaaaaaaaaaaaagtagaactaccatttgatccagcagtcccactactgagtgtctacccagaggaaaagaagtcattataccaaaaagatacttgcacactcatgtttatagcagcacaatttgcaattgcagaatcatggaaccaacccaaatgcccat

SEQ ID NO: 116672 - DNA, 601 bp, Human
tcatgcccgtaattgcagcactttgggaggccgaggtgggcagatcacaaggtcaggagattgagaccatcctgactaacacgatgaaaccccatctctattaaaaatacagaaaattagccaggtgtggaggcgagcgcctgtagtcccagctactcaggatggtggtgagctcctgtagtcccagctactcgggaggctgaggcaggagaatggtgtgaacctgggaggcggagcttgcagtgagccaagatcatgccactgcactccagcctgggtgacagagcaagactccatctcaaaaaaaaaaaaaaaagaaaaagaaaaaaacaaacaatcccatcaaaaagtgggctaaggacatgaatagacaattctcaaaagaagatacacaaatagccaacatatgaaaaattgctcaacatcactcatgatcagtaaaatgcaaatcaaaaccacaatgtgataccaacttactacttcaagaatggccataatcaaaaaatcaaaaaacagtagatgttggcatggatgcggtgatcagggaacacttctacactgctggtgggaatgtaaactagtacagccactgaggaaaaca

SEQ ID NO: 116673 - DNA, 376 bp, Human
tcttagggccccacgaagtctcaacacaagaagggtggactccttttgaatgttgtagtcagacaaagcacatccrtcttccagttgcttgccagcaaagatcagtctttactcgtcagaaggaattccttccttatcttggatgttggcttttacatttccttgtatccaagggttcaacctcaagactgatggctttctccataaaggttgttatgaaaatctgcattttggtggtggctccactgcagatggtggatcgaaaaggcagtatctttgtctctaacatcagggattagttttgccccagtacagccaactgatcttggcaacaaagcaaacgaaaacataaagtggggaaagaacagccttttca

SEQ ID NO: 116674 - DNA, 601 bp, Human
gaaatgaatactttgacaatggtagattgtattattgtttccaatcattctttgccttccctgtaagattgtatatcctcacttattgccatgtgatttttggtatctccctgtggaagaagtataattctcaatccagtgatgtcaggcttagccatgtgacttgctctctcaatgaaatgtaagcagacgtagtgtatataagatttgagcagaaactttaaaaatcatcatgtggttctgccaatgctcatttccttctgccacgagaagggaacatcccagacagaggctgcacctkgagcctggatcccagaatgaagaaggcccatgaaagagccaatacagaacatgagcaagaattaaacctttgttttgcaagtcactgttttgttacagcaacatagtccggtaaaagctgactaataaggggcctatggaaagagtgacaagcagctcctctttggctctttctgtgccttctctctcttacatctcctggctggttaatgagtattctttctgttaaaggctggaccaagatgttacctccccatctctctgaacttggtatttggagcctgtttatgggttaagactt

SEQ ID NO: 116675 - DNA, 601 bp, Human
gccacaggcggcagcgcgcagttgggggcgatggtgttgcgccggcgctccccgcagccccggtcgttgggggcacatgggcacagtagcaggccctgcgcgtggggctcggcggccttctcgaagaaagtgagcagctgcctgaggcagacgtggcgctggcagtggggcccggagcacgcctccccgtaggccttgcgcagccggtcacacttgtcattgagagtacacagcatggcaaacttgaggcagaggtctgagtctggggggaaagggcacggagtcagtcggctgggccctytgcacgcctgcaccccaggttccacaggaaccccggaaacccctgatttgacaagaaggtagtggatataggaggaaaagaaggcctgtcatgaataaacccactcctaatccagggcttcccctctccccacaaactctacctgctgttttgaagccttccccaccctactcctcttttttttttttttttttttttttttttttttgagacggagttttgctcttgttgcccaagccgaagtgcaatggcgtgatctcggctcactgcaacctccgcctacatgggttcaagcaattc

SEQ ID NO: 116676 - DNA, 601 bp, Human
ctggtggcacatgcctgtagtcccagctacttgggaggctgaggcaggagaatcacttgaacctgggaggcagaggttgcagtgagccgagactgcgccactgcactccagcctggatgacagagagagactccatctcaaaaaaaaacaaacaaaaaaaaaacaaacaaaaaaaaaccaaaacaaaaacctaaatatctagcaatagaggaatggttaaattaagtgtagggcatccatacatggaatataatgcaggcatttaaaaatcaagttcttggctgggtgtggtggctcacayctgtaatcctagcactttgggaggccaaagcaggtggatcacagggtcaggagttcgagaccagcctggccaacatagtgaaaccccatctctaccaaaaataaagaaattagctgggcatggtggcacaagcctgtagtcctagctactcgagagactgaggcagaagaatcgcttgaacctggcagacagtggttgcagtgagccaagatcgtgtcactgcactccagcctgggtgacagaaggggactctgtctcaaaaaaaaaaaaaaaaagttcttaaaggacagtaagtaaaaa

SEQ ID NO: 116677 - DNA, 601 bp, Human
tgcctgttatcctagcactttgggaggctgaggcgggcggatcacgaggttaggagatggagatcatcctggctaacacggtgaaaccccgtctctactaaaaatacaaaaatttagccgggcctggtggcacatgcctgtagtcccagctacttgggaggctgaggcaggagaatcacttgaacctgggaggcagaggttgcagtgagccgagactgcgccactgcactccagcctggatgacagagagagactccatctcaaaaaaaaacaaacaaaaaaaaaacaaacaaaaaaaaamcaaaacaaaaacctaaatatctagcaatagaggaatggttaaattaagtgtagggcatccatacatggaatataatgcaggcatttaaaaatcaagttcttggctgggtgtggtggctcacacctgtaatcctagcactttgggaggccaaagcaggtggatcacagggtcaggagttcgagaccagcctggccaacatagtgaaaccccatctctaccaaaaataaagaaattagctgggcatggtggcacaagcctgtagtcctagctactcgagagactgaggcagaagaatcgctt

SEQ ID NO: 116678 - DNA, 601 bp, Human
acacctgtaataccagtactttaggaggccaaggtgggcagatcaactgaggccaggagttcgagactagcctggccaacacagcgaaatcccgtctctactgaaaatacaaaaaaaattagctgggcgtggtggcaggcgcctgtaatcccagctacttgggaggctgaggggggagtatcccttgaaaccaggaggcggaggctgcagtgagccgagatcgcaccactgcactccagcctgggtgacaaaacaagactccgtcttaaaaaaaaaaaaaaatcgctgggcacggtggctyatgcctgttatcctagcactttgggaggctgaggcgggcggatcacgaggttaggagatggagatcatcctggctaacacggtgaaaccccgtctctactaaaaatacaaaaatttagccgggcctggtggcacatgcctgtagtcccagctacttgggaggctgaggcaggagaatcacttgaacctgggaggcagaggttgcagtgagccgagactgcgccactgcactccagcctggatgacagagagagactccatctcaaaaaaaaacaaacaaaaaaaaaacaaacaaaaaaaa

SEQ ID NO: 116679 - DNA, 601 bp, Human
gtaagagaatgcataagccaggcatagcggctcacgcctgtaatcccagctacttgggaggctgaggtgggagaatcagttgagctcaggggttggagactaccctgagcaacacagcaagaccctgtctcagaacgaaagaaagaaaaaaaaagaaagagaaagagagacagagagaagagaaggagaaaagagagaagagaagagaaggaaggaaggagagagagaggaaggaaggaaggagaaaaagagaggaaggaagaaaggaaagaagtaaggagagaagaagagaaagagagargaaggaaagaaggaaggaaggagggagggaaggaaggaaggaaagaaggatcgatttaccttattggggttcttgtgaggtttagatgagttaatatatgttaagtacttaaaacagtatctagccctagtaagtatttagttattcagtaaatgttagtattatgattattaagagccctgactataagatagtttacagatgaggaaagtggtagtctcagaagttaagtaacttgccgaaggttacaaagaactaagtaggagaaccaagttgcaaaccaaggttattgtcaacaaa

SEQ ID NO: 116680 - DNA, 601 bp, Human
agtgaccttgggagatctcttgctcctaatattacctcaagcctttttaaacgttttaagccggagaccaagcatggatatgggagttaggggtcttgatttaattcttggttgcttcaaactctgtggaaccttgaggtgtttcttgccttctctgggtctcaattttcacatctatatggtggggagcttggattgggtaatgtctgaggctagaaccatggccaactcgggttctgctggggctgacttgccctggccttccctgaccaccctgcatctggcttctggagaagtccckcactgaccttgttctcctccccaggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtccc

SEQ ID NO: 116681 - DNA, 601 bp, Human
ttctgtgactctgatttggtggccttcccttagtggccttactgatttcatttggatggtgcttgtggtatatccaaccaacatgtcttcccaaatggccttttaatttcctataaagaagtagttgtcattgattgcaggttagggacagaaaatgctgtggaatgaaacaaaatgcaagttaaagaactaaattccaaaaatacccattgctactattgactgagtgaattcctactgtgtgccagacactgtacccagtccattccctgtattgttttatttaagcctcacaagggtrtagtgtgactacactgtttcttaacaatgaagaaactgcccaaatcgcccatctgggaagcggcccagctagaatttgaatccaggcctgttttcctccagagcttgtgctattctctgtctgtcataaaatgtgggggctttgtgtggtaaacttgctcagttgggcatagcagttgttaggaaacctgaggctggtaacaccagctgtaataccagctgtccgtctgactcatgcaactgttaaagttgatagggctgaggtgtcagactgagctctgaattgcctgattcctataac

SEQ ID NO: 116682 - DNA, 601 bp, Human
agggacttggtctggcttttccttccctgggaatttataaggacctcttctgggaagtcagtcggcaatgccatgaatgagtctggggaaatattgggctcattgcaactggagggtctggtaggactgatgtgaattaggtgctgtgtccggaggaaaatggccagaggaagtgggctgctttgtacagtcagtggtaaagttgccaaaggctattatagctcacaggaatgggccaaggctaaacactcctgtggagtgaaatgaatgtcctcagctgactgaggcagcgggagttgaraagaaacgatattagttcatggtgaagacaagtcaaatatagataaaggttagggtcaggcttgcctggacatctaggagataactgccctcaacttgtttgaatcttgagtcactgctccattttgtttgaactggtggccatctacttatagtatacagccatcaacctgagatttccctacatggtcttcctgccttggtctcctgtatcctgaatcctatggcctcttcttccctggtttactacattttgctagaccgtatcctccagtcaattccttagaatgaatgtatgaaa

SEQ ID NO: 116683 - DNA, 601 bp, Human
cctccagtcaattccttagaatgaatgtatgaaagttaaaatttctgaggtctcacatgtcttaaagttccctcatactggattgatagtttggctgggtataaaattctgggctggccatcattttccttcagaattttgattgcattattccattatcctctcttttcaatattgcttctaagaattccaaaacctttttttttttttctttttgagacagtgtctcactctgtcacccaggctggaatgcagtagtgtgatctcagctcactgcaacctccacctcctgggtttaagygattcttcttcctcagcctcctgagcagctgggattacaggcacccaccaccacaccctttagtagagatggggttttgctatgttggccaggctggtcttgaacttctgactttaggtgatctgcctacttcggcctcccaaagtgctgggattaaaggcgtgagccaccacacccagcctccaaaaccattttaaaactctttctggaagcttttaaaattttcttttagtccccagaattttaaaatttcaattatgtgccttggtgttcttccattatgttagtcacccaagaggt

SEQ ID NO: 116684 - DNA, 601 bp, Human
cacctcctgggtttaagtgattcttcttcctcagcctcctgagcagctgggattacaggcacccaccaccacaccctttagtagagatggggttttgctatgttggccaggctggtcttgaacttctgactttaggtgatctgcctacttcggcctcccaaagtgctgggattaaaggcgtgagccaccacacccagcctccaaaaccattttaaaactctttctggaagcttttaaaattttcttttagtccccagaattttaaaatttcaattatgtgccttggtgttcttccattatrttagtcacccaagaggtactttcaatctggaaacttctctatgttttgggaaatgttcttgattagtttacaggtgatttcttcctctccattttatctcttctcttttcatgaaactactattaattcaatgttagaattccttgactgatcatttaattttcttctattttccatctctgtgtctttttgctctacttttctatgatagtcacagctctatctttaaactcttgagtttttcatttttgatgtcatgattttaatttgcaaggggtaggtttgactgattcttttttg

SEQ ID NO: 116685 - DNA, 601 bp, Human
ggcatgagccaccatgctcagccatatcttgctattttctacatggattacatgttgaaatggtaatgttttggctattgtggattaaatagaatatatgattaaagttgatttcatctatttcttttaactttaaaaaatatgtctgttagaggatttgaaattccacatgcggcttgcatttgtgacctgcatttcatttctgtggaacagtgccctttttgggacatgctttgaaggtggagtcaacaggatttggcagattacagacgagaggcttcaagggtgactccaagacttmggggcagagcacctggaagaaaggggttaatattagccaagatgaggaaggctgtcggtttggcaggtgcatgggcaggttaggagtttagttttgaatatgttggaggtgtttatgaaacttttaagtggagatggaaaataggcagttggatgtgcaagtccagggttcagggagacagttcaggctggagatgaagatgtgggagtctgaggagagattgtattcaaatattcaatccatgagacttgatgaaatcacttctcttccaaatgatttacagcctgcagaatcattttc

SEQ ID NO: 116686 - DNA, 601 bp, Human
gcttcaagggtgactccaagacttcggggcagagcacctggaagaaaggggttaatattagccaagatgaggaaggctgtcggtttggcaggtgcatgggcaggttaggagtttagttttgaatatgttggaggtgtttatgaaacttttaagtggagatggaaaataggcagttggatgtgcaagtccagggttcagggagacagttcaggctggagatgaagatgtgggagtctgaggagagattgtattcaaatattcaatccatgagacttgatgaaatcacttctcttccaaatgmtttacagcctgcagaatcattttccctatctttgtaggtttatgtcttcattttgtttcatttatttttcagttattcactgttttagtgagttttgagtaggagccagattggatgcatgcgttcaattcaccatccaacactgtattaactacttgaaactcatgtggttgttcggttgtttttttgaccttttattctggatggaagagagatgcttatgaagttgcagtaatcagtaagccttcccacattgctccatcagccttcctggaagaataatgtcttctgcctttcctg

SEQ ID NO: 116687 - DNA, 601 bp, Human
agaggaagatatatatctgatatgtactggagaggaagatatctatcttatggtctaagttcagggatcctggtatattcagagggcagaaagctcagcaataatcatcaactctgggaacagaggtgacataaacacagggcgtcccctttgtgtgactgcagatagtcatcagtgagctcagagctctatgaaaattacttgctagtttttgggttgaaaatagtgggccagtgtttggttgggggcagtgaggctgtgatggcgggggaccatgccaagctcctaccagcctgggacrctaaaccagcacttccccatttcctgaaaggggaactaaactctgacacaggaaatggtttgcttgcattactttcaggatgagaaaggaagagcactggccttccaaacacaccccgtgcatgaaaactctccctgcatggggtgcatggggaggatggggaagtggaggcaggatcacagactcttgttcgagtgctcagctggggcaccccggtgaccccgaggccttcccttgctaggtccacccagatcaatcaggatcatctccccatctcgaagtttaactttatcacatctc

SEQ ID NO: 116688 - DNA, 601 bp, Human
tttatcacatctcagagttccttttgccacgtaaggtaacatattcacaggttctgagaatccggacatggacatctttgagggtctattgttgtgcctactatatccatgaataataatgataataagcaccattttttgagagtttgccatgtcagatattcttttaaactgtattttatctcgctgcctcctgaaaaaatccttccaggtgtatattgtccccatttttacagatgagagaactgaggcccagaaaggctaaatggcttgcccaagtgtatggtggacccaggttttyaaactcaggtgtgtctggcttcagagactgggctcctgagcccttaagccctttgttcccctttagaaaaagtcacctgaggctgagtggtgaagggatttatccaaagccacccggccactatggcaggacagatatcagaatacaggtcttccgatcccagcccagagccccttcccgtcatctagaactcctcctggtgtcagtaatgataacggcagtcactgatgtcttttgagcacttactttgtgttgagcacttacactgtgctaagcacttgacataggtcatcttagttg

SEQ ID NO: 116689 - DNA, 601 bp, Human
cttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgkgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactgg

SEQ ID NO: 116690 - DNA, 601 bp, Human
gcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgsatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgag

SEQ ID NO: 116691 - DNA, 601 bp, Human
gcagctgctgccttgccttggtgtctgcaaggctctgtagtgagtgttactgggcattgctgttcaggtatgggggagcaccatcaaggctaagtgtgggagcaccgagctgggctctagaagtctgggcccagcttcgcctctgccaccctgctttgcaacactgcccagatcccttcccttctgggccttaatttcaatatgtgatgatgacagccacactttattgactggcctatgtgctgggtctggtgctatgctttccggaatgacctcatctaatctctacaaccaccctggsgggtaggcaggaatgttattatctccattatccttgacttgaggctcagagaagtgaagtaacttgtccaggaaatggcagagctggggttcacaaattgcatcattctgattacaggttttctgcctcccaccagtctatggatacacttcagaggctccctgaaaaccttgaggtcacttgcagaaagttttgtgtagtatgtgtccgtatcaggaacaacaccaaatcagaggtgacttgtgccccatcagagactttaacaccccaaccagatgggaatttcaggacccaagaaat

SEQ ID NO: 116692 - DNA, 601 bp, Human
ttcctgggcctgcctctagtgattcccattcagtaggtttggggtggggcccaggaaatctatatttttcacagacacccctggtgattctgatacaagtggtctcgccctgggagaactactggtctgcagcaaccagcttggttttccattagcaattactgtccttgagcgagttttactgctcttcaccttacacacactaaaactgccaaggccgtaggggaggggaagcaaccatgaggttgctgtgagtgcactgtgtgtgtgtgtgtgtgtgtgtgtgtgtgtgtgtgtgtggatgagagagagagagagattgagaaagagaggaagggaggaagggggagggcacaggctcctctcccacagtgccaacctgcctctctcccacttgaagtgtttccatgccaactgaaatcctcagcctctaggaaaccctatatacacagtgcccctatataggtttctttagactctggctctctcagactctagagtgatggctttaaaagttttttgaatgttacccacaatgattgagaaagagagagagagagcacgcaccaccatgtaaacatggaacctaagtttcacaaaa

SEQ ID NO: 116693 - DNA, 601 bp, Human
gtggggtttggagccaagccgcctaggctcaaagcctttatgtgccgtacaaccttggcaaagtcacttcgcttgtctgtgcctcagtttctttctcacgaatgctcataataatggttcccatttcactggcttgttgtgaggatgaaatagtgttattattgagaagtggtaagggtagtgatcagtgctagcgatcatgattctaggtgacttttactgtgtaccgggtgctcacaaggctttatgtgcacagcctggtgaggctgataatactattgttccctctttttttttttttgagacggagtctcgttctgttgcccaggcagggggtacagtggcacaatctcggctcatgcaagctctgcctcccgggttcacgccattctcctgcctcagcctcccaagtagctgggactacaggcgcctgccaccacgcccggctaatttttttgtatttttggtagcgacagggtttcactgtgttaaccaggatggtctcgatctcctgacctcgtgatccgcccgcctcggcctcccaaagtgctgggattacaggcgtgagccaccgtgcccggcctgttccctcttttataga

SEQ ID NO: 116694 - DNA, 601 bp, Human
aaagcctttatgtgccgtacaaccttggcaaagtcacttcgcttgtctgtgcctcagtttctttctcacgaatgctcataataatggttcccatttcactggcttgttgtgaggatgaaatagtgttattattgagaagtggtaagggtagtgatcagtgctagcgatcatgattctaggtgacttttactgtgtaccgggtgctcacaaggctttatgtgcacagcctggtgaggctgataatactattgttccctctttttttttttttgagacggagtctcgttctgttgcccaggcwgggggtacagtggcacaatctcggctcatgcaagctctgcctcccgggttcacgccattctcctgcctcagcctcccaagtagctgggactacaggcgcctgccaccacgcccggctaatttttttgtatttttggtagcgacagggtttcactgtgttaaccaggatggtctcgatctcctgacctcgtgatccgcccgcctcggcctcccaaagtgctgggattacaggcgtgagccaccgtgcccggcctgttccctcttttatagatgaagagaccagcaaataactagtaagtcg

SEQ ID NO: 116695 - DNA, 601 bp, Human
ttggcattgaggtgagcccaggttttccttattccctggaaactattttttgccccattcctgagtcagtctgatctggtcttggcctggcactgcccacactggctcctgacctcctgattgaatgcagggacagtgtctcattttaagcaggggttctctaatgctgtgatctccccagtaaactctggactagctctgctgaggacttcctgtcttttgacctttagcccgtagggcaagaaagcttttctaggcccctttccttttctgtgtctaagagtgtcacagctttctgggkttactgagttccacgatgcatgttgagctcgtcctggtgggggaggcatacacagttacttgccaccccagctgtggcagcgagttgctgcaacactcccaggaggtcctttcaccactcagagcatgcaaggtttgcagtccatctggttctgcatttctgctactccagtgtctcccagtttcaacaggagtctctctctctcctacctgatgcctttaaattgcccctctagctggccgctgggttggcctggcttctctctccttctctctctctcagatattcttgcctcctgtg

SEQ ID NO: 116696 - DNA, 601 bp, Human
cctttagcccgtagggcaagaaagcttttctaggcccctttccttttctgtgtctaagagtgtcacagctttctgggtttactgagttccacgatgcatgttgagctcgtcctggtgggggaggcatacacagttacttgccaccccagctgtggcagcgagttgctgcaacactcccaggaggtcctttcaccactcagagcatgcaaggtttgcagtccatctggttctgcatttctgctactccagtgtctcccagtttcaacaggagtctctctctctcctacctgatgcctttaarttgcccctctagctggccgctgggttggcctggcttctctctccttctctctctctcagatattcttgcctcctgtgatttgtgaggcagtaaaaaaagacaaagtaaagaattgcttccatctattcttttacctcttgggctgggtttgtggatgggagccgccattttaaaatggcgggccacatagctcagtctcggcaagggctactgagatcagaaccacaggtgccaatttgtacaaaggactcagtcctgctaccactgcctgatccctcagactcacaagcctggaatagg

SEQ ID NO: 116697 - DNA, 601 bp, Human
agactgcccgaggtttgaaccctcattagctgcgtgacctcaggtcagcccaatgtctgtgtgcctccgtttccccttctgtagaatggaggtaataaccctggctacctcacaggctgtagtgatgagcaagcaagttaatccacatgaagggctgcaccgtctggcaggggctttatatagtaagcgagtggctgaaagatgatgggtaaatcacacaagcactcagcttgtttctccttatgtgagtccggtcctccaagcagggattcaatgtgccacccatttattggggaaaagycctaaaaggggaagtggggaagggagctgggggaggctgggaggtgtgtccctgagtgaaggagagagggaaggaaggaaggttgagactgggcaccttggacttcagtgcagtcctaagacatcttggcaaggctgatgaggagttcttgaaccaaattcaccaggcaggggagcctgatgtctcaggcaggggctggcaagtgcagatgcgaggatgttagattttggagcacagcagctggggcccttggctacctccaaggagctgaggctggagacctgaaaggcgagttctcct

SEQ ID NO: 116698 - DNA, 601 bp, Human
attacaggtgtgagccaccgcacccggcccccaagctcagtttgagccacaaatgggactatgttgctctagaaatcaacatcttttccacactgcattagtagcaacagagtctagaacaaaggaggccacagccccactgaactctcttctgcttgaggtcacatctgccacatcaggggtatttacctctttcaacacatatttattagggcacctgtctgggccaggcgttgtgctaaaacccccaaacgctgtcatatgatacaaagtgttctgtaacttgcttggttttttttttgtttgtttgtttgttttgttttgtttttgttgttgtttttttttgcttcgccatatattataggaatttttttaggtcattatgacctctttatttacttaattatctatttatttattttactaatatttacagaaagggtctcactctgtcacccaggctggagtgcagtggttgcaatcatagctcattgtagccttgaactcctgagctcaagtgatcttcctacctcggcctcctgagtagctgggactacaggcacaagccaccatgcctggccgatatttttatgttttgtag

SEQ ID NO: 116699 - DNA, 601 bp, Human
agaggacactcgagtctttctgggtgacttggaaatgtcccttgtcctctcagggttttgatacagtatctgtaaattgaagatattgggctggatcaggtacattttatcttaaggaccaattccaatccattggtagtgggtgcccagtgcaccacattaaaaagaattctaaggctgcacctgggcttaaagaagagcactataatcaattagtgatgtctaaaaaagctaaaaaaaaaaaaaaagagcactgcattcaattagtgatgtctaaaaagggtagaaaaaaaaaaaaaaagaaaaaagaaagagcaccgcaatcaattagtgatgtctgaaatggagcagaccaggagagcaccacgaattttgccctccataggttagctcatctctgaggtctttccctgctctgacatacttttgttccatgattacctccagcctggtggggaacaacattggcagtgtgggtgcccaagccttggcactgatgctggcaaagaacgtcatgctagaagaactctggtgagtttgggggattctctgctctggggaagtggatcacaatctctgttgatcccctggcctcatccat

SEQ ID NO: 116700 - DNA, 601 bp, Human
ggctgctgtgattggctaagacttagctgtttgttataaggatatgttgttaggttgcagtttgctacataggaactcaaagtacagaggcagtctcaggccaaatttagtttaactatatgttaagctgcaggtgacagaatacctccatctatagaggtttaaacaaggaaagggtttattttttcctgtataggcagctggatgtaggcagtgtagggtttgtacagtggctacaagaggccaggaggggtctcagctctgtctcattctcttcctgttccatcatccttagcctgtracttcattcacatggttggttgtctcatgatcacaggatggctgctccaggtgcagcactacttctgtattcccggattcgatctatatacccaggaaagccatctgggttctctcctttaaaaagcattcctggaagccccacctgtcgacttccccttatgtatcaaccatgtgtatgtcacttgaccaacccacttgtatgttgtttgaccagccctggctgcaatggagagtgggaaatacagttttttcaccaagtgcatggctgtccaaatgaaatgagacttccattaataag

SEQ ID NO: 116701 - DNA, 601 bp, Human
ttaaaaagcattcctggaagccccacctgtcgacttccccttatgtatcaaccatgtgtatgtcacttgaccaacccacttgtatgttgtttgaccagccctggctgcaatggagagtgggaaatacagttttttcaccaagtgcatggctgtccaaatgaaatgagacttccattaataaggaagaaaggaaagatggagatcaggaagctgggggatcagggaacttattacattgagagcccttggagtgaattctcttgcaaatatgtccctggaattgagaatccccacaacgtamtttatctgttctttctttatccatgagtttgggttttcagatgttggatttcctatatggggggcatgtgagttcatcatcttccataatcaatgttgtatcaactggattttctctcttcttctcaccagcctggaggagaaccatctccaggatgaaggtgtatgttctctcgcagaaggactgaagaaaaattcaagtttgaaaatcctgaagtaaggaacccataagcaggaaacaggacaataattgctggcctttggaaggggcatttctgaataagatctgggccgctctccg

SEQ ID NO: 116702 - DNA, 601 bp, Human
aaaagcattcctggaagccccacctgtcgacttccccttatgtatcaaccatgtgtatgtcacttgaccaacccacttgtatgttgtttgaccagccctggctgcaatggagagtgggaaatacagttttttcaccaagtgcatggctgtccaaatgaaatgagacttccattaataaggaagaaaggaaagatggagatcaggaagctgggggatcagggaacttattacattgagagcccttggagtgaattctcttgcaaatatgtccctggaattgagaatccccacaacgtactttatctgttctttctttatccatgagtttgggttttcagatgttggatttcctatatggggggcatgtgagttcatcatcttccataatcaatgttgtatcaactggattttctctcttcttctcaccagcctggaggagaaccatctccaggatgaaggtgtatgttctctcgcagaaggactgaagaaaaattcaagtttgaaaatcctgaagtaaggaacccataagcaggaaacaggacaataattgctggcctttggaaggggcatttctgaataagatctgggccgctctccgctg

SEQ ID NO: 116703 - DNA, 601 bp, Human
attgagaatccccacaacgtactttatctgttctttctttatccatgagtttgggttttcagatgttggatttcctatatggggggcatgtgagttcatcatcttccataatcaatgttgtatcaactggattttctctcttcttctcaccagcctggaggagaaccatctccaggatgaaggtgtatgttctctcgcagaaggactgaagaaaaattcaagtttgaaaatcctgaagtaaggaacccataagcaggaaacaggacaataattgctggcctttggaaggggcatttctgawtaagatctgggccgctctccgctgggctaactcatgtgaggtggcctggtagaacagcttgccttggtctaggtggacaaggattccagtgcaagttgtttatctgggaggtggtcccagtaaatgctgataggagagtggtgaagtgagatggggaagtgaaggtaaccaataaaggggagttatcaagccagttatcaatgagggaaattggagctcagtactctggggcactcctggagccagtgcagaacacacatggtcacctacccaaccaatgggcaagaaagccatggcatt

SEQ ID NO: 116704 - DNA, 601 bp, Human
ggagagtggtgaagtgagatggggaagtgaaggtaaccaataaaggggagttatcaagccagttatcaatgagggaaattggagctcagtactctggggcactcctggagccagtgcagaacacacatggtcacctacccaaccaatgggcaagaaagccatggcatttatccaccaaccctctgtccttcctatgttgatgtgcgctcatggggcactgattctccagcacttccagctcaccctcacccagctgaacatgcttctggggtcaggagaatggcctcaggcagagagtggmaggtcttctctgcaagcagtggctggggaggtgatgtgatggggagtactgtggcctcctccagtggctgactcagtggcttgggacttgtgccacaaagagatggacagctcaggtgaacatgaacccacctagtgaccatcatgggtttgtcagggtgctctctgaggctgatgccaaaattcttatttcaagtagacctcaggaaccccatcagatggctccttttgctggaggaaagtggcatctgcctaggcaaatgtggtcctaggaaaacgcttgcctttagagacagacaga

SEQ ID NO: 116705 - DNA, 601 bp, Human
cctaggcaaatgtggtcctaggaaaacgcttgcctttagagacagacagacagacagctgcctctgtgagtgccagctttgctgccaggctgctacccactctggcgacactcatttgtgttgctttcacaagctaggaagtttccaaatatttggagaaaacacttccactaattatttgggtggaaatgggctgggaagttggggtgaagcccggatgtgtctgagccagatgccagctttgcactgagggtcggcctttgggaataccaagcccattatcaaccaggtgtggatatgkcaggtttgtcttccctccttgtcacagccttactccacttgactcccatggatgccaggcaatgaggctggggttggtcccatgccaccctgtcatcagccttatttttcagcatcctaaactatatcatcccccacaaaaattgaacttctgatatatcttttataaaaaagagaaatgcctacatctttcttttccaggcttagtttctgccaagagttggttgagagcccaggcttgctgggtgcagtggctcacacctgtaatcccagcactttgggaggctgaggcgggtggatc

SEQ ID NO: 116706 - DNA, 601 bp, Human
tgtcttccctccttgtcacagccttactccacttgactcccatggatgccaggcaatgaggctggggttggtcccatgccaccctgtcatcagccttatttttcagcatcctaaactatatcatcccccacaaaaattgaacttctgatatatcttttataaaaaagagaaatgcctacatctttcttttccaggcttagtttctgccaagagttggttgagagcccaggcttgctgggtgcagtggctcacacctgtaatcccagcactttgggaggctgaggcgggtggatcacctgargtggggagttccataccagcctgaccaacatggagaaaccccatctctactaaaaatacaaaattagccgggcgtggtggcatacacctgtaatcccatctactcaggaagctgaggcaggagaatcacttgaacctgggaggtggaggttgccatgagccaagatcacaccattgcaccctagactggacaagagagaaacttccatctcaaaaaaaaaaaaaaaaaggatgagaaaaataataatttaaaaaaaagagtccaggctctggaaccagacagcctgggtcttacccctgc

SEQ ID NO: 116707 - DNA, 601 bp, Human
cctgctccaccattaccagccagttcttcttggatgagtgcctcagttgcctcaagtgtaaatggagataatggctggaccttcattataggccatgagcattcactgagagaatgtagctaacaaaagtgagttgtaggttggagcaaaagtaattgtggtttcagaccatgaactttaaattattataactaggctaaaatacatctttattaatcaaaataggaaccattaaaatcaacacatttttgccaataagaaataagtttgtttattcctgtagcataaaaattcatgcttygggattcaacaaactcttggaaagcattttctgcatcctcctggttgtggaagcatttttcctgcagaaagttgtcaagattcttgaagaaatggtagtcagttggctagaggtcaggtaaatatggcggatgaggcaaaacttcatagtccaattcattcaacttttgaagctttggttgtgtgacatgcagtcgggtgttgtcgtggagaattggaccctttctgttgacgaatgccggctgcaggtgttgcagttttcagtgcatctcattgacttgccgagcatacttctcatatg

SEQ ID NO: 116708 - DNA, 601 bp, Human
gttaaagctactctaactgagagagttctactagtgcagttagcacagcagaataaagaaggcctttctgacagctggctgcgcccacccacagcctgggcttccactaacaatgatctgcttgttaatctcgcagcgctggaggccccaagtcttcatgaaatgcacaaagctggtgtgggaagaagctgggatttgaaatccacagccgtggatgtcaccccggatgtgcggtgtggccctgggctggctatttaacctctctgagcccatgaaacagggctggcaaaacagtctcacrtgagttaaatgaggaattgtaaggctgtgaaagttcacatgctacttttcattctaaaaacaggtacaaacactttttgattggcttttagaatccatttctaggttttacatgtgtataagacatgtggagatgttcctgtcacctccgaactaggccacagctgggagggcctggggccaacagtgcccaggtccaggttcaccctctgaggggagcagcacaggctttctactcctgcccctctaccaatcacacaacaaccctgaggacagatcaccaggcacctcattttacaag

SEQ ID NO: 116709 - DNA, 601 bp, Human
ctcccagtgcaggctctgaacatcaggacgcaggcttggcttcctaaagcacctgctctgcacggagacctgagccatggtgggaggcctatgagagccccgccccctgggtcccacaggctgccatcaagagttgggccctacgggcaccagacctggctattcaggagtcagatgaagctgataggagaggtggagccggcaggagcaggtgtgggagcctgcgtgtgggcggtgacaccacagtgaccctgctattagatcccgtggtggcctctgcccacatgactgtaatctcagmtactcgggaggctgaggcaggagaagggccaccaacctccaggggcctccaaacatggagagcatcctggtatgtgtctaatccatgcccccccaccgccccacccagcctcagtaattaccagttaaagctactctaactgagagagttctactagtgcagttagcacagcagaataaagaaggcctttctgacagctggctgcgcccacccacagcctgggcttccactaacaatgatctgcttgttaatctcgcagcgctggaggccccaagtcttcatgaaatgcacaaagctggt

SEQ ID NO: 116710 - DNA, 601 bp, Human
ccccagccctggcctcccagtgcaggctctgaacatcaggacgcaggcttggcttcctaaagcacctgctctgcacggagacctgagccatggtgggaggcctatgagagccccgccccctgggtcccacaggctgccatcaagagttgggccctacgggcaccagacctggctattcaggagtcagatgaagctgataggagaggtggagccggcaggagcaggtgtgggagcctgcgtgtgggcggtgacaccacagtgaccctgctattagatcccgtggtggcctctgcccacatgmctgtaatctcagctactcgggaggctgaggcaggagaagggccaccaacctccaggggcctccaaacatggagagcatcctggtatgtgtctaatccatgcccccccaccgccccacccagcctcagtaattaccagttaaagctactctaactgagagagttctactagtgcagttagcacagcagaataaagaaggcctttctgacagctggctgcgcccacccacagcctgggcttccactaacaatgatctgcttgttaatctcgcagcgctggaggccccaagtcttcatgaaat

SEQ ID NO: 116711 - DNA, 601 bp, Human
cctgcctcccagctcagggctctcccctccctgagcacagagagaccagggacagaatccaaccgctccatcactgtcctgcccaagagagcccaggtctacaggctgatatggatgacaggccaggcagggccccggctctgaccccagccctggcctcccagtgcaggctctgaacatcaggacgcaggcttggcttcctaaagcacctgctctgcacggagacctgagccatggtgggaggcctatgagagccccgccccctgggtcccacaggctgccatcaagagttgggccctasgggcaccagacctggctattcaggagtcagatgaagctgataggagaggtggagccggcaggagcaggtgtgggagcctgcgtgtgggcggtgacaccacagtgaccctgctattagatcccgtggtggcctctgcccacatgactgtaatctcagctactcgggaggctgaggcaggagaagggccaccaacctccaggggcctccaaacatggagagcatcctggtatgtgtctaatccatgcccccccaccgccccacccagcctcagtaattaccagttaaagctactctaactga

SEQ ID NO: 116712 - DNA, 601 bp, Human
ataatccgcaggcccttccctcataatacagccacttattgagcagtgccagacactcgctaagttttgtttttgtttttgtttttttttgagatggcatttcgctcctgttgctcaggctggagtgcaatggcgcgatctcggctcactgcaacctccacctcttggattcaagcaattctcctgcctcagcctcccaagtagctgggattacaggcgcccgccaccacagccggctaatttttgtatttttagtagagacggggtttcaccatgttgtccaggcttgtctttaactccygacctcaggtgatccgcccccgcttggcctcccaaagtgctgggattacagacgtgagcttccgtgcctggccagacacttgctaggtttttatgtgccttaacctatttaatcattgtattatgatacaggcattattattattatttagacagagtcttgctctgtctcccaggcaacctccatctcccaggttccagcaattctctcgcctcagccgcctgagtagttaggactacagtcccgcgccaccatgcctggctaattttttttgcatttttagtagagacaaggtttcac

SEQ ID NO: 116713 - DNA, 601 bp, Human
tccctaagtaaatgactgggggatggggcataatccgcaggcccttccctcataatacagccacttattgagcagtgccagacactcgctaagttttgtttttgtttttgtttttttttgagatggcatttcgctcctgttgctcaggctggagtgcaatggcgcgatctcggctcactgcaacctccacctcttggattcaagcaattctcctgcctcagcctcccaagtagctgggattacaggcgcccgccaccacagccggctaatttttgtatttttagtagagacggggtttcaycatgttgtccaggcttgtctttaactcctgacctcaggtgatccgcccccgcttggcctcccaaagtgctgggattacagacgtgagcttccgtgcctggccagacacttgctaggtttttatgtgccttaacctatttaatcattgtattatgatacaggcattattattattatttagacagagtcttgctctgtctcccaggcaacctccatctcccaggttccagcaattctctcgcctcagccgcctgagtagttaggactacagtcccgcgccaccatgcctggctaatttttt

SEQ ID NO: 116714 - DNA, 601 bp, Human
acaggaagaggaacagcacacagtaggtttgcagcagtgcttgctaaggagtgttcatagactgctcttaaagccctgaatgagtcaactttctccacacccaggtcttgcagccatcaacttccccagaaccctgatgtgtgcagggtccaggactgttcagaaggaacggctgctactcaagatagagccagcagttaaaggaaatcaccaacttttgcttctggtcttgccactaaccagctggccttgggctaaaaacaaataaagctgacatttattgagcactgaccagccactyttttcataattttacacagattaactcatttaatactcctaatcatctaatgaggtagctctcccattttacagatgaggaaactgaggctcagagcattaaataaattagaccataatcgtgtaaattgtatcttaggttaggctctctgggcaacagacactgggtcggaaagtttactgggaaaactggaaagtttactgctttttgtagtgaatgaagggagcaagttttggatgcacccacaacaaaggcctcagacaactgagaccacactgggagctctgggggctggtggcc

SEQ ID NO: 116715 - DNA, 601 bp, Human
aaggatcttgtcggtcttctgaactgttgaaccctcacacccatgtttgccaggtgggtgaatggacatttcttccatttggggatcatttatattgagttgtctttgggcttctctttctcagtaaatgagcagactttgggttgggctggggctatacttttattagcccccaagataaacaggaagaggaacagcacacagtaggtttgcagcagtgcttgctaaggagtgttcatagactgctcttaaagccctgaatgagtcaactttctccacacccaggtcttgcagccatcarcttccccagaaccctgatgtgtgcagggtccaggactgttcagaaggaacggctgctactcaagatagagccagcagttaaaggaaatcaccaacttttgcttctggtcttgccactaaccagctggccttgggctaaaaacaaataaagctgacatttattgagcactgaccagccactcttttcataattttacacagattaactcatttaatactcctaatcatctaatgaggtagctctcccattttacagatgaggaaactgaggctcagagcattaaataaattagaccataat

SEQ ID NO: 116716 - DNA, 601 bp, Human
gtcacagtcaactgtcagctagggctgcagtctctgaagacttagctggggctgacggatccacttccacgcgctgtctttagctgctcaccatgtggccctctccatagggctgctcacctcatggcctcccccagaacgaggcatccgagagatggaagccatggtcttttatagactaatcctggcagggacctatcaccactagtgtcatattctattggtcacacagaccagcactggcacagtgttggaggggacacagaactctgtgcatctcaggaagtgggaccatcgaggsccatggtgaaggcggcaccatgacaacactgtgggggacattattcatcccaggttatagatgagagcactaaagatcccagaagttaactgatttgcacaaggccacaactggaagcatccaaggtgggatttgggtcaaagtctgtctggactccaaagtctacattcacttctcctaatccacgacctctccaagctgcagatatgtcaagggagcaccaagcggtgcagttgactagaacgctgaactctgaatgccaggctggggaaacgtgaattccattctggcttgaaggga

SEQ ID NO: 116717 - DNA, 601 bp, Human; identical to SEQ ID NO: 82224

SEQ ID NO: 116718 - DNA, 601 bp, Human; identical to SEQ ID NO: 82223

SEQ ID NO: 116719 - DNA, 601 bp, Human; identical to SEQ ID NO: 82222

SEQ ID NO: 116720 - DNA, 601 bp, Human
aggagatctgtggagataagaaaatggtcagtgccagattaagatcagggacctgaagccccagagctcagaagggatcccgtccccaacttgactcactttgtcatcaatgccaaatagggtcaggtactcaaagagcaacttcaggtctcccaggccctccaaggcctgcttgttttgggatagtttaggatcctggagcagctgttccaccagggataccccacctggggagacagacttgtgagtgaggctgacaaggaaacaaaaaaggtaaggagggttgaccttcttgcctggmctctagtcgcccatgcatgtgtgtgtacatatgcatagacacactcactcccctacatacataacacagaacagtttcaactttaggactgagggcagtgggacggctgctggggaggcttggttctgttcctcaccatgttgctggacatagtccccaatgcggtcagccacctcaggtgcaaggcccttctctcccaccatctcattcttcacctcttcccaggacacctaggcagacagacaccagtcagggacccctgggcagcttccgcaccacagagcaagtgtgtactgtcct

SEQ ID NO: 116721 - DNA, 601 bp, Human
cttgggcataaaggtagcttttagtagatatgaggactgaactgactgacttgtacataggacgtatcagaataaataacttagggcaagagtaaaggtagcttttttacagtaacttcaagcttatctccatgtagtaccttttttttttttttgagacagggtctctgtcatccaggctgaagtgccgtggtgtgatcactgcagcttcgacctcccaagctcaagtgatcctcccacctcagcctcctgactacaggcacacaccaccatactcagctaatttaaaaaaaaaaaaaaatttttttttttaatctgtagagacagggtctcatcatgttgcccaggctggtccatgtagtaccttaagggtccaccaaagcattcacacagaagtactactatgagcccaccccaattagatcacccttgacagttttagtccccacttactatctacccatttatgacactgtgcctctcacacttcagttacagggcacaggcgtgtatatgggtgtggggaaaggagaatgctgctgctgcttcccttgtctttttcaggaaaactattttcatagttcttagaatgtaagatgcc

SEQ ID NO: 116722 - DNA, 601 bp, Human
atgcggctgagctcggtggctcatgtctgtaatcccagcactttgggaggctgaagcggttggatcacgaggtcaggagttcaagagcagcctggccaacatggtgaaaccccatctctactaaaaatacaaaaattagctgggcgtggtggtggcgcgcctgtagtcccagctactcgggaggctaaggcaggagaattgcttgaaccaggaggcagagattgcagtgagccgtgattgtgccactgtactccagcctgggcaacagaccgagactctgtctcaaaaaaaaaaaaaaaaatccatatacagtgaggaagcttgtgtggtgaagacctgacctcatatatattacacgtgtaattgtaaatacaacatagattctttggggtgggactgagattgggatagatgaaatggtgctttggcttcctgttgctcagggtgaagagtctttgcaggttggtggtcaacagggtcagagatgccacaggtctggccagtgtccagagaagccacatctcacattcattcttctgccaggttgcagaggcagtgttaacatcccaactgaaagcacatcaagagaaaccaaatttta

SEQ ID NO: 116723 - DNA, 601 bp, Human
ggctgggtgcagtggctcacgcctgtaatcctagtactttgggaggccgaggcaggtaaatcacttgaggtcaggagttcgagaccagcctggccaacatggtgaaatcctgtctctactaaaaatacaaaaattagccaggcgtggtggcgggcgcctgtaatctcagatactcgggaggctgaggcaggagaattgcaggaacccgggaggcggaggctgcagcgacccgagattgcgccactgcactccagcctgggcgacagggcaagactccgtctcaaaaaaaaaaaaaaaaaaaggaagaagaagcagtgttagagagtcagaggaattccgagttccaagtgacaagcagaggcccctggcttgaatctggggtcggttattactgctaacccgaaccaaaccccttccctcaggagacgtctcttttctaagctccctatgtccagggaccccgacctcgcctgactccaagtgcctgatgacaagaaaacgtcaacttctcagaaaagctcttcctctaagaccccactgtcctctgcaggatggagccacaaggtgctcgccgaccggttgccgggcaacacgggctggg

SEQ ID NO: 116724 - DNA, 601 bp, Human
ctcagaaggctgaggtgggagaattgcttgagcccatgaggtcaaggctgcagtaagccatgatcatgccactgcactccagcctgggtgacagagcaagactctgtctcagaaaacaaaaacaaaaagaaagaaaaccatctgcattttcaggaacttatcctcaggaaataatcagggaagtggtcaaagagatacagttattacactatgaactgtaatacagaaacaatggaaataacataaatgttcaacaacatggaacggttaaacaaattacattaacacaatgaaatactayagaaccaataagaatgacataacgggtatgtagtaacttcatataaagatgttcacaacatattattgaatgaaagagccacacataatagccagggagtggaatgtccattaactgataaatggataaataaaatgtggtatatacatacaatggaatattattcagccataaaagtgaattactgacacatgctacaacatggatcaaccttgaaaatatcatgctaagaaaaagaaggcagtcacaaatgattacatattatataattccattgtttatgaaatgtctagaatatgc

SEQ ID NO: 116725 - DNA, 601 bp, Human
tggaatatactatttttgttgcttagcaacaacaacaaaagactacttttatatgcaacaatatggataattcttacaagtattatgttaagtgaaagaagccagacactatttgtatggagttcaacaacaggaaaagctaatctaagctgacagaagtcagaacagtgattgtctatgggagatagaaattgactggaatggggtacaacaatattttctgaggtgatgaaaatgttctctatttttattggggtattggttatagggatccaaactcattgaactgtacacagaagggctgtgcattttcatgtatgtacattttacctcaacaaaaaatagacaaagaagaaaaccagccaaatgcagtggctcacatctataattacaacactttgggaagctgaggcaggaagactgctttagcccaggagtttgagaccagcctggccaacatagtgagaccctatctctctaaaaaataaacaattagctgggtgtggtagtacacacctgtagtcccagctactcagaaggctgaggtgggagaattgcttgagcccatgaggtcaaggctgcagtaagccatgatcatgcc

SEQ ID NO: 116726 - DNA, 601 bp, Human
acaaaaattacccaggcgtggtggtgcgtgcctgtagtcccagctactcaggaggctgaggcatgcgaatcacttgaacttgggaggtggagcttgcagtaagccgagatcgcaccaccgcactccagcctgggtgatggagtaaaactctgcctcaaaacaaacaaacaaacaaacaaaaaaccagaacaccattttcctcatctatagaaataataataatttatcttcctattagggttgttgtaaggattcaatatgttacttcatataaagtacttagagcactacctggcatacrataggtacataataaatgattgccattattattatttgcatgtattaactcattaaaagaaatgcctttatgtattcaactatatgcaataatttttctctatttaatcagtcttttcaaaatatatcttaattaggatttttattgcttttcttaccataacatacagctctgtctgaccccctccccaagcttttatcctaaaaccacctgggtttggagatgccccagcactctcacttgatgtttcatctgacagtactgatctatcttgctcaaggttaccatagttcgaggtgg

SEQ ID NO: 116727 - DNA, 601 bp, Human
tgcaaacccctttaagaatgtaatgaaggctccgggccctctcttcagaaagcacatataagcacatacacacaaaacagactcccgggccaggcatggtggctcatgcctgtaatcccaacactttgggaggctgaggcgggtggatcacctgaggtcaggagttcaagaccagtctggccaacatgacgaaaccccatctctactaaaaatacaaaaattagctgggcgcggtggcaggtgcctgtaatcccagctactcgggaggctgaggcaggagaatcacttgaacctgggaggyggaggttgcagtgagccaagatcacgccactgcactccagcatgggcgacaagagcgaaactccatctcaaaaaaataataaaataaaaaacagactccctgtataaacacacatcctcagactgctccttttggcacccatttctcctcttcatttcttctctgtccacaactatcatcttacatcatgataactgtgaatatataaaaagtatagtaggactaaataaaaactgatgactcttgctataggataacttagttaaaatcattggtagcactgtatgtcaatgtgtaggt

SEQ ID NO: 116728 - DNA, 601 bp, Human
ctcatcagacgagcatcctcagctccgaccagcaaacttcggatcaaattagaatgatcagccatatcagcactgagcttctgatgcactgaatgatattcatccacctggagaccatgaacactcaggaatgaaaaaggcctcacaaacttcttgaacccagacaaatgaaaagacactatttaccagatacagagacccccttctttcccctgttcgcttataccaattaagctacttcccgttatttcatctctgtctcaacaagttaactcatctgtgctgcctccaatttcaacasgacactccatgtgaatcttccccatgctttagcaccaggagcccccacaacacacatattaatattttagggatttgcagtgggaatattgtatactttggggccaatcagaatcatctttattttgctcttttatcttgaatttgggtttttggaaagacccaaactgaagaagaccaaagcagatactacaaataagatgaagagctaacaaaggaaaatgttaatatttaaatgcatcactttaaaccaaacaaagcaagcatggtgctcaggagctaaacacttccttttataaaa

SEQ ID NO: 116729 - DNA, 601 bp, Human
gcctaaagaagatgcaggccaacaatgccaaggccatgagtgcacgtgccgaggctatcaaggccctcgtaaagcccaaggaggttaagcccaagatcccaaagggagtcagctgcaagctcgatcgacatgcctacgttgcccaccccaagcttgggaagcgtgctcttgcccgtattgccaaggggctcaggctgtgccggccaaaggccaaggccaaggccaaggatcaaaccaaggcccaggctgcagctccagcttcagttccagctcaggctcccaaaggtacccaggcccctamaaaggcttcagagtagatatctctgccaacatgaggacagaaggactggtgcgaccccccacccccacccctgggctaccatctgcatggggctggggtcctcctgtgctatttgtacaaataaacctgaggcaggaaaaaaaaaaaaaagaaatacctaaaatcagagcagaactgaaggaaatagagacccaaaaaaacccttcagaaaattaatgaatccaggagctggttttttgaaaggatcaacaaaattgatagaccactagcaagactaataaagaagaaaagagagaagaa

SEQ ID NO: 116730 - DNA, 601 bp, Human
gttgcccaccccaagcttgggaagcgtgctcttgcccgtattgccaaggggctcaggctgtgccggccaaaggccaaggccaaggccaaggatcaaaccaaggcccaggctgcagctccagcttcagttccagctcaggctcccaaaggtacccaggcccctacaaaggcttcagagtagatatctctgccaacatgaggacagaaggactggtgcgaccccccacccccacccctgggctaccatctgcatggggctggggtcctcctgtgctatttgtacaaataaacctgaggcaggaaaaaaaaaaaaaagaaatacctaaaatcagagcagaactgaaggaaatagagacccaaaaaaacccttcagaaaattaatgaatccaggagctggttttttgaaaggatcaacaaaattgatagaccactagcaagactaataaagaagaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcg

SEQ ID NO: 116731 - DNA, 601 bp, Human
gtttttctattctgtcccactggtctcctggacttttcctttaccagggccctactgacttggtggtcccggtactaaagtcaatttcatgatgtcactttgtgcctcggcagggctttctttttcgggggtttcctggtggcgcttgcagccttgcttttcccagtgaacgttgccatcaccttatccagccccgggaagaaactcgaaggccgcgggtgaataaactgggggagactgacatctcggtggtctccaggagcatggtgtgtgtgtttatgggcagcattttatggtttcrttatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgcctgccaggagggcagattgctgcttgggtctgtccagagctgggggtggtacctgcgg

SEQ ID NO: 116732 - DNA, 601 bp, Human
tcggtggtctccaggagcatggtgtgtgtgtttatgggcagcattttatggtttcgttatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgcctkccaggagggcagattgctgcttgggtctgtccagagctgggggtggtacctgcggccagcggggccctcctggcttctgtgggcgggccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtac

SEQ ID NO: 116733 - DNA, 601 bp, Human
ccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtactctcatgctttgttcagacttttgcactgccctgtgaagtggggtgtgtgtgtcatcttgtggtgccatcttggttggggtgaggccrtccttcccccacagggcgatgtccaatacccttggcagcatgggcctcatgttttatggggtccccaaggtacctgcccaggatccccaagtcctcctcacccaccacagacctggctctcagatgagcacccagccaagtctctggccatgtctagcaggaggatgttctgccccggccaactgacagggttggctcaactgcaggagtgggcacggcatgtcctttgctggttctgccatggggcgggtctgtggggggtccctgacctggtagttgtccctggagggcctggggcca

SEQ ID NO: 116734 - DNA, 601 bp, Human
tctgcagctcgagaattagacgtgccctgggctccacatgcccgtctgcagctcgagaattagacgtgccctgggcttcatgtgcccgtctgcagccctagaatcaccagcagcaccccaaggcccccatgcggcatctaaaccaggcaggggacaggggcatggagcagaccaggtagggttgctccctaggatgcagccctgcccaggcaggagggcagaccctacacagtgctgagctgtgcccccagggaagcctccaagatggtcctcatcccagcagccctgcccactgtctgcrcatccctggggtctgtgcgccacctggtggctatttgctgaactgtggccacaaacccctggtcagcaggaaccggccctttcactgccctgcagctccctctcctccggggtggcatggcagagaagcagcccgtggccccaagcatagagccccctttctgctgtagtcccccttgcagtcccctctgccttttccactgcttggaaggcagagagaccctggccgcctcccttgtccctttatctgtcatgccagctgcctccctgccacaccttgcgtctcaccaggcaaccctgc

SEQ ID NO: 116735 - DNA, 601 bp, Human
acttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcrgcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcac

SEQ ID NO: 116736 - DNA, 601 bp, Human
gccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaayaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcg

SEQ ID NO: 116737 - DNA, 601 bp, Human
gagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctgtttcttgccgargccagctgctgctagaaactggccccctgctctctgcagtaagagaccctgccctggcccaggtgagggcctggcttttgtctccaggatcacagcttttgtcaaactccacacaaagagagaggcactcaaaagcacaacacaaacacggctagtccgcgcctttggtggtgaacataccagggaattgtcctgcaatgcctgtggttaaaaaaccccgtgagctgcggccccggaggcctaggggatgaggtcatcgctgcggcttcctcccctctgctgaggctccctccgccccgc

SEQ ID NO: 116738 - DNA, 601 bp, Human
ctaagaccggtccccaccacccaggccactctgaggcttcagaacgcggtcgtcttctccctggcagggttgtttccgcctgcatttgttcagccagcaaatctttattaagcacctactgtgtgccaggatctatgtgcaagcagcccatgggctcatgaaaggcagagctggactgagattccgcacccctgggatcctcactgcagggccctgtgtatgtgcgggctggagccctggttcctgtctgcactgagcccctggagctaggcccagaggacttgacagatgtgggccctcygtctgcacagcccccagggcacggggtggcctgcagctctgcccagccagacttcaggtcactgccccatgagcctgtaggagaaacttctcactcatctgtcctgagacctgcctggagcccaccccagggagacagaggctctcggagcctgttcagggtgaaaggacgctagacactggcctgcaggctttgggcgggtaagggtagcgaaggtgaaagtggaccaggggcaggtggagcagggtaggcccaagtgtctgtctggggcagctggggacacccaggtgggctgaactt

SEQ ID NO: 116739 - DNA, 601 bp, Human
gcaccctctgccaggtcagcagtggctttcatcttctgccatttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatrgggttttgccatgttacctaggctggtcttaaactcctgagttcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggct

SEQ ID NO: 116740 - DNA, 601 bp, Human
ttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatagggttttgccatgttacctaggctggtcttaaactcctgagytcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggctggttttttctcattgcacatggctgtcacgcggtttcagctt

SEQ ID NO: 116741 - DNA, 601 bp, Human
aagatggggtggggtggggggcagtgaggggcctggggcaggaggtagaggaaactgcaagattttttaaaccttctccaaaaacacgtaacccgattctgtccaagcgatttgtgagaatggggttgacacccctgggctggaacctgggaaccaccagtcagcgtctttcctccagggaggctgtgcagagggaaggcagtgagccccacctgggtttgaggaacctggggcttcaagggaggcggtctcagcccatggtgctccggccaggggtggggcagccgaggcatgagtggaygatgtcccgtcggcagcccgtggtccctctggggggcaaggtgcctgttccccattgctcctccaccagaacacctcctccagatctccgccaggtgcgccccctgaaggaaaaggggatgggggcctggctcgtgcctggtggcaagtcctcttgggccccagaaagaccccataatggccaggtagaagctcctacctgctgctgcctgaagagtctggggccctgtcggctggttccatcgtcttccctgttttcaagctacaggagcgcaatctttccagagcattgagtggctag

SEQ ID NO: 116742 - DNA, 601 bp, Human
acaggcacacacgcacagacatatgtgcacggatgggcgtgtggacgtatgcacacataggtacccatgtggacacactcacgtgtgtgtgcacgttcaggctcagacacgtgcctgcatgcacacgtgcacacgtgcacacccagccctggacctcaggcaggcagggagagagacccccttggggccgcgttccatttgcacatttaatccagaaactgtcagcatgggaagcctggatgagaacaaaatgtcaagtgtgtgccgagaggcgcaggccagccccttttcctggcggggygatgatctggtcagtttccgagcaccatgtgctgagaatgatgcgtgcattcagagcagcatttggtggggaacctgggggaagggcgggcgtctttatttcattttagctttctttagcggggcctgtgtctcttctcactgaccgttttctgaaactggctggggagggtcagggatggctgctgtcctcgggggagggactgagctgggcccttttcgttggttagttctcagtgtggcctacccagccaggtccctggacctggcggtggctatgaaagcctgggattgaggacaa

SEQ ID NO: 116743 - DNA, 601 bp, Human
atagatatttgttttacacatgtattctctagtcggtggctttccttttcatttatttagtagtatcttttttttttgtttgagactgggtcatgcactgtgctcaggctggagtgcagtggcgtaaacgtagctcactgcaacctcgaattcctgggctccgaggatcctcccacctcagcctcccaagtagctgggactataggcatgtgccaccacaggtgctaactttttaaagttcttgtacagacagggtctcactttgttgcccaggctggtgtcaaactcctggcctcaagcratccccttgcctcggcctcccaaagcgctggaattacaggtgtgagccactgctccaggcccaatagtatcttttaaagaccaaacattttcaattttatgaagtcaaatatagctttttccttttaaatatgtttcatgcttttcacattctatttaggaaatgcttaccaaacacactcttactaagattttctgctagtagttttataatttttgtgcttacctttaggcctaggatgcattttgagttaatttttctctatcatgtaagacataggcggagattcatgtgtttttt

SEQ ID NO: 116744 - DNA, 601 bp, Human
tcatattttttatgctatggtcaatggtatttcttctaatctagaactgaaattcattttgacaaatttatcttgaatcttgcaacctttctaaactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagrcacacatcattgttcaccgtcaagggtgatgttggctctgggtttccatagatgtctttaccaggttaaggaaacgtcccctctaatactattgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcattggacttgacttgttaaa

SEQ ID NO: 116745 - DNA, 601 bp, Human
aactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagacacacatcattgttcaccgtcaagggtgatgttggctctgggtttccatagatgtctttaccaggttaaggaaacgtcccctctaatactatwgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcattggacttgacttgttaaaattttgctaacaacctttgcatctaggttcatgagggatattgtctatatattttcttgtaacgtctttggctttggtattagagtaatgctg

SEQ ID NO: 116746 - DNA, 601 bp, Human
tgtccccagccttagaagacacacatcattgttcaccgtcaagggtgatgttggctctgggtttccatagatgtctttaccaggttaaggaaacgtcccctctaatactattgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcaytggacttgacttgttaaaattttgctaacaacctttgcatctaggttcatgagggatattgtctatatattttcttgtaacgtctttggctttggtattagagtaatgctggcatgaggagtgagttgggaagtgttctctctcccttttagaggtggagtttgtgtagaattggtcttatttcttccctctgtgtttggtggactccatcaggaaagttgtttaggtaggcctggactttgcttgatgagaagattgttaactagattttaaattgacttaatagttttattcaggtga

SEQ ID NO: 116747 - DNA, 601 bp, Human
cttcttgagtgggctttggtattttgtgtatttgaaagaatatgttcatttcatctgggtgttaattgtattggcataaagtttttcagaatatcctgttactatcctttaaacagctatagaatttgtagcaatgtctcttctctcattcctgatactagtaatttgtgcctctttctttgttagtgtaatcagtcagctaaagttttagcaaatttatggatctcaaagaatcagcttttggtttcattattttttttctttttggttatttgattaattttaattattttattctgcytacttagttttaatttgttcttttttttctcgtttcttaaggtggaagctgaggtcattgaatagaaatttttttttcctttctaatacaggcacttggtggtataaacatccacaaattttgtgtttttttatcccatttaaaatattttctaatttcctttttaacttcttctctggtgtatgcattatttaaaagtgtattcaaaacatttagggattttcaagatacctttctgttactgatgtctaatttatttatggctatagaaacacttaatataatttggtctcttaaaat

SEQ ID NO: 116748 - DNA, 601 bp, Human
acttgatttagggcccagaatatgatttatcttggtaaatactccattgtgtgcttggaaagagtgtgtactgctgttgttgggaggactgttctataaatgtcaatgagactaatgtggttgatgatggcattgtccaagtctacatcagtaatgatacatccttactgattttgtatctacttgttctattaattcattcttgggagaaggatgttagaatctccaactgtatttgtggatttctctctttattcttcagttctttattctttattagttttttgtttaatgtattttwttttttgcttttgtcatttaaaaaattatttacattctttatttttcatttttgtggatacacaatagttgtacatatttatggagtacatatgatatttcaatacaagtataccatgtgttcaatgtgttttgaagcttcgttcttgggtgcattagcatttaggattgttatgtcctcttgagaagtcaacacatttgtcattatgaaactgcctctttatccctggccactttctttgctctgaaatctgctttgtctgagattaatatggctattctggctttttctttttatcat

SEQ ID NO: 116749 - DNA, 601 bp, Human
atctcccagggtttaagtgattttcgtgcctcagcctcccaagtagctgggattataggtgggcgccaccacacctggctaattttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttacwgtctggcttaccgtttttattaatctgccttaacttctacttagtgcctataccacaaacaataagctgactccatttccatcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtg

SEQ ID NO: 116750 - DNA, 601 bp, Human
attttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttacagtctggcttaccgtttttattaatctgccttaacttctacttagtgcctataccacaaacaataagctgactccatttccrtcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtgcctggcgcgggtggagggagctgtgaggagcctgtagcattcagagacaggggagcagggagcggtgggggatgaggtcag

SEQ ID NO: 116751 - DNA, 601 bp, Human
gtttcataggtgcgtgtggggctgttggatacagtgacccacttcaaggtgacatcttcttcttgcatctcagatagcaccaggtttgtgtgtttatgcgtgtgcacacacggtgttgggctctggcggtggcctgggggtgcttaggctgtgcacaaatgcccacgcacgtacacacacagacacacagcctgacttggcccaggtgggtgggtgtctgaggagaagttcgccattgtcgactttggggtaaagtgaggacctgtctggcgggaataaaggggccctactgtcccccgamtaccactgccccagccctcctgagcccctgtgactgaaaaatcctcactttggaggatgtttggtgacaggtgctggggcccggacacgacctggtttcttcatcccaggggctgtctccagggtgggttctagagtacatccagcttccacccaagggagagtggctgggtggagagggggcaggctgagatctgagaagccaggctagggggttgtggagcaaatgatgatgtctcaaccatgtggctttaggtccccagcacgtgctagtggccatcagcaggctacagcatccagc

SEQ ID NO: 116752 - DNA, 601 bp, Human
ctgcaaaagcagagggagtggagtgtcaccgggtgtcccggcgtgggcaggtcctgttgtggagcctcgtgacctgctcatagcacagctgggacacttccagtgactgctcttcgaggcccggggtaggggggtgggggggcctcctcctcccaagcacctggggtgggaacaagaggcgttttgtgttctgcgtgggtggccctgggctccccaggcctggtgtgggggtgcctggggggcagtggacgtgagcagcagcacgtggcccccagtcatgagtaccccaggcccctatgcrcctccttccccatgactggccctgggtggcggagagacccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcag

SEQ ID NO: 116753 - DNA, 601 bp, Human
ccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagcygccgagccccggcctggatggacatcccgcaggcagtgcacgtccctcccccgcctctctttgccgttgccgggactgggccgtgtgcctggagtttgaactttcctgatcacggggtgagagggtctttgcagttgcagagccgtggcgtggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagac

SEQ ID NO: 116754 - DNA, 601 bp, Human
gagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagccgccgagccccggcctggatggacatcccgcaggcagtgcacgtccctcccccgcctctctttgccgttgccgggactgggccgtgtgcctggagtttgaactttyctgatcacggggtgagagggtctttgcagttgcagagccgtggcgtggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcct

SEQ ID NO: 116755 - DNA, 601 bp, Human
gaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagccgccgagccccggcctggatggacatcccgcaggcagtgcacgtccctcccccgcctctctttgccgttgccgggactgggccgtgtgcctggagtttgaactttcctgatcacggggtgagagggtctttgcagttgcagagccgtggcgyggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcctaggccagagtgccaggcagggtaggggaacaaatgccaacacgtga

SEQ ID NO: 116756 - DNA, 601 bp, Human
tgcatcctcgcctaggccagagtgccaggcagggtaggggaacaaatgccaacacgtgagctgagtgaccggaagagggggcgcctccctgagcaggtgaatgaagggtgctggggtggcgagttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggcggtagcaggaggcaggggaggctgtgctgagctcagtgggtttggtggggtcatagctgcctctccctctaaatagattaactaaaaagtattgttgactgactcatgcatttcttaggttttcttattttctaatttcttcttttaaatttaggtttgtcgaggtttaagttacata

SEQ ID NO: 116757 - DNA, 601 bp, Human
gttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggyggtagcaggaggcaggggaggctgtgctgagctcagtgggtttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggta

SEQ ID NO: 116758 - DNA, 601 bp, Human
caggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggcggtagcaggaggcaggggaggctgtgctgagctcagtgggyttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggtacccactggcggctagcccctccccgcacctgggaaccgtgg

SEQ ID NO: 116759 - DNA, 601 bp, Human
atattcgcctaatccaagattacaaagttttttctcctgttttctgtagaaattttatagtttcacatttcttgtttagatctgtgattcatttcgagtttaattttatatatggtgacaggtatggatggaggttaaatctttctgcatgtggttatccagttgtcccagagacttttttcccattgaattactttggcacctttgatgaaaatcagttggccgtgtgtgtgggttcgatttctggactttgtcatctgttctgccaggaaagcactgtcttgattactgtgacttttaygctaagccttgaaatcaggtcctgttaatcctccaattttgttcattttcaagagtgagctgttctgccagctccttcacattctcatgaatatcttagaatcagctcgtcaattctaccaaaaaaaaaattggctagaattttgattggcattgcattggatatgtagataaatttggatctcatacacgtcttagtaataccgagttttctgatccacgaacacggtctctctccccagtgcctcatgcacgtcttagtaataccgagttttccgatccacgaacacggtctcgctcc

SEQ ID NO: 116760 - DNA, 601 bp, Human
gtggggagagggctgctatccttatcttactcctaaggtgaagtgaggtaatctttcaccattaggtgtggtgggagctgtagggttttagtagaagccacttatcaggccaagaagttcctcctcttcctggtttgctgggaatagagagtgcgtcaagaatagctgttggattttttgacaagtgctccttctgcctctattgagataatcatatcatttgcaacaatctcaatcaaattctttcttaatttgctagtgtggggaatcgcactgattgactttcaaatagcaaagcaamcttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggcgcccgccaccacacccagctaatttttgtatttttaggtagagatagggtttcac

SEQ ID NO: 116761 - DNA, 601 bp, Human
tcttaatttgctagtgtggggaatcgcactgattgactttcaaatagcaaagcaaacttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggygcccgccaccacacccagctaatttttgtatttttaggtagagatagggtttcaccatgttggccagggtggtcttgaactcctgacctcaggtgatctgcccgccttgaccttccaaagtgctgggattacaagcgtgagccaccatgcccagctgtcatgatgcgttttaaaacacctttttggatgtgactgacttcggttgtgtgtagaacttccacgcccacgctcacgagggcgtcacctgccatgtgttggctgttgtgtctggttttggcatcagatgccgctggcatcaga

SEQ ID NO: 116762 - DNA, 601 bp, Human
aacattcctgaaagggggggaaaacaactgtttaaattcaccgcctgttattaaaatctctagatttgcagaatcagagtgaggtactcagcagtcagaaaacagactagacaggcccgtgtgcacacacgcgctgacacacgtgcacacacacacgtccacagggcagcctttaataaccgcaggccttcctgtcccaacactgcgcgggcccctgaagggccggtgtgggttgcagctcctcaatctctgctaaagtaaacagggttcaaccctgcggccttctcagcactctccccargtcaaaagaagggtgctcagcccctggtctctttggtttgccaaacttctagtgctggtgaaattcttaaatatgacatttttagaagcttcggctcctggcagataaaaataatgtcccccgctccacccccttttccccctatcccagttctagctaagacagtgatcagaggggtgcaccgtctttggggttaacagccatcagcagtggggttcccaggctgaaactaaatcctcgtttaactggcctggagacggaaacagccctgcctggggaagatgggggatttgctttaaa

SEQ ID NO: 116763 - DNA, 601 bp, Human
cagccatcagcagtggggttcccaggctgaaactaaatcctcgtttaactggcctggagacggaaacagccctgcctggggaagatgggggatttgctttaaatacgtgtaaagctgcctgccaggcggctaatggtgtctgcagccaggcgtgggcgtctccgggccatgggctcccccaccacaaattgcagggcagccggcttgggccactcctgtgtgtgcggggccctgggtatgattcctgggaggcagctcccaaactgtggggctcagcagaggattcagggcctgatttgcrggcagccccacctgcctttttgactgttcagagccctgagtgcctcccatatgcccacattttcctgcccctgggccttttcttctggtcatcggcctggagtgcctccactggcacattgagttctgccttcagagcctgggttttctggtggaatggggcaggggtaggctgatagacctcttggagagacagggcccactttcttgtaggcccacagggaccccgcctggggagagagaagcttcaggccctgaggcctatggcctggacctctctagagaccctagaacagacctc

SEQ ID NO: 116764 - DNA, 601 bp, Human
cccactttcttgtaggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagygccccccggcctgcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttg

SEQ ID NO: 116765 - DNA, 601 bp, Human
taggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagtgccccccggcckgcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttgattagcacacgg

SEQ ID NO: 116766 - DNA, 601 bp, Human
caggggctccttcctccctctctgtctctggggtcccatgggaagtcagggtggggcctggtgtgtggcttccgctggtttcctgggtgtgtcttcctgcagggccaggacccccagagtgttccagtgacttcagagaggggcagccagaccaggaggagctccagaggtgccctgtggggagaggcagcgtcccaaacacgggggagggggtaccgccagcctggggacagatagcagcatctcagccatggggggccgtgacatccggtcaggagggggttagcatctcagacatggkggggagatgtccagcccaggggaatgaggggggtgatgtccatcctggggaggggtgacatccatcctggggggacggaggcgtgacgtccatccttgggggatgggggggtgacgtccatcctgggggagtgggggcggtgacgtccatcctgggggagtgggggcggtgacgtccatcctgagggaacaggggggtgacgtccatcctgggggaatggggggggtgacatccatcttgggggtactggggggtggcgtccatcctgggactggggggtgacgtccatcctggggggac

SEQ ID NO: 116767 - DNA, 601 bp, Human
tgagctggtctcagcactgagcttgcaggtggagaaggcgggcccctgactttagggcgctctgggtgggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaarattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggct

SEQ ID NO: 116768 - DNA, 601 bp, Human
ctctgggtgggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagkagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgcccc

SEQ ID NO: 116769 - DNA, 601 bp, Human
gggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagtagaatggygtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgccccccgaggac

SEQ ID NO: 116770 - DNA, 601 bp, Human
gatcgagaccatcctggctaacacggtgaaaccccgtctctactaaaaatacaaaaaattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacrtggagggccccaggcagctgggccagcacgggacggggcgtcaggtcagcggggctcttctgtgctgtgtgcagcatgagagtctgtaccccacctgtactcaggaccctgccccccgaggacaaggtcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgc

SEQ ID NO: 116771 - DNA, 601 bp, Human
tcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgctcgtctgggtcccccgcctgggatgccaccagtgtcctcacaccagcctgctcctgccctgtgcccatcctcctcctgcttagcgatcctttctcttgctaatgtgtgggacaaggggctctcagggrgcctggccaaggtagcgggtccccccaccatactcccagtgccacccctggctgcctggagctagctgtgcaggggcccagaagccctcccctccgaggaggtgggcctgttccaggctaccttgggcgggcagggccttgggtggccagggcctcaggagggacacagagggccccactcaaggtcgcgggctgcacgttccatggggcctggggaagcagccgagcagaaggatgcagcccgactaaggctgcctcagggtggcaccccagcggtgcccacactaaggggacacttgg

SEQ ID NO: 116772 - DNA, 601 bp, Human
cctggagctagctgtgcaggggcccagaagccctcccctccgaggaggtgggcctgttccaggctaccttgggcgggcagggccttgggtggccagggcctcaggagggacacagagggccccactcaaggtcgcgggctgcacgttccatggggcctggggaagcagccgagcagaaggatgcagcccgactaaggctgcctcagggtggcaccccagcggtgcccacactaaggggacacttggcaggggaggggctgtggcagggcagggtcatgtccccagcagtaaggccaggacmgggcagccggaccccgactgtgccaccctcagcccagtggatggtgcatctcacctgggcctggccggctgcactgtggcgcctgccccaggccaggctaccttgggcggggtggggactggtactccccggggggtgggggtgagggcggaggtgagtgtggatgaggccaccagctgtgcccagcacgtcactgagggcccacaagctctcagcacaggctggcggctgagagcagctggccacaggcaggccctgggagcaaagggcgctttgagctgcctgagtgcctgcattgcc

SEQ ID NO: 116773 - DNA, 601 bp, Human
gctttgctagacccttgctggccctccggcttcgggcaggtctcctctttatgccactgtaaccccacaacaccggataccagcatggggccggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccrtgaaggatggcaccgagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcgg

SEQ ID NO: 116774 - DNA, 601 bp, Human
ttgctggccctccggcttcgggcaggtctcctctttatgccactgtaaccccacaacaccggataccagcatggggccggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccatgaaggatggcacygagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggc

SEQ ID NO: 116775 - DNA, 601 bp, Human
acataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggccctgaaggcccayagaatccttttggagacctgacccgcgggagcccaggtgagcaaccgccacgggccagggcccctcgaggcactcatttcagtatcagagaacacacataacgtaaaattcaccatttcagccatttcagccatttcagccatttcacagcgtgcaatttggtggcatttagtatgttcacaaggcggttcagccaacacctgtctccggttccagagctttttcatcacctcaaaaggaaaaccatccccattgcccttctcctagttcctgacaaacatgttctttttaaacattatg

SEQ ID NO: 116776 - DNA, 601 bp, Human
tcatcttgcaaaactgatgaaagtctgtccccattaaacactcactccctactcccccttccccagcccctggcgcccatcatctactttctacctctgtgaatctgatgactgtagcgacctcacgtgagtggaagcagatagtatttgtccttgtgtaactggatcatttcactgagagtaatgtcttcaaggttcctccatgttgcagcctgtgtgagaatccccttcctttttaaggccaaatcctattccgtggtagggagggaccacatcttccgtctccgtcggtgcactgagkgacactgggctggttcccctttttggctgttgtgaatgttgctgctgtggacatgggtgtgtatggatctcctttaaagagaccggggacagactccaaagtggaattgctgggtcatacagtaattctgttttttttctggcatgttatttaaacagactatttgttagagcagttttaggttcacagcaaaatcgagcggctggtcatttcacgctttaaaggagctgtggcattctacatcccccagcagcacacaaggtcccaacttctccggatccttgggagcacttgtcactc

SEQ ID NO: 116777 - DNA, 601 bp, Human
ctatttgttagagcagttttaggttcacagcaaaatcgagcggctggtcatttcacgctttaaaggagctgtggcattctacatcccccagcagcacacaaggtcccaacttctccggatccttgggagcacttgtcactctgtttggggtggcagccaccctaatggatgagaggtggcatctcgttgtggtcttgatttgcatttccctgatgattagtgacactgggcacctctccgtgtgcctcttggccatctgtgtatcttcttcacagaaatgactgtccaagccctttgcctrttttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttggggggcagggacccagaaactcattgctttcaggccttgctagaaaagcatacagtcgaacgagtgggtccgatgtggagtgcagtggcatcagccaaggct

SEQ ID NO: 116778 - DNA, 601 bp, Human
atttccctgatgattagtgacactgggcacctctccgtgtgcctcttggccatctgtgtatcttcttcacagaaatgactgtccaagccctttgcctattttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttgggggkcagggacccagaaactcattgctttcaggccttgctagaaaagcatacagtcgaacgagtgggtccgatgtggagtgcagtggcatcagccaaggctccgaggcgtttcttcccacttcacatgtcttttctgttgtttctgcgaaggtgtctcagggaggggcagaacccatggggtttggcttcctgaccctgaacgtctttgtcccaggcccttcactgggtctggaggaaggagggtgctgtggtcctggtggctcttgtgcctgcacccgccttggggccatctgacacccacac

SEQ ID NO: 116779 - DNA, 601 bp, Human
aaaatgtgaacagaggccaccacccccattatgtgggtctgtgtttgctctgtgcacgtctcggtgcccagatctgaggcccttttgtccatgaagccatctgcagccaggaggcggccttgctttagtctgaaggagagtgaccagggtaggaggggcctccttgtccctttggtctgtttgtggtctcagtggagaccaaggacggctcttcttctcgtatctacggggcagagctcagggccgcactccatcagcatcccgggccattgcatccttgaccccggggggcttgcaggcrccacatagatcttgtgagaggcgctttgtggggctggatgatcctgggtgcccctcagagaaggccctggggctggccttgttatcagtgggggagtcaggaagtaccccggttctgtacctgtagtggatggggctctcagagggattgggggtgatgggggtgctgagctggcctgagaagggtggggtaacctagggggtggagtgggggagggagagagcactcctgacacagggtcctgaggaggcaggggtgccccagggaatggggggcacctggggcccacgggaggctctg

SEQ ID NO: 116780 - DNA, 601 bp, Human
tgtggtcccgtgaatcaggggtgggccatggcatggcgtgggggaccagccctcctccctgtccccagctgagtgtgagctccctggggtcttgctgtggccttggccctgggtgttgtcccacacagcccaggagagcgtttgaggctgatggtggtggagatagttttatctctgagcaaacattccatcttgctgtttccagcctagagatggtgaggggacttttccttggctctttcctggcctgctagcagcaccagcctaattaacctgacaagcggggcctccccagccatgyagccttgcactgccttcccacatccagctggatttggggatcagtgttgtttttaatcattcctaccaccttgtcccacaggcaggagtcctgccatcttcgaaggccagcccctaaacaggttccctgagtgttaggtcaaaataactttaaaaagacacgcagctatccacagcaatccttaatagttacttatctatttcagggtataacataagacacacctatcatttcagacctgcctaggacatgcctggagaaggtatttaagtaattttaaaagtgcatcaaaacaaggtc

SEQ ID NO: 116781 - DNA, 601 bp, Human
gctcctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgtttttygttttttgttttttgagatggagtctcactctgtcacccaggctggagtacaatggtgtgatctcggctcactgcaagctctgcctctcgagttcaagcgattctcctgcctcagcctcctgagtagctgggattacagggcgtgcgccaccatgccaggctaatttttgtatttttagtggagacagggtttcaccatgttgatcaggctggtcttgaactcctgaactcgtgatctgcctgcctcggcctcccagagtgctgggattacaggcgtgagcccccgcacctggcccacac

SEQ ID NO: 116782 - DNA, 601 bp, Human
ggcttctgagggaggacaggcaggagtccgccggaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactwtacagctgaggaaactgaggcccagctttccacttctgtgcctagggggtgggatccagctccgagggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctct

SEQ ID NO: 116783 - DNA, 601 bp, Human
aggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccycctctggccaaggctggggttcctggtgtggggcctcctctggcctgggtgggcctggcctgagagctgcagcctcacctgggctccactgcctatggacatgagctgaagctgctcagccttccaggagggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgca

SEQ ID NO: 116784 - DNA, 601 bp, Human; identical to SEQ ID NO: 18270

SEQ ID NO: 116785 - DNA, 601 bp, Human; identical to SEQ ID NO: 18271

SEQ ID NO: 116786 - DNA, 601 bp, Human; identical to SEQ ID NO: 18272

SEQ ID NO: 116787 - DNA, 601 bp, Human
ccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaa

SEQ ID NO: 116788 - DNA, 601 bp, Human
gaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcrtggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgat

SEQ ID NO: 116789 - DNA, 601 bp, Human
ctcagacacaccctgagagggtgctggagctgccacaacaaagtccgcgaactgctgggcccagagcaacagaaactcatgggctctagaggccagagcccgaagcgaggtgtgcacagggcctgcccctccgaaagctcagggagaaatttcctctcctctccccgtggctggagactccaggcgtgcccggtgtgcggccgcctctttcctctgtgtcaggccctgtctctcatgaggacacttgctgttggctttagggtccacccaggtgatccaggaggagctcatcttgattgartcttcaaagagcctatttccaaatatcgcattctgtgggtccaggtgaatatgaattaggggggatgcagtccagcctaggacagtgggtggcccaggtggacttcctgggaaggtccctccccttgccggccaccagtttccacagctgtccagcgaaggcgccggctcagtggttgagtgtcccctcctgtccccttcgccggggtggggatacgcaacttggatgtgagaactctcgaatcccctgagtgtggcgcctgccctggctgccaaggcgtttggggagaatttaagactt

SEQ ID NO: 116790 - DNA, 601 bp, Human
gccagaaggggctgggggctggtgcaggggtgtgcgtgagggcagggcctcccagacagtcacaggccagccctgttggcactgcccagcgggaggggtggtgtcaggaagagctggggaagccaaggcgccgtgggccgaggggcggcaggacctggccacccaccgagcccctgggtcagcgttcttcctcctcctggagttccgtgcaaaggggaacgagttcagctgccctactgagtgggcctggggacagaggcagagtacgcacctgctgtgtgcctcagtttctccatctgcmcatgggagacagcagtccgtctcccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcagg

SEQ ID NO: 116791 - DNA, 601 bp, Human
cccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcaggtggccatgggaagcaccgccggrgtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgacggggaggcctggccctcgtgaattggtgttcgtttatttactttctcctgctgaaaggaagc

SEQ ID NO: 116792 - DNA, 601 bp, Human
gcatggtgtgagctggggctggcctgtggtggttcgcaggtggccatgggaagcaccgccggagtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgayggggaggcctggccctcgtgaattggtgttcgtttatttactttctcctgctgaaaggaagcaggtttattttggggtgtgtgtctgcttttgcttttaccctgagagtttgccagcctgctggcttgttcccccacccccacctggtggcgtcagcccctttatggctgttcctgagagacaggccggagtctccagggcggccccacgggggctgggcgtccccttggaatgtgagtgcctggcctgttagagccccaggaccgctggccccacccttctctgtcccagagacagtcc

SEQ ID NO: 116793 - DNA, 601 bp, Human
cctctcggggcacccctgccttctactgaccacccagccagccagcaggagcccacgtgcacccagctcagccccaggaggtgacacccccaccctcagcagctctcgtctgtttgggggcaggtttggaaggtggtctcgggtgtccttacgcgagcaggtggctacctcacctgctcacctgaccccaactccactctgacttccaggccagccccactccattccaccttcatcatgcagtttctgtattagatttttaaataatcaaaatatggtattttcatttaaaaagtaatgmttttaaaatatattaaaataatttaatgttgttattagaacaatgtttaatatgccagcccgtgccatttgtcttgatgcctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgc

SEQ ID NO: 116794 - DNA, 601 bp, Human
cctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgccatcactatttaatacagtggaggcatgtaaaaacaattccatattaatttattaaaataatagacccattacattttcataatgtcatgaaaaatttctatattttccaaaacaaatattatcgaaagaaaaatatgcatttttgcaaatctccagaaagcctggctccccagaggacggggatccccacgcctgtcccggaactgtctgtgaagagcaacgtcccactgcttacgcttgggtgggagcaggagtgcctgttagtgccccccagccacagagagtgctgccgtccctgagcccagccccagcagatcatcagcacacatttgcctggggaacacagacagccctgtcctggacgcagcccttcaaccct

SEQ ID NO: 116795 - DNA, 601 bp, Human
ccctgggctgagcccctttgggctgagagctcaccaggtggaagtcactccccagggcaggactggcacagggtctccgatgccccgcccactttgcagccctgtgtctgcctctgcaactccccaccccagtgcacctgggccctctggggaaggtagcggcagcccagcctgtgcatgtgggtgcaggccctctggggaggacaccctgcagacgaggggctccggttcccccagggcccccctctctgccagccactgtcagcctcacccatggcctggcttcaccctgcagggaccyggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcacccacatacacagagccgggtggtccactgaaagggcctggcagtaaacagcttcctgtgcacattgtgt

SEQ ID NO: 116796 - DNA, 601 bp, Human
cccccagggcccccctctctgccagccactgtcagcctcacccatggcctggcttcaccctgcagggacctggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcrcccacatacacagagccgggtggtccactgaaagggcctggcagtaaacagcttcctgtgcacattgtgtgtgtggcaggggcatgggggcatgtgtgtgtctcttaaggacagtggcgctgcagggagagctccgtgtgcagctgtgggaggtagcctgcaagcagcctctgcagaagcatcctggccataagcgaacgtgcggtcagggcactagtggggcaggggcctgggtggcggccagggctcagcagaggcctgtcccgccctgtggcctggcggcggtggctggcgttcatc

SEQ ID NO: 116797 - DNA, 601 bp, Human
ctcccaccaagaagaaggcttgagctgcatcttgtactctcagaaaagaggaaaataaaacatctggtgccctggagtggcgtcaggaagcagcgcgtcatcccagcccctgctctttgttgacgaccagcctcagtgggagctcccggtctcctgggggccggcgcacagcaacgtcggtggcccaggggcccagcctcctggggacaggcaggcagatgaggcagccggtgtggggcgagctcccaggcccacgttcccagccagcaggcctggcccttcgtgggtgctgggctccttrcatgtgctggtgggacataccttgtgtgtgacgccgagagcctgggagacatgtgccatcccgcggctctgttcctggtgctttcgccgagtcacacggggtcgtcctggtggtcagggtctcttgccggcctctccgctcatcagagtggtgggtttgggttaggcagttggccctcccgaggctccagtcccatccgtggctgaccactgtccctctccctgcaggtcacagtcaccaccatcggctatggggacaaggtgccccagacgtgggtcgggaagaccatcgcctcctgct

SEQ ID NO: 116798 - DNA, 601 bp, Human; identical to SEQ ID NO: 18273

SEQ ID NO: 116799 - DNA, 601 bp, Human; identical to SEQ ID NO: 18274

SEQ ID NO: 116800 - DNA, 601 bp, Human; identical to SEQ ID NO: 18275

SEQ ID NO: 116801 - DNA, 601 bp, Human; identical to SEQ ID NO: 18276

SEQ ID NO: 116802 - DNA, 601 bp, Human
accaggcccgggtaaaacgtggggggcctgacgggacaggcccttctcatgcagcccaggggccccgagtctgtgcgtgatggtgtggctcggatctgcgtccctcctctcacccctgcagcgggggctgggatgaagctaccttctgcgggacctgacgattggatggcagacctgtctagggtttagatgtcctccatccctggtgaggggttttacccacgctaactcgtaagcgtggctctttgacagatgtggagagcgaggccctagaggctgggctcgtgtgctccagccacayggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcagacctggcctcctggctgcatcaggaggcacacgtgatgcatccgtcatctcgggaccagttttgag

SEQ ID NO: 116803 - DNA, 601 bp, Human
agcgtggctctttgacagatgtggagagcgaggccctagaggctgggctcgtgtgctccagccacacggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcaracctggcctcctggctgcatcaggaggcacacgtgatgcatccgtcatctcgggaccagttttgagacaaacatcctatagggcaggaccgtgaactgggtagctctacagagtgtgaggggctggagacctcctgcccactggccacggatgccacggatgcccttgagagttaggagaggtggaagggaccccacttctccctgggagctccaacttctcttgcatgtgacttcagtgcccacttctggggactgtgatcccaaactgccaaattctctagcagctctcttaaaacca

SEQ ID NO: 116804 - DNA, 601 bp, Human
ccctttgcccaggaggctcttggagagccctggcttggggagaaggagatgctgatcccagggcagatgccactcctggggaagccccacagccccactcccgcaaggcgggtacgaacagccacactgagtcccccgcaaagtcaaacccaggcctcgaccttgtctggctgtgctttctgttgtgtgaacctgcaggttaggcagaagtccccttgaccctgcctcagggctgctacctgtctgcgccatccacctgcacacaagccccttcagctcgtgctctagctggtgctgtgcrgtgttggccccatttatagatggagaaacggaaggccagggccatgtggggaactcctgaggacacctgtgtgtcctgacacctcactgagcctgtcgagaggcacaggcaggtatggcagtggcagacctcaggggagggaggctgggaaggtagaaggtcccccatggtagcatcagaacacagactaacctgcagcaaaaatgggctgtgtggtccctgtagagcagcctcactgaggggaggcaccagccctcatcccacgcagcagggcccgctgctgctccctcaaccttctga

SEQ ID NO: 116805 - DNA, 601 bp, Human
aagggactggaggcaggttgtcagagtagggctggccggaggtggcctcctgaatgcccctaggaggccagaggagacttccccaaattcactggtcctggaggccgcctcagaggccttttgctgctcagagaacactgggctggaaggtcgtggtctgtgacgtaggatcggggaggccacctcagaggccttttgctgctcagagaacactgggctgtaaggtcgtggtctgtgacgtaggatcgggcagcacgcacctttccacctggcctggaggtgattctgaagggcttctggrgaggcgtcttcaaagctgtgcctgtgtgtgtcaccacgtgtttgccaggtgacctgggactattgtgtggtttcccgtttgtgaagtggggcagcgtgctggaggagcatgcatcacatacccagaggtccccagtgtggtctggggactcatcgttcacactcgtgtgtgtgctttctggaggcatgcgtcatggaacagcctcacctctcacttctgcacttgtgagcctggttctcacagggtcaggctgtagcctcctcctgctcccggctccgcgtcctcagcccaacacaccaa

SEQ ID NO: 116806 - DNA, 601 bp, Human
ctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagygattgctttgatgaatctgggcaaagtaaattgaaaacattttagaaaataatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaa

SEQ ID NO: 116807 - DNA, 601 bp, Human
tttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagcgattgctttgatgaatctgggcaaagtaaattgaaaacattttagaaaakaatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaaataccacggcccaattattatattatataaaatgagggagatggatgata

SEQ ID NO: 116808 - DNA, 601 bp, Human
tgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatamattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatc

SEQ ID NO: 116809 - DNA, 601 bp, Human
atattcctaaaatggaatactacttagaaatacaaaggaatgaaccactgatatgcctacaatatggatacattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgrtggtttcatcatgtgtcaaaagttaccaaattgcacactttaaacataagcaagttatgtcaattatatctcaataaaactgtttataatatataatgtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaaga

SEQ ID NO: 116810 - DNA, 601 bp, Human
gaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatctcaataaaactgtttataatatataatrtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaagaatgaaaatatgctggatgacttcaattatgacaagagaaatgcaaactaaagcaatggggtttttgaaacttatctgattattaaatatcaaagagtt

SEQ ID NO: 116811 - DNA, 601 bp, Human
gccacttggtagcaactgattttttcctttagtgattttatggtcttctctatcatctcttcgtttttcttttcctttatgcctgaacttttgtggtttttctccttttttcttaatcaagcacatgagaaatttatgttttatttatattttattatcagaaaactatctttgtactctttgttatctatttcattaatctaagcttttatagctattaattcccttttcttggctaactctatttttgttttcttttacttaagagtcatagttcatttatttgaagttcttctactamaggcatttttaaaggctataaattttcctctgattgcagctttagctgtgacacgtagatctgattatgaaatatgttccttttcattgctttcttgatagttttaattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttg

SEQ ID NO: 116812 - DNA, 601 bp, Human
aattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttgtaaatgctccacagacctcagaaaatatcttctgtatttgtataacacaaagttttatttgtatacatggacagacaaaatgtacattgagatggattgtgtatayatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatatggccaaccttctttagggtcatagcccagctctgccattttcttatgtggccctaagcaagctactgcattctctgtgcctcagtttccacatctgtgaaatcaggatcctaactgcctgctcccaggactcc

SEQ ID NO: 116813 - DNA, 601 bp, Human
aagtatgaaaataacatcattatttttgtaaatgctccacagacctcagaaaatatcttctgtatttgtataacacaaagttttatttgtatacatggacagacaaaatgtacattgagatggattgtgtatacatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatayggccaaccttctttagggtcatagcccagctctgccattttcttatgtggccctaagcaagctactgcattctctgtgcctcagtttccacatctgtgaaatcaggatcctaactgcctgctcccaggactcctgtgttgactgagtgagttagaacatgtaagtgctcacccaggacccatatgcagcaaacagtcttgtgtctctgtctgctgccaaattggcctcaggctctatcaataccagatctgaataggggctattctttcttttagtgtccttaatgttgtattactttcc

SEQ ID NO: 116814 - DNA, 601 bp, Human
tttagtgtccttaatgttgtattactttccaatattcacactttaactttacagatgagtagaatggaatagatgtgtttcagtacagaacttttttcttatgtttgcttgggctcccctcctctctgttacctatgttgataatctaggatttgttgtcttacatttttcctgatgttcatataatattcaatgaaataaaatacatgtgacataatgaaggcattatcattgttttccaaactcacgggatcatatcatacctgctttctgcatcttgtttttctcaatcagtaaaatmgtaaaaatgcctctaaggctgctgaaacaattttattttgatttaattctatctctaattgaattttatttctatttcaattctattctaaaatttataatctctgcttaatttcctttggtgtacatactctgtgatgttctctatcgcttaaaattcattttgttcaagaacataggttcttgaacctgtttctatgtacagaacttttatttctatgtgttaactttccaggatgtattagtttgctaggactgccataacaaaataccacaggctgggtggcttagacagcagaca

SEQ ID NO: 116815 - DNA, 601 bp, Human
aaacatcaatataatacttggacctaatttaatgcctatgttcccattttgtcagttgccatgacaatgtcctttgtggcattttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtaycacatcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatact

SEQ ID NO: 116816 - DNA, 601 bp, Human
atcaatataatacttggacctaatttaatgcctatgttcccattttgtcagttgccatgacaatgtcctttgtggcattttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacrtcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtcc

SEQ ID NO: 116817 - DNA, 601 bp, Human
gacctaatttaatgcctatgttcccattttgtcagttgccatgacaatgtcctttgtggcattttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacatcctgaggcacacagygtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtccagttggaatggttacc

SEQ ID NO: 116818 - DNA, 601 bp, Human
atgataaccaggatgtcaacagcaagagtccagatgcagagtgctcccgtcgccacggggttcccattatttgtccttttacacggactttctcccatcccatccctccaatccctggtgaccactcatctgttctctgattctctagttttgtcttttcaaaaatgccacgtaaatggaatcacacaatacacgatatcttagaaacggggtcttttggctcggcatcattctctggattcattccggttgttttgtatcgcgacagttcattaaatcatagtgctgagtggagtttcayggtatggacatataccccagtttatttaaccattccctcatccaaggacatgtgggtcattcccagtttgggctattacaaatcagagtaggctgaacaatggcccccaaagtagccaggtcctaacgcctagaacctgtgactatcgccttctatggcaaagggcactctgcagatgtgtcaaattaaggaccttgagatggagagatcatcctgggttatctgaatgggcccggtgtaatcacaagggtccttataacagggaggcagaagaatgactacagaagagaaaaagggtta

SEQ ID NO: 116819 - DNA, 601 bp, Human
ccatttaaagaatataattgaatggtttttagtataggcatacctcagagatattgtggttcggttccagtacactgcaatgaagcaaatattgcaataaagcaagtcacacaaattttttggtttgccactgcatataaaagttatgtttatattgtagtctattaagtgtgcaatagccccatgtctaagaaaacaatgtgcctaccttaattgaaagacactttattgctaaaaaatgctgacccagaatgaagtgagcacatgttgttggaaaaatggcactgatagacttgctcartgcaggcttaccacacacatttaattttttaaaaacacaatatccacaaagtgcaaaaaagtgaagtgtgcctgtgtatccccagagctgtgcaactgccactccagtttgagaacatttttatcattccaaaaagaaacccagtgccttttaaatatcacccccaaacccactattccatccccctcagccctaggcaataactaatctttctctctatgggtttgcctattctggacattttatataagtggaatcatacaatgtatggtcctttgtgactggttactttcacttagc

SEQ ID NO: 116820 - DNA, 601 bp, Human
ccactattccatccccctcagccctaggcaataactaatctttctctctatgggtttgcctattctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacrggcacgcaccaccaagcccggctaatttttgtatttttagtagtgacggggtttcgccatgttagccaggctggtctcgaactcctgacctcaggtgatccgcccacctcggcctcctaacctgctgggaccacaggcgtgagccactgcacccggcccttgtgcttcattcttttatgaatgaataatcttccatcgtatgatatacaatgaataaacattttgtttatccatttatttgttgataagcattttagattgtttccacattttgactactatgaataatgcttctagaac

SEQ ID NO: 116821 - DNA, 601 bp, Human
ctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacgggcacgcaccaccaagcccggctaatttttgtatttttagtagtgacggggtttcgccatgttrgccaggctggtctcgaactcctgacctcaggtgatccgcccacctcggcctcctaacctgctgggaccacaggcgtgagccactgcacccggcccttgtgcttcattcttttatgaatgaataatcttccatcgtatgatatacaatgaataaacattttgtttatccatttatttgttgataagcattttagattgtttccacattttgactactatgaataatgcttctagaacatgtgggtttttgtgtggacatgtgttttcatatctcctgggcatgaaagagatatgaaaggct

SEQ ID NO: 116822 - DNA, 601 bp, Human
gctgggcatggtggcaggtgcctgtaattccagctactcgggaggctgaggcaagagaattgctttgaacccgggaggaagaggttgcagtgagccgagactgtgccactgcactccagcttaggcaacagagcaagactgtttcaaaaaaacaaaaagaaaggaagaaaagaaagagatatgaaaacacatgggagtggaaagctgagtcaaatgatcactatcttttttttgagatgaagtcttgctctgtcgccaggctggagtgcagtggcgcgatctgagctcactgcaacctctrcctcccaggttcaagcgattcctctgcctcagcctcccaagtagctgggattacaggcacatgccaccatgcccagctaattttttgtattttagtagagacagggttttaccatgttggccgagatggtctcgatctcctgacctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgca

SEQ ID NO: 116823 - DNA, 601 bp, Human
cctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgcaagttctccatatcctcaccaacacttgctattatcttttttcaattatagccatcttagtggttgttaagcagtatctccttttgggtgtgatttgcatttccctgtgactactcacgttgagcatcttttcatgtgtttattractatatgtcaaccctgaagaaatttctattccgatttttcatccattctttaagttgggatatttgtctttttgtttttgagttgaaggagttatttatatatccagtaacaagtcccctatcagatagattatttgcaaatattttctcccatctgtaggttgtcttttcactttctttaaggtgtcttttgaagcacaaaagcttttaatttttatgaagtccaatatatctactttttttcttttgttccttgttctttggtgttatatctaagaaacctctgccaaatccaaggt

SEQ ID NO: 116824 - DNA, 601 bp, Human
tgtcttttgaagcacaaaagcttttaatttttatgaagtccaatatatctactttttttcttttgttccttgttctttggtgttatatctaagaaacctctgccaaatccaaggtcataaagatttacccttatgtttaccctaagaattttatagctttatctgttacgtatttatgtctttgatccactttgagttaatttttatatatgatgtggagtggaccaattgatttttctcatgtggatatcagttgtttcaacactatttgttcaaaagactattctttccgcattgaacrttcttggcatccttgtcaaaaatcaattgaccatagatatatggctccgtttttacactctgattctattcccttgatctacatatctatctcatgccagtatcacattttctcgaatactgttactttgtagtcaatttggagatcaggaagtatgaagcctccaacttttctttttcaaaattgttgctattctgggtcctttgcattttcatatgaagttgaacatcagcttattattctacaaagaaaccagctgagattctggtaaggattgtgttgagtttgtagatcagcacg

SEQ ID NO: 116825 - DNA, 601 bp, Human
atgttttgtaattttcagaggataagttttgtacttgttaaacttattcccaaggtattttattttttctttattatggtaaaaatatacataaaatctactattttactcattttaagtatatagttatgtggcattaggtaaattcgcactgttgtgctttattcttttttgatgttatacatggaattgttttcttaattatattttcagattgttttttgacagtgtgtagaaatacaattgatttttatatactgattttgtctcctgcagccttactgaactcattcgttgtaaytgtttcacaatggattccttggggttttctgtatacaacattgatacggtttggatgtttggtccctccaaatctcattaaaatgattcccaatgttggaggtggggtctggtggggggtgtctggatcatggacggagccctcgtgaatggcttggtaccatccccgtggtaatgagcgaattcttactctggtagtttatgctaagagctggttgtttaaagaatctgctacctccctccaccttgctcctgctcttgccatgtgatatgcctgcccctctgcctttcgccatgattg

SEQ ID NO: 116826 - DNA, 601 bp, Human
tgaatagaagtggaaagagcagatctctttgtctcattcctgatcttaacggggaaacattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacgggrtttcaccatattagccagtatggtctcgatctcctgacctcgtgatccacccgcctcggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaa

SEQ ID NO: 116827 - DNA, 601 bp, Human
cattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacggggtttcaccatattagccagtatggtctcgatctcctgacctcgtgatccacccgcctyggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtca

SEQ ID NO: 116828 - DNA, 601 bp, Human
ggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtcatgagggtggagacctcatggaatggattagtgcccttgtaaaagagacctcagtgagctcctttttttcttccgtcatatgaggacacaagaagacaactgttcatgaaccagaaagcgrgtcctctccagatgctgaatctgccagtgccttgaccttggacttccaagcctgtaaaattgcaaaaaataaatttctgtgtttataagccaccagttcgtgatactttgttataacagtctgaacagactgacagaaatcgtggtgttttgtcttttattctgttgataatggtgtattacattaattgattttcagatgttaattcaaccttgcattcctgaaataagtcccatttggttataatgtataatcctttttaaacattgcttgattttacttgctagtattttgttgagg

SEQ ID NO: 116829 - DNA, 601 bp, Human
cttgctttaggtttagtttgctcttctttttctagtttcttgaggtggagagttggcttactgatttgaagccttattttttgatataggcattcatagctataaaattccatctttacactgctttaaatgtatcccataagttctgttatgttgtatcttcattttcattaatctcaaagtacgttccatttcccttgtgaattctttcacccattgattatttaagaatgtagtgttgtttaatttccacatgtgtatgtttccctaatttctttgctactgagttctacttttattycattatattcagaaaaagataccttgtattatttcaatccttttaaatttatgcaggtttgtttcgtgacttagcatatggtccttcttggagaatgtctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttc

SEQ ID NO: 116830 - DNA, 601 bp, Human
tctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttcagttctgtcagtttttgcttcttatgttttagttctctattgttaggtgaatatatgtttataatcattgtatcttctcatgaattgacattttatcwttatgagatattcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttt

SEQ ID NO: 116831 - DNA, 601 bp, Human
ttcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttttctatgtactrtttcttgttcctctatttctcctttgctgctttcttttccatctagtgactactttctaatataaattttcatttcttttatgattcttcaatattctatttgttattagtgtttgctctagggcttaccttatgtatcgtctcaaaatttacttcatatttatattaatcctggtgagatacagaagttattcctgtatgagtttattcagttttaccactttttgtggtattgttacatatattacatctttattatgcgctattataatgatcatactatataatgatatatcttta

SEQ ID NO: 116832 - DNA, 601 bp, Human
gttggctttttttttttttttttttttttttttttactttgagcacttgggatctgttaccccactactttctgggtaccactgtttctgacgaaaagtcagctccacatttgtctccctgacaccagaacaggggagggtattaagcagagtgccacatagcctcacctcccaccatttcatccaagaatagtagttgggtaatagttcaataactcactctgaataattgatagaacaacaagacagaaaatcaacaagagttagtactattattgttgagttgtctattattgttcarttgtctgtttctctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttatttttattttatttttgggatggagtctcactctgttgcccaggctggagtgcagtggcgtgaccttggctcactgcaacctctgcctcc

SEQ ID NO: 116833 - DNA, 601 bp, Human
tctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttatttttattttatttttgggatggagtctcactctgttgcccaggctggagtgcagtggcgtgaccttggctcactgcaacctctgcctcccggattcaagcsgttctcttgcctcagcatcccaagtagctgggactacaggcatttgccaccatacccagctaatttttagtagagacagagtttcaccatgttgaccaggctggtcttgaactcctgacctcgagtgatctgtctgcctcagcctcccaaaatgctgggattacaggtgtgagccactgcacccagccaattttgtctgattttagtacagtcactctagctttcttattactgtttgcatgtcatctttttccatcattttactttcaactatgtctttgaatctagaatgtgactctt

SEQ ID NO: 116834 - DNA, 601 bp, Human
ttatagaccatatatatttggatcctgcttttaaggcagtctggcaatctctgctctttattgagtttttaattcacttatatgtaatataattattgatatggaaggatttatatctaccatgttgttatttattttctatatgtctcatatcacttttgttcctctcttcctcctttactgccttctgcaggttgaatagatatgttctagagtaccattctaattcctttgttagtttatttcccccatttttaaagtgtaatctggaggttacaataagcagcttaagcaaaaacartctgcttcaggttaataatctactcaaatatttttgtctgccctattctctccttctcagtactcttattaacacatatgttgttactccttaattccacatatgttttctactcttaattacatatatgttacaacttaattacacatacattgttacacatcctgttaggacaggggttcccaaccccagggccatggactggtaccagtctgtggcctattagaaactgggctacacagcaggaggtgagcagcaggcaagcaagcattactgcctgagctctgcctcctgtctgat

SEQ ID NO: 116835 - DNA, 601 bp, Human
aacctagtggtcaagccatgattagtcagacatttgtttaaacatcttgagccagtgaatcttccaccctctgctgaggggatctatgtgtgggttgggacattcaaagttcaggcactttataactctgtcctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattargttgctgtgatgtgggttgcctccaattatttgccactgaaatccttgttgcttaacatagtgcatagggttttctatggaattcaaaatcagatgagccttctttgttgctggtcctcaagcctaccgtgcccctgagcttgggtggggagatggcagccccacgttaaatcataaccctgctattcttaggaaggcttaatattttttctttaattagcacttttcaattttatatttctttgtccagttttatcattgcttttcagggagtggttatatcaaggtgctcattccacc

SEQ ID NO: 116836 - DNA, 601 bp, Human
tgttctccatgttgacatttaatatagagtcttctttttctggtgataattctgtctgtgctgctttttagtcttctgtgcaccctttaaattttttaagtaacagaaaccatttcaaaatgtacaattcagtgtcacttagtacatttacaatattgtgttttttgtgtcttttctaagaatttatttccaatctcaagtcataaagatttactcctgttttctactaagaaatttatgcctttaactcttattttttggtctctgatacattttgagataatttttatatgctatgagktatgggtccaacttcattctttgatatatgaggatccagttgccccagcaccatttgttaaaagactactcttcccactgaattcttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattg

SEQ ID NO: 116837 - DNA, 601 bp, Human
tagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagtkttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatatcgttcc

SEQ ID NO: 116838 - DNA, 601 bp, Human
tctctggttacgtaaggtataatattaggttatggatccttcttctttttcagtgtgggcattcacagctataatttttcctctgagcacttctttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtrtgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatc

SEQ ID NO: 116839 - DNA, 601 bp, Human
tttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtgtgatttctatattttaaaatttattgagactcttttgtggcctaacatatcatccctcctagggaatgttccatgtgcacttgagaagaatgygtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgt

SEQ ID NO: 116840 - DNA, 601 bp, Human
gtagttttatttccctgaatttgttaatttttaggtttttcttctgttacagatttctggcctcactatattgtagttagagaagatattttgtgtgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgktttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagttta

SEQ ID NO: 116841 - DNA, 601 bp, Human
tagttttatttccctgaatttgttaatttttaggtttttcttctgttacagatttctggcctcactatattgtagttagagaagatattttgtgtgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagtttat

SEQ ID NO: 116842 - DNA, 601 bp, Human
gagtttatttctatgtatggtgtaaggcagcgatatcaaatcttttggcttcccggggccacactgtaagaacaattgtcttaggccacacataaaatacactaacaataacaacagctgatgggctaaaaaaatgcaaaaaaattcaatgttttaacaaagtttacaaatttgtgttgggcctcattaaagccatcctgggcttacatgtggtctgtgggccatgggttggacaagccacagaactgggtttcctaacgtcatttatgagagagactatctttctgcattgttttcttcrtgttcttgtggaaaattggttgatcatatatctttgaatttctttctgggctctctattctgttccactggtctacatgtttgttttttatgccaggaccatactgtttgatcaatagttttgtaaaataaaccagaaagtatgaagtctccctttgtttttcagaacagaattttcagaatttcgttggctacttaaggttcttgctattccaaatgaactttagaatttaaaaaaattttccatgggattttgatagggattttattcaatctgtatattgatttggatattattgac

SEQ ID NO: 116843 - DNA, 601 bp, Human
tttcatctttttggctaaatttattcctaagcaatttttttgatgctatcataaatgggattgttttcttgatttcttttttggccaggtcattatttgtgtatagaaatgcaactactgttttatattgattttatatcctacaactttactgaactcatttattagttctaacaggttgctttgtcagagtcttcggggttttctatatgtaggatcatgtcatcttcatataaagataatattacttcttacttcctgatttgaatgtctttcatttctttttcttgtctgtttggtygtactagtacttccagtactatgttgagtagtagtagctagagtgggcatccttgccttgtactggttcatagtagaagggcttctgttttccctcattgattataacgttagctgtgggcttttcataaatggcattcgttatattgaggagtgttccttctatacctgaactgttagaatttatcaacaaaggatgttcaacttcatcaaatactttttgtgtgtcaattgagatgatcatgtggttttcatctttcagtctgttagtatcacattgattgctacatgtatattaaat

SEQ ID NO: 116844 - DNA, 601 bp, Human
gtgtcaattgagatgatcatgtggttttcatctttcagtctgttagtatcacattgattgctacatgtatattaaatgagatttgcatgccagaaattaattccacatagacatgatatataatctttttgatgtattgttaaatttagtctgccaatattttattaaggatttttgcatcagtattcttgggttatgttggcctgtagtttccttttcttgtgatgcctttggctcacctgggtatcaaggtgatgctggcctcataaaatgtgttaggaagtattccctttagctgcatttttttttttttggaagtattccctatagctgcatttttttggaagagtttaagaagtattggtattctttgaatattgggtagtattcagtcatgaagctatctggtcctgggcttttctttgtttgaggttttggggtttttttaacttttatttttgatttagagggtatatgtacaggtctatatgttgcatggtatatggagtatactgcatgatgatgaggtttggagtgtggataagcctatccccaggtagtgagcatagtacccaataggtaggttttcagcccacctctc

SEQ ID NO: 116845 - DNA, 601 bp, Human
tatatggagtatactgcatgatgatgaggtttggagtgtggataagcctatccccaggtagtgagcatagtacccaataggtaggttttcagcccacctctccattcctcccccaagtagtccccagtgtctactgatcatctttatgtccatgtttactcagtgtttaggtcccacttgcaagtgggaacatgcagtatttggttttctgttcctgcattaatttgcttaagatagtggcctctagctgcatccatgttgctgcaaaggacgtaagttcattcatgtatatatatatatwttttttttttattttttttttagacggagtttcgctcttgttgcccaggctggagggcaatggcatgatctcggctcactgcagcctccgcctaccgggttcaagtgattctcctgcctcagcctcctgagtagctgggattagaggcatgcgccaccacgtccagctaattttgtagttttagtagagacagggtttttccatgttggtcaggctggtctcgaactcctgacctcaggtgatccacccgccttggcctcccaaagtgctgggattacaggtgagagctaccgcacctgg

SEQ ID NO: 116846 - DNA, 601 bp, Human
atggacatttgggttgcattgatgttttaactgttgtaaataatgccactacaatcgtgggtatacaaatatatctttgagactgcttttaatccttctgggtatatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctktcacttaggctggaatgcagtggcatgatcatggcacactgcagcctcaacctagacctctgggcttaggctatcctcccaccttaacctcccacgtagctggtactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatatgtctgtccaagtcctttgcccttttttttt

SEQ ID NO: 116847 - DNA, 601 bp, Human
ctttgagactgcttttaatccttctgggtatatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctttcacttaggctggaatgcagtggcatgatcatggcacactgcagcctcaacctagacctctgggcttaggctakcctcccaccttaacctcccacgtagctggtactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatatgtctgtccaagtcctttgccctttttttttttttttgagatggagtctcactctgttgcccaagctgagtgcagtggtgccatctcggcttactgcaacctctg

SEQ ID NO: 116848 - DNA, 601 bp, Human
tgggatttttttgagacaagatctggctctttcacttaggctggaatgcagtggcatgatcatggcacactgcagcctcaacctagacctctgggcttaggctatcctcccaccttaacctcccacgtagctggtactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagataygtctgtccaagtcctttgccctttttttttttttttgagatggagtctcactctgttgcccaagctgagtgcagtggtgccatctcggcttactgcaacctctgcctcctgggttcacatcattctcctgcctcccgagtagctgggactacaggcgcccaccaccacgcctggctaattttttgtatttttagtagagacggggtttcaccctgttagccaggatggtctcaatctcctgacttcatgatcctcccgcctcagcctcccaaagtactgggattacaggcgtgagccacc

SEQ ID NO: 116849 - DNA, 601 bp, Human
attgcctgtgcctttggtgtcgcatacaagaagcactgccaatgatgtaaagtttttcccctatgtttccttataagacttcatagttttaggactttgacccattttgagtaagtttttgtacacagtgttaggtaagggtctcaacttcattctcttttatacatggttaggtaaggatctcaacttcattctcttgagttaatttttgtgtatggtattaggtaagggtctcaacttcagttatcctggcaccatttgttgaaaatacagcactttccctattgaatggtcttggcaytcttctcaggaatcatttgatcatgtatacaagggtttatttttgggctctctattcaattccattggtctctacatctttatgtcaataccacatagttttgattactgtagcttcgtaataagttggggtttttgtttgtttttcagacattcttactttgttgcccacgctggagtacagtggcattatcactgcttactgccacctcaatctcccaggctcaagcaatcctcccacctcggcttcttgagtagctgggaatagaagtgtgtaccattacacctggccaattatttt

SEQ ID NO: 116850 - DNA, 601 bp, Human
gtataattgacaaattaaaagtgcatatatttaagaacatatttgacctactgtgaaatgattactacaatcaagccaattaacatataccttacatagttgccatgtgtgtgcgtgtgtgtggtcagaatacctaagctatactctcttagcaaattccaagtatagaatatattaactatagtcaccaatctggacattatgtcaagaacttattcatctgataactctatgtttgtacccttcaacatttcctatttcccctactccctgacccctagtaaccacccttctactctcygtttctctgagttcaagctttttagaattccatatgtaactgggatagtgcagtatttgtctttctgtgtctggctatttcacttagcataatatcctccaggttcatctatgttgtcataaattgcatgatttcctgctttttaaaggatgaatatttcattgtgtgtgtgtatatatgtgtgtgtgtgtgtctgtatgtatatgtatgtgatgtgtttatttgggaatttggtgatacacacacacacactattttcttcctttctttttgagacagggtctccatctgtcatccagg

SEQ ID NO: 116851 - DNA, 601 bp, Human
acatcctcaccaacacttgctatcttttgactttttgataatagcgattctaacagttatgaggtgatatctcagtgtggttttcatttgcatttccctgatgataagtgatgttaagcacctttttatatacctgttgaccatctgtatgtcttctttgaataaatgtctattcagtcccttgtccctcttaacaggttattaattgggttattaagtttttttgctagttatatgagttccttatatatattggatattaatagcttatcagatatatggttggaaatattttctcccrctacatgtgctgccttttcattttgttgtttcctttgttgtgcagacacttttttgtttgatgtagttctaatttatttttgcgttttattccttgtgcttttgatgtcacatctaaaaaattgtcacaaaaaccaatggcaaggagcttttccctgttttataggttttatggtttcaggtcatatgtttaaatcttattcacttttctctacagtgtagggtaaggttccaatttaatttttttgcatgtggatatcctggtttcacagtgccatttattcaagagagtaccctttcc

SEQ ID NO: 116852 - DNA, 601 bp, Human
gagccccagatatgggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgktttttttttaggatttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgag

SEQ ID NO: 116853 - DNA, 601 bp, Human
ggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgttttttttttaggayttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgaggatataatggaata

SEQ ID NO: 116854 - DNA, 601 bp, Human
gacttgcatttctgtgatgagagatgttgagcattttttcacatacctgttggccagttgttctattttgcacatttctaaatcagataatctggtgttttttgctgttgaattgtttgaattccttgtatattccggatattaaacccttgtcagatgaatattttctcccattctacaggatatctcttaatagtttattatttccttttatgtgtaggtttttagtttgatacagtcccatttgtctatttttgtttttgttgcctgtgcttataaagtcttacccataaaatcttcrctagacccatatcctgaagggtttcccttctgttttcttctagtactgtttgcttcaggtctcatgtttaagtctctaatcaattttgagttgatttttttatatgctgagagatagtatagtttcattcttctgcatatgatatcctgttttcccaacatgatgtgttcaacatggtgtcctttccccagagtgtgttcttggcacctttgtcaaaaaccagttgtctgtaaataaatttatttacttctgggttctctattctgttccattggtctatatgtctgttttatgcccatt

SEQ ID NO: 116855 - DNA, 601 bp, Human
agtggttgtaaaagataatgccttcttgatttctttctcagctggttctttattggtatatagaaataagcctgatttttaaatcctgtaactgtaatcaatttattgatcagactgaagagttttgatttttgtatttcatggtatgagttgtaatatcccctttttcatttttgattttattcatgtaggtcttctctcttttcttcttggatagtttagccactggttattttgtttcttttcaaaaaccgattttgcatttcattgatcctttatatttatttagtttcttgtttarttctgctctgatcttcgttatttctttccttctactaattttatgtttagtatggtttgttcttgcttttctggttccttcaggtgtatcattagattatttaagatcttttctaccttttttaatggaggcatttattacaataaactttcctcttagcattgcttttgcagtatcccttaagtttcagaatgttgtgcttctattttcacttgtttcagtaaattttttatttctgccttaatttcttctttgacccattggtcattcaggaacatgttaatttccatttatttatac

SEQ ID NO: 116856 - DNA, 601 bp, Human
ctgattattttgtgtgctttcatgaagttgtcctttcacttcttcctgtaagactcccttaagcattttttgtagtgccagtgtagtggcaattaattccctgagcttttacttttaagggaaatactttatttctccttcatttctgacgaatataactttgctaagtacagtattcctggctggcaggtttttggttttgttttttctttcagcactctgcgtatataatcccatcctcctggcctgtaaagtttctgctgaaaaatctgttagtctgcaggttgttcccttgtaagtgtctacaacctcttttatcgctggttttatgattctctctttgtcttgggatgggcaatttgctataatgtgctgtggaaaagacctttctgaattgtatctatttagggttctgagattcctatatttggatctaaatctcttgggagattgggaagtgttcaggtattatttcattaaataggttttataatcttttggtttgctcttcaccttctgggacactgaaggtgtcaccttatggcatcctatagtcacatagcctttgttcattcttttctattttttctatatttttgtc

SEQ ID NO: 116857 - DNA, 601 bp, Human
caccctgtcttgtgtcagtctcacagcacacacagcttaattcaggaattaagctgtgctggtcacttattgagaaagagcttcatggtgggcagctgggaagctgcacagaacactcctcagagttctacaagcggctgagagagctggggtatttatctttcactagtgagtgctgccccggtggtggctcactttccattccttttggcctgccctgtgtgcagctcagcaagtgcctgaagtcagaggtagtgcttatgaaagtatctggtgggcttgcattaagaagctgtcagtktgaagaacgtgaatgctaagggcatatgagtgtgtccctgagaacatggatattgtgttctttacctccatgtctccagtgcctgccacatagcaggtcctccaagatttgctgatctgcctgccccacctggggtctctgtctctcccacagctcactgacattagccacgtggccctctgtttcctgtaataggccatttcctaagtaagcatcatcctcatttctatacgttttctctgattactggaaattcctcaagtgttgaccattttgattcctgggccccttaagagtcca

SEQ ID NO: 116858 - DNA, 601 bp, Human
gcaccagtgtgtctggaaagagctgaatccccacccacccacccccagctcccctccatgctctcctagatgcctgacctggctacgaccacaggtgaaaacagggaagaggtggcagctctggtgactgcctccctgtggtggagaaagcacgccccacagtctccaacacacaagccagcagacaataacctctcctcttgaattggaaaaacaaatctgtggaggccttctctgccccttgttataggggccccatatgccgttcccaggattaaaccaaaaagcacacattcctctytggcaggtgcaggtcccacccactctgggcagccaactgatgtgcacattttaatttcctaaaacaccaggacagaaccttcctcaggggtcaggtggctcacccttggccctcaggctttggagatgggcacttgtcatcatgggtgtttggaaagcaactctacgttctagcctgtgctccatcgttccttctacatacaagtgatgcaaacatcaaaatatgttttttctttcttccttcctttaaaaaaaattgaatcctggatgaagttttagctctgtcacttgacaactgcat

SEQ ID NO: 116859 - DNA, 601 bp, Human
attatgagcagagttactatacacatttatgtacaggtttttgcgaacataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattrtgtatcttttcatgtgcttatttataatccatttttaaaattggattgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctc

SEQ ID NO: 116860 - DNA, 601 bp, Human
acataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattatgtatcttttcatgtgcttatttataatccatttttaaaattggaktgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctcttatgttttcttcaagatattttatggttttatgttttattttaga

SEQ ID NO: 116861 - DNA, 601 bp, Human
aaatccatgcctatatacctagagaaaaatgaaatgagcttatgttacagagtgacaggaacagagtcacagtgacatcccatgtgcataaaagcaactcccacctggcatctgctgctcggatgagcagagagggtgggctagggatctagttggcagttaacactgatgaccttgggggaggaaagccattgtgaatctttgaattattccacttctcacagatgagtacttaatccttttgcaataaaatatttaaatgaagacaaatataagccaagagcaaatactgatagtgtcracagagagtggggagtgataaggatcagtatcctgagctcctgtgtcaaagttgcagaggtgggcccaggaatcataatgtgaagccagctgttggagggactcctgtgcctcattgggggtacaactggttgatgtagcatcgtgttttgaggaaggagttctgtggctgcccccacctcccaggcttgccattcctcatgggtcagaggtcctatcaccccatctttcctgacccactactctgtcaatgtatgagtgtgacaatgtatggtggtgggagctgttgtcccttaccagg

SEQ ID NO: 116862 - DNA, 601 bp, Human
ctgattgtcagggctggagcttccaggcacaagctccactcctcacctggccctgggagctcacaggcctggctccacagcactggcaggttgggtgggaggcctaacgtgctgtccccacactttctcctcagtaaggaagagcccaacactgctggaagtgagcatgccccatttcatgagaaccaacagcttcgccgaggacctggacctggaaggggagactctgctgacacccatcacccacatctcacagtgagtgcctacatgtgcgtgaagggctgggctggaggggactggrgctcaaggagtcagacttggtgctggggaagccttgctctctggccagagtgctatctactcgcctagtgcccaccacttgccgtctgcctggccccaacacggaggcaccaggcaagagaggagagcaagggcacttcccactgagcctgggaacatgatcctcttgttttgacttatggaaaaccagactgatcattttccacttgttttcatgctttgagagtctgagattgtttttctctcccccagccccctcccctgccccccaaaaaagagacgactttgttttttagcattt

SEQ ID NO: 116863 - DNA, 601 bp, Human
acacattttgtttccatctcgagctctccccgcccgcagggccccagagaggtgaggtcactatagccttgattacgggaaggtccctggggctgggcgaagctcctctttccggggcctgttagccagaggtggggtggggggtgagcaggcctgatgcaagctagggagtcatgacaagctgaggcacggggtacccaggagataaagagtggcgtcgctgcaccccagcctataggtgggccctactgctcagcctcaggaccctcaaccagctctgggcggccaggactcagcctcraacacacctttcaggcagaagctgtcttcctaggttgaatggggcacaagagagtccctgccagcctcaaactccctgagcctgtgtctcccacccagaaccatatgacagggcttctgagagaaaggtgggaagtagagactgtaggcctgcatgggcagttggggagcacccccatgacaagaggagccctgtaccccaagagccaggatgagttcctgggattctgacccactcactatcctctgctcaccaagggtcactggcacgacagtgggtggggacggtgccatgcctgtg

SEQ ID NO: 116864 - DNA, 601 bp, Human
ctgcatgagtcataggatccccgtcagagccccacatagccccagccaggctcaaacccgtctctgaaatgcacggggggattaaatgttcttctaattaaattaaaaccgaggcgtaatggctcagtgggaaagagatgggattgggaatcagatgccctcaatctggcttccagcctgccatcagcccagctgtggcggccccccgtggccccctaacctttccaaacttcacttcctccgtctgagcacgtgaggaagaagcggctggcctagggctgctgctatggggagagggccrcactgtctaggtggatggcccagaagaaagcagtgaggcttctcatttcctctgcaagggaaaggccatccaaatcaccctgccccagtgcactctggccaggctcagccctctccacttgtgaactcccagccatgatgctgctcaggtcctcagccaagcagatggtgttggaggatgtgacagagagaacattcacgccacagaggtggctggagggcaaaggacttcacaactgcactgatattgtcatggagacacttctggcagttggggcagggggtcggggcggggttgggc

SEQ ID NO: 116865 - DNA, 601 bp, Human
gggcagggggtcggggcggggttgggcggggggcacatcccatatagatctcttgtgtgctctgctgatacctgaaaggggagattgaactgcagagcctctggaggctgaagcacggaggtgacctagtcaggaagtctggaagccgtgtccccttaagtgagggagtgggatggggctgggcctagcggccctgaaggccagggctatccacctaattaggctcacctgggctaccctggtatagggtggtggtgttaaacttttagttaaagggtaatgtgcatgcacacagattagyacacaggtctcaagtgcgcagcttgaggcatcttcagtccctgggacccatgtgtgcagcacccggaggaagcaacagaacccccagaaagcctctcaggctcccatttcctgtcactgaccttgagattaaccacaggcctaactgctagcagcaaggaccagctttgcccacatttgaactttatgcggtgggaatgatgcaactcatacacctttgtgtccaatgtccctcactcaatttgatgtctggcagcctctctatggggctgaagggagagtgctccctcatgctccttgc

SEQ ID NO: 116866 - DNA, 601 bp, Human
tcttgatggtgtcttttgatgaacagaaggtcttaattttcatgtggtccagttaatcaaacatttcctctctggatagggctgtttgtgtcctatttaagaaactttgactactccaaggtcataaagatattctggtttattctaaagctttattagctcacctttcccatgtagatctgcactccatctgggattgatttttgtgtccaatgtgaggccgaggtcaaggtccactcttcccctacttggatatccagtctagctcagcacccggcatgggaaggcccgtcctctcccmactaccctgccgtatcagtgtctttacaatcagctcactggctacgtgtggctctgtttctggaccctattgggtgccactggtcagattcaagttgttctttgtggccaggaccttgcttccttctcactgtagtttgctaacaggttttgacagctggtcctgctggctctggctgcttctccttccccatcactggctttgctgtctttgcagggtttctcctcaccatacatatgccagttgccatggaaagcctcctctaggcgcagcagcctctagatgggcatgggagaatgg

SEQ ID NO: 116867 - DNA, 601 bp, Human
gtggagggaagggaagtctagaggtccccaagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacrtgacgggcgagggaagaggaccatggtagcttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaagg

SEQ ID NO: 116868 - DNA, 601 bp, Human
aagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacatgacgggcgagggaagaggaccatggtarcttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaaggatagggacttgccagtatcactgggagat

SEQ ID NO: 116869 - DNA, 601 bp, Human
agggaacagtctgcagatattatctgggcactggccagtggctcttgtggctgccctctgcaataagaattcttcaagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaaygtaggtgtcctgggcaggggctgtatctgaggcacacatccttggtagtgactggctagcaggaggaagtctggcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagagg

SEQ ID NO: 116870 - DNA, 601 bp, Human
caagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaatgtaggtgtcctgggcaggggctgtatctgaggcacacatccttggtagtgactggctagcaggaggaagtctgacagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagaggctccctctgaagatgacactgggaatatcctgaaaaaggtacaggaacacctggcatgcctctcccagggtact

SEQ ID NO: 116871 - DNA, 601 bp, Human
ccagagcccctggctaggcattcatgctttagatatgtgggccctgttagggacaatgtaggtgtcctgggcaggggctgtatctgaggcacacatccttggtagtgactggctagcaggaggaagtctggcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttrgcctctgatcttctccataagtaatcttttcccatgtgtggctgcagcctcagaggctccctctgaagatgacactgggaatatcctgaaaaaggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagca

SEQ ID NO: 116872 - DNA, 601 bp, Human
ggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagcatttatacaagatcagactgcactgcaccctaagtataaaccttgccacagcagtgtcctgtggtgccctgctggggaaactgaggcagagagcagggtgactttgcaaggcaatagagggtacttgggaagtagggtggtaggcaaggcttttcagagaacaaggagctacatacacatacatgcatgcacataatcattctgacccagtcagggttcttcccccaaataaatccctgcaaccccactgtggttataggtctgagccttctgccccagggagccaagccctggagaggaggtgggcagcaccaggcagccagcctgtgggccccgctatgcttcctcaggcagctagtctctgtatctggggtagaaagagtgggctaaaaagt

SEQ ID NO: 116873 - DNA, 601 bp, Human
cacagtaggccttcacggtactcagcaggagaccccagcaggcagcatcagggcaggggtgctgaccatccctgacccaagcacgaggatcagaatgggccctggagccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagmtccccttggcctttgtttagcccaccttctgcctaggcaccaggcctggaggttccaacttggtgttgggcctccttgagccggaacacctgaaaagccatacagactcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttc

SEQ ID NO: 116874 - DNA, 601 bp, Human
agccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagatccccttggcctttgtttagcccaccttctgcctaggcaccaggcctggaggttccaacttggtgttgggcctccttgagccggaacacctgaaaagccatacaractcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctc

SEQ ID NO: 116875 - DNA, 601 bp, Human
ttgtaaaattttggtctccgttttcagtggatttactttaagagatcctccctttccccccatttccagcaggattaaaatgttcatttatgttgtgatagatactgccaaataagggctgtaccatttacatcactttgactgcacaaatgcactttcttcccccacccttaccaagtgtatactcaggtttttatcttcattcatttcatagatgagaaatggtacactggagctttaatttacatttcttttgttggaaatgaggtttttatctttccaaatgcttaaaatcatttgttttttctttcttgtgaactatttcttcataccctttggactttgtaaaataccttgtcttactgatttgtagaaacttgctttgtcatattcattgaaaatattttatcctcattttccttaggtgttttggctttttctataatatttttctggtggcagaatttttttaatttcacatagtcagctgtgtcagtcttttatggtttgaggtccttatcttaaattctgaaataacctctcatcctgaaattgttttaataaattcttccatgttttcttctatcattttttatttcat

SEQ ID NO: 116876 - DNA, 601 bp, Human
tgaccttctctccccttccccaggccaggactgtcttatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgactagtgagtgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttgaccagaatatctctagtcataaagaatctcttccccttgagcccactcatctctgttgacattctagaaa

SEQ ID NO: 116877 - DNA, 601 bp, Human
ctcagtcatccctgcttccccagggctcatgtccacatgctattgtccatagaagctggggtccaaagttgaccagaatatctctagtcataaagaatctcttccccttgagcccactcatctctgttgacattctagaaatgcagggaaatctgggcaccatgaaatgcagtgacttgcagtgatcctcctggggccttgtatagaagagaccatctcagttttgtagaccaggaaactgaggcttggggatagcagatgttcccagacagaaaatggtggcacctggagaggtgctcargtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggaggtgtggggatgggctagcattaggaatgggtattagcatctgcattaaaaggctcccactgacagctcatgcattgtgatggaactagaggtgagatac

SEQ ID NO: 116878 - DNA, 601 bp, Human
tatagaagagaccatctcagttttgtagaccaggaaactgaggcttggggatagcagatgttcccagacagaaaatggtggcacctggagaggtgctcaggtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggaggtgtggggatgggctagcattaggaatgggtattagcatctgcattaaaaggctcccactgacagctcatgcattgtgatggaactagaggtgagatacagagcaggagtccatggcacctccagaacctgtcagcctgagtatgggcaatggcgttttagtttgcaaaaccagacacatagaggccaggtttcccccgctcaacactaggccactgtgcctgccactgctgtctgcaaatgcaggttcctggggctctgggtggtttgtccaatggctaagctttccccaggaatgggt

SEQ ID NO: 116879 - DNA, 601 bp, Human
gaacatcccttactttcccatctcaatacaactgtgaaaagcctagcctgggactcaggcctttccttactccctctggttacctagctttagctctgaggcagcccagatgacatgggcctctaaggctggctgctcttactctataccccaaaatcccagccactagcttgcagaatggctttgttggattcccctccctggccccacactcactgctacatctctcttccaaatcataaatgcaaaagatggccaaaggtgcatgctctgtgacacgtttcatagtcagacaaaaccrgctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagtttcttaaggggaccgtttcccttgaagaatggggtacaccagaggacttaggaagagaagcgcccactggggcttggtcagactctgccaggagacaggcagctgtctgttaactgaccctacccagtacct

SEQ ID NO: 116880 - DNA, 601 bp, Human
gcttgcagaatggctttgttggattcccctccctggccccacactcactgctacatctctcttccaaatcataaatgcaaaagatggccaaaggtgcatgctctgtgacacgtttcatagtcagacaaaaccggctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagwttcttaaggggaccgtttcccttgaagaatggggtacaccagaggacttaggaagagaagcgcccactggggcttggtcagactctgccaggagacaggcagctgtctgttaactgaccctacccagtaccttctgggattggattaacaaaaggggagttggttaggctggagcattgcaactcatttcttccctgcagtctctctcctgaggtggcccaggtatgtgtttgaggcctgggacttgctgccagcatgagacaagctccagtggggtccatccccctgattcctcagtgc

SEQ ID NO: 116881 - DNA, 601 bp, Human
ggcacattccaaggcttgaggtctcctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaagggscccttttggcacggggggtctgacggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtg

SEQ ID NO: 116882 - DNA, 601 bp, Human
cctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaagggccccttttggcacggggggtctgayggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtgtttccatgggtctccttcacatag

SEQ ID NO: 116883 - DNA, 601 bp, Human
caaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttcyagattctcaaggatccgggtattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaa

SEQ ID NO: 116884 - DNA, 601 bp, Human
tattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaaggttcccacctgctccaacytctggtactcccaggctgcctcacccaacgatgacagtgactagcctcagagcctggctgcttggaagacctttgcccaagcagagaactgttgaggaaggtgagccttccgagggccagccctgcctctcctcccctctcctagcctgcttctgtctgggctgaaggcacagcagggacaatcgctcttccggggttagaactgggggagcagggacaaaaagcgggcagccctccccagcatgacaggatgtggaaggctggtctctccagagactgggctaaactctgctgtgtcaa

SEQ ID NO: 116885 - DNA, 601 bp, Human
tagcccactctactgaaggcccctgtcctttcagtgtcacccatcctttcagtggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagamatcctttcaaagtttagagacctgtgggtcttgcttaatcctgcagctgcctttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggc

SEQ ID NO: 116886 - DNA, 601 bp, Human
tggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagaaatcctttcaaagtttagagacctgtgggtcttgcttaatcctgcagctgccyttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggcaggtccctgctcctatcaaatccctccctctgggccagggtctagtacctgc

SEQ ID NO: 116887 - DNA, 601 bp, Human
cagacccttttctgagaggaccacaagtcatagcccagggctacctgtacagctaccaggcttaacaactcagatgcacaccctccacaactgctcttagcacccacaggcctgggccctctctccctgccctgaagccaaccagaccctgggtgggggccgagtctggccaagcagcagtgtgtggagctgggcctgggcctaagctgggaataagcttgttttgccaggcgctggccccccatcgagtccccattctctaatgctaattgctacaattagcaggagaaaggccttttakatccatttcttctcctggctgaggcccgggctgctagggaggttgagcccaaggcttttcggaggagcagggattcttccataaatgaggccacatttaaattgcaaacaagagcttcgcccagccgtaggaaaggctctgggagaaaggcttttagttccgcagacagagcagccagagactgggtgcgctccagcctcatgggccttcctggctggtgtgactggaaccctgggttatacaggctcctgccagtaacctggacatgctggggccggccagttcagaggagcatggcac

SEQ ID NO: 116888 - DNA, 601 bp, Human
aagccacaggtgcccatgccatagatggctgagggacggcagctgacacgtagttccaactaaacctctgggtggcagcccataggttgtgggactggaagtgcttgccaaacaaattatactgctgaccagggaagagggtactctgattggccaggcctgggccagggtctttctcaccgaggtggtgaggctataggtgttagatgtggcaggatgcaagccagggcctgctgcctttaaagagccacagcagagacaccatcccagtcccaagagctgttctaaggaagtggttgtcatctgcggtgccccccaggggacatatggcaatgtctggagatatttttggctatcatgactatgggagaattactaatatcaactaggtagagaccaggcagggtgctaaacatcttacaatataaatgacagcccctcacaacaaagatacatcctgtcccaagcattaccagtgtggctggctaagaaaccctggttgcaaggggtcagattttgacatgctatttgctttctcactgagttgtgaaaatggaggcacactttcctggcctggcctcttccttcgttcaataaatga

SEQ ID NO: 116889 - DNA, 601 bp, Human
ggccttatcctactttctaatgcttctcctatgaagaatagctgttgctttcatttacatttctctgataactgattagcttgggcaaattttcatctgtttgttaaccctcctgcaaactggcaatcttcctacctttttcttaatgatttgtggtgctttctggtatattttagctgttgttccctcctcagctttaattgtttcaaatatcttgtaatgagtcatggcaaagttacattcatgagtgtaaaagtgaaaaacgcaaattgtttccttagtattattatgaaaacagtcytgacccttgccatgatggatttatttaacagaaatccttaatccataatcattaatgcattcaagttcatacattttagtcttgaggtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtcc

SEQ ID NO: 116890 - DNA, 601 bp, Human
gtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtccccactgatatgtggtgccacctttatcacatgtccccttcctctagacttggagttacctctgagctctcttctgggcctctgtcaycacaccgctctgattgctgaagttggcgtgtgccctggtatctgccagcagaagtcctctgctctccttttcaaaagttcagttggcatttacaaatatttttcttccacatacattttagaatatgtttgttaaattactcaagccctccaactggaagtttgagtggagtcctgttgaacttaacagatttggaaaatcctgacgtcattctaatgccaagttgccctgttcaagaaaataaaatgtctctgcatatggaaagatctccctctatatcctccaatagagttttaaaat

SEQ ID NO: 116891 - DNA, 601 bp, Human
agtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacaccaaaatgtttgagaayctttatggagaccatcaaccctatgagctacactaagttttatcacttcctacctgatcctcacatccccatttctttttcttgtattagggtatggccaggatgacatccttggcctactccttatcttaaagagaatgatacacttttaatttctctatcaagtttactgaaaagttaagttttggtttataacttgtatcaagttgaagaagttcctctctagtcctggcttgctaagtggtgtactccactaccccaaaatcacacataggcgttaaactttatcacatcattttt

SEQ ID NO: 116892 - DNA, 601 bp, Human
tgattcgcaattttaaaaaatccctctagctggagcataaatcctgaaacagacccacttttctcctcagcatgttaggaaacacattaaaatacacccataatcaagcaactcaatccttaaatttttctcctactgagtatctggaaaacaggtgcagaaatggatcatttgagacaccatagaaatctggttaatcctgcctgcctgctttccttcaagtactgactgagtaaggctgtgtatcaggctcttggctgggtacagagcaggcagcagaaaacaaaacagagttcctcgytgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagactgcatctgatcaac

SEQ ID NO: 116893 - DNA, 601 bp, Human
aacagagttcctcgctgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagactgcatctgatcaactctcatctccaatatgaccaagagacttctaccactacctctcacctggcaggtgatcaccacccccaactcagactgcaacctttacttcgccccctaattcctgactcagaatccccacctagaggcagaacttcgacttcaattcctgactcccataccccactgagacctctaaccccaatcccaatctcttaactcagagccccccattcagaacctctacccaaagacagactccagaccctgactccagtcgccaactcggacctcccttggatctcaa

SEQ ID NO: 116894 - DNA, 601 bp, Human
caggccttcagcaacgacgcccagatgagtccactccctgcctcctgctcagcccacaggcaatctgggcacaagtgacacatcccctgggcgcctgtcccttcgcactggcccagggagttcatgtgtctgatcagagggcgcagtccaccctcactatctagctgggaagtttttgtcatctgcctgtccgagaggcagctgtgcaaccagtgccatcactcagagccagtgctcaggtgcaccccagactcagggtttcacgctataatgtcactgtcttgaaattcttgatagttaytatctttgaacttgtgttttagaagtgaagtctgaggggaaaatggagcttggaacttcagctcccaagtggctttcccaccttcctgcctcctcaggacagattatcagctgcctgtctgcctgcttcctctgtgcccagcctctctcttgacatccaaaggatcacaactcccactcagtgaccactattattctctgcccctgaccaaaaagagcagggcagggctggagtcctgaccctggcctggactctgcaatgcagagatacctgcaagtctcatttccccgcctgtaggat

SEQ ID NO: 116895 - DNA, 601 bp, Human
tcatttatatagattttcatgttctgggcttgcctccaccctctacctaaccctggaacctcagaccccaagctcctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgcygtcaatcagccagcgccgcctgccagcccagcgcacctgttgtgtgcccccactcccgcctcctctagtcctttgggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagct

SEQ ID NO: 116896 - DNA, 601 bp, Human
cctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgctgtcaatcagccagcgccgcctgccagcccagcgcacctgttgtgtgcccccactcccgcctcctctagtccttygggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggac

SEQ ID NO: 116897 - DNA, 601 bp, Human
cacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgctgtcaatcagccagcgccgcctgccagcccagcgcacctgttgtgtgcccccactcccgcctcctctagtcctttgggggaagagtggagaggaaaacaggccgagactgagaggggtttgttgtctcrtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggactcaaggctgcaggggtgggtgtgagacagagagcctgggcacctggtggccact

SEQ ID NO: 116898 - DNA, 601 bp, Human
ccatgtccttgttccagaatcttccgcctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggmacagtggggagtctctaggaggttttcggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtag

SEQ ID NO: 116899 - DNA, 601 bp, Human
ctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggaacagtggggagtctctaggaggttttsggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagc

SEQ ID NO: 116900 - DNA, 601 bp, Human
gagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagcgagcccaagggaaggacgggtttggagggtttctgaagatctggcttggatatagtggggtcagaccctatccctccacccagctgcagtgacaactctgtggctctggggcactgtcaccctgtggcatggcctgtttgtggtgtccattgcygtcttagctacccaaggcccagggagaggcacacggctcaggctgacagagtgtgacagatgcaggtcctgctccctcagggaatcccccattccaggacagtctcagcccccatgcaagagcagcctcagcatgggctgctcggggaatgccctcagacaacagtgctgtgttagggtcactcccagcctgtcctcacaggcagatttgcgttcctgcatttggggtcagtgataacgtgaggccagacgggtggggggtctggagttcaggcggtctccatgagtggcagcacggggt

SEQ ID NO: 116901 - DNA, 601 bp, Human
ccctcagcctgccagggaaaagtgggcccaggcctttgaggacattgccacagccagggccaacctgggaagttgtttctgattatctcttgagtcctgggagaggtgttaacaaaaagccccatccctgtcgctctggtggttatagtttgttttacgcattaaaaggccctggatcggtatttgtagtgagaacagatatttgcagagagcctactccattcccagctctgtacttgtagagggtgaggctgctgaaatgaaacccaccaggcctctggtgagcagtgggtgcagagtyattggcagtaaaggtccttagagaacctgaagagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcag

SEQ ID NO: 116902 - DNA, 601 bp, Human
gagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcagcctccctgccctctcactgggatcactgattytgggggaagccagccaccatggtgtgaggacactagcagccctctggagaggtcctgtggtgaggaactgaggcctcctataaatggcctcctgtatgagcttgggagtggatcctccagccccagtcaaacctctgatgagacagcagccctggtctacaccttgactgcagcctcacaggagatcagaaccacccagccaagccacccccagatccctcgcccacagaaaccatgtgggatgataaatgtgggctgctttaggaatgaagctgtagggtgacttgtcacacagcaaag

SEQ ID NO: 116903 - DNA, 601 bp, Human
ttttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttgsggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgagg

SEQ ID NO: 116904 - DNA, 601 bp, Human
tttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttggkgggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggg

SEQ ID NO: 116905 - DNA, 601 bp, Human
tctgctctggtgctacggtcctgcagggctgtttttttttattttgtattttttggtgttcatttttgtttttgtaacagctttattaagataaaattcacataccatacaattcacccatttaaagtgtacgattcaacggtttttagtacgttcagagttgcgcaaccatcacactatctagttccagaacattttcagtgcccctaaaagcaaccctgcattctttagccgtcactccccacttcccttctctcattccccagccccagtcagccacggctctgctttctatctccaygggtttgcctgttctgaacatttcacatagctggaatcacacactaagcagacttttgtggctgacttctttcacttagcctaaggttttcgaggttcattcatgctgtagcatgtatcagtgtttcattcctttttagggccaaataatatgccattttatggatattatcacattttatttatccattcattcattgaacacttgggccatttttactttttagctattagtgaataatactgccaggaacatttgggtacgagtttttattgtggacatagattttcatttttcttg

SEQ ID NO: 116906 - DNA, 601 bp, Human
ccatcctccagcccatctcccttggagtctctccccgactccagggctcatggcccctttcaggcccttggcttctggtaatgcttctttgtggtctcctgtcttgcgcactaattgttgcccaagtctttgcacatcctgcatcctgcctggagtgttctctctcctcccttttctgtgagccgtcatgaaacacctcctgtgggcttactgagccaccatcttatccaagtgctctgtggcagcttgtggaatcttctcaaccttgggtgtcgcctgcccagaacggggctctcggagrccagggtgactccactatcccaccaacctctgtaccccacggccatgcacaaggcacagggtcccacagagggtctgtgggtacaatggagctatttcccagtcagacctcacaatcggtaaactgtgcttaaactaagtgaggtatcttaaggctttaccaccagggaaatagaactttggcagcttacaaaggagttttatttttcaaatttcctttcaactcgagggtctcaaatccactcagcagacttaggagggagggtcctggcactgcttctgaggagggtgcctttgaggg

SEQ ID NO: 116907 - DNA, 601 bp, Human
ggctggggtgcaaatggggcaggaacaggagtccggcctgggggatgttagactcaccagccatcccctggaaagctgtggggagactcagagcagagcccccagtaatcatagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggccyccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccacctccctccaaggcagttgtcagagcaagatcagctccctggaagacacccgggttgtaaacaggg

SEQ ID NO: 116908 - DNA, 601 bp, Human
tagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcrctttttctgcacgggactccctcacagcctctgggttgggagcacacatggcatctcctagagagtttgggggctggacacagggaggaggcagcatgggaaatggaaggactgcagcccccacctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaat

SEQ ID NO: 116909 - DNA, 601 bp, Human
tggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccrcctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaattaacaactttgtgaagcatttggtatttgggggattttacattagggttaatgagcctctgaaatgagatcccggagaggggccaggaccatgcctgggatgtggcttccgtggactgagcag

SEQ ID NO: 116910 - DNA, 601 bp, Human
gcgccttggggcacccaggcctgcagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccstcccaggcccgtgagaggcagcgggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggcca

SEQ ID NO: 116911 - DNA, 601 bp, Human
cagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccctcccaggcccgtgagaggcagcrggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggccaggcttcacagaggtggaatctca

SEQ ID NO: 116912 - DNA, 601 bp, Human
cccagggctgggcacagggctgtgacgccataggtgctctagatagatggaggagctcacagctgcagggagtgttgggtggacatatggggtgtggggggcgaggccaggcttcacagaggtggaatctcaaaggaggaagcggcatgccaggtggcggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttcmaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccgggggggagcctgcaggaggggcctagccagggccaggtgtcacacaagcagagctccagggtgcagctgggcagattgccggtggttggtgctggtgaggagtagcagggtggggtccggcggtaatgccactgatgatactt

SEQ ID NO: 116913 - DNA, 601 bp, Human
cggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttcaaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccrggggggagcctgcaggaggggcctagccagggccaggtgtcacacaagcagagctccagggtgcagctgggcagattgccggtggttggtgctggtgaggagtagcagggtggggtccggcggtaatgccactgatgatacttggcgaggatgaccgcaagtgtcttgacccaaacatgagatgcccctcacccatcctcccatgaacctcagcatgggcaccccatgccacccgctccatttacagccaaggagcctcagtagagacacagctagaaagtggccagctggggtttggtg

SEQ ID NO: 116914 - DNA, 601 bp, Human
tctggagagctcaagggaacctgtaaagacctgcgggctgtgtcatggagggcccttaccccggaggagccaggaaggtggacagagcaggcaggagtggggcaggagggggctttgcagattacccagaccctttgttggccagtgtgggaatggggggaggccagggaggaccccctgcagcctggctcaggcaggggcatgtgtgaaggcccagggggaagagagcagccaggtagacttcgtttccagccggagtgtacctggggatgcctgtgcccaagccttcctcttccaccayccctgctggggtcccctgggacccatccttccaagcccctgccagccttggaacctgtgactccccaggtggtcaaacacagaaggacctcttgggggaaggggaaccagcaaagggggtatggggagccctctggggcaccctcatatcacaccctgtccctctggccacattccagctggccctgcctgtgagggttgaccagctggagcagccccgcatcccacatccccgcagccttgcgctggtctaaatgcctcccagcctcctgaggttgagggtggccacaccagccagagc

SEQ ID NO: 116915 - DNA, 601 bp, Human
cagaaggacctcttgggggaaggggaaccagcaaagggggtatggggagccctctggggcaccctcatatcacaccctgtccctctggccacattccagctggccctgcctgtgagggttgaccagctggagcagccccgcatcccacatccccgcagccttgcgctggtctaaatgcctcccagcctcctgaggttgagggtggccacaccagccagagcttgggtgattgagtgggtagagggggtggccagagtgggaaccatggtgatgcaaaccataaacctgtcccccacgtcacctccaaaccctttgggctggcctcttggtgaggaatggccctgggagaggctgccctgcctttgacctctcatgcactgagagtaatgggcaagcgctgtctgcagagcactgaccccaccgccggggtcggagcccctattcctagcctcccttgagcgttttggttgccggatcctcattaatggctgtttgtatcacttaacaatttttcacttttggaggggtcgtgaataaccccaaagcaacatgtaccctctccgggccaggctcaagcggtcctctcactagggaaagaagt

SEQ ID NO: 116916 - DNA, 601 bp, Human
aagtcttccttcctactcctggcagggcaggcaattccactgatggctgcagtgcgacacagactgggcctggcatggtgtccctcagaccccacggcttggtcgggtcacctgggccatttcaaaggctgttggggagcaggaatcacaagctggatgtcagcttgagggttaccccagagtgagagcctcgacagccaggccctcccaggcttctgtgatcgcagcccacacctctgcgcacagtatgccaatgttccccaaaatctacatactgagaaggtagacagcaaagccacarggagacttctgggtagcccaggtggaattcttccctccctgtttcccagttttccacccttttccctggctttcttccagaaccttttaatgaaagtgcctctgccccaccagggcctggcttaggatgggtgagggagaggagctccgggaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcagga

SEQ ID NO: 116917 - DNA, 601 bp, Human
gaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggyctccaggtttgagccccccggggtattagcccagcattttaggggctgccgtggtcatggagtaaagaccacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagagg

SEQ ID NO: 116918 - DNA, 601 bp, Human
ggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggtctccaggtttgagccccccggggtattagcccagcattttaggggctgccgtggtcatggagtaaagacyacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagaggccctcccctgacagctgccttcctctgctccgtccttccccacatccccctcacacaccttgtgcttgct

SEQ ID NO: 116919 - DNA, 601 bp, Human
ttactgtccgtgtccctccatgccagctcactggaggggctcctgctgaaagaggtggggttcagttcccaaacccactggagggttgcaaggagacgcttctagtatgttagacagcacagtcttccaaatggactgtgggcatgatggatgtgtaaagaatcgagaagccaagtgcccttgccatttgttatctttaaaaagtatcggtgggctcatgggggcttgagtgtcctggcagctctcctcatccatcctatgtgtacactcaggcacgtactccctggctcagccgccttcyggggcccggctacagtcaggcctccttcgtgctgagcatgtgctggccctgcctggggacagctgaaggccaggaggaagctgctggcctcaagaaggcctctcgaagcagaggcagccccctcgaagctcacctggcctctctctgtaaggggagagggacccagggctgaccagagcaagcagtgtgccattaacccctacctgtccagaactctgagctcctgtgggtccttctctgagtgtcctatgttgggggtgtcagcctgggtgtcaaggctgaagaggggagcctccttgg

SEQ ID NO: 116920 - DNA, 601 bp, Human
tgggggcctgtctcatgttttccattctggacgccggggggacatgttgctggggccagaccaactccagggagacaactcgacaagttacgaaacatccagcagcatccacgactaatttcttccccctgtttgtcctaccgtggaggtcgagttaaaaggcagcacttcgggggttgaaaagctacccgcaggggtctgctcgtgagggacccccgggcctctgcagcctttgttcagaggcagctaataagccgactcccgctgggcgctttgtagcgaggccgctgttcccagtccyagctcagcctccctgcctcagagggctggcagatcagcaaattgctgtctccagctcgcaagaggggcaggtccagggatgtgtttcacccccaaggtgtgagtggaatcagcaaattgtatcaagaaatatttctagggatttacattccggcggtcagcagcctttgggaggctttactccgcctgcaggggtgggaggcctcgcgtagagttggtgggggcagcagagcctgggtgtttcaggaggacccactcactctgggccacttctgatgctgcagatcacgccaggcaggcc

SEQ ID NO: 116921 - DNA, 601 bp, Human
ttcaggaggacccactcactctgggccacttctgatgctgcagatcacgccaggcaggcctccggccgtttgtctcttccgacagcagcggtggtgatggtcccctcggcctgcctggcctgcagcagccctggctggaggctgaccgagcctccgaggaggttcacctggagctgtctgtccatccatccatctgtcccttggcccctttaagaggccttgtcccctttgccagtgcagggagaccccaccgtggacttctcattgggacttccagtgagacccaactccactgcctggrgataccctcaccccaagcccaaggagcctgtccctacgcacaccccctgcccctgggaggcacatgccgagctttcctgtcctccatttggtggccgcctcacctccatggggtcgcagggcccacacagacagcctactatggtcctggcaggcacagggtatgggaagccctgtgcccctgggatcaagcttggatcctgaggtcctgagcttggtgagtcagggctggggagccacaaagccagcatgctcctgccttttgggggtcccaggtgatgtgtcatcttaccaggtgttg

SEQ ID NO: 116922 - DNA, 601 bp, Human
caggctaaagacccctgatttcttcatgaattccagagcacttggttcactccggcagagaaggggccccaggcagccatgcatacagagccacctctgcgtgggtgaagggctggggacggcctcttgggagcccactaaggaggaccacctgcctgctccaggcagattgcttccagctggccagggcagaggagcaggccaagggtgggtcccgggcagtggcccagagaagctgagctcgctcacgagatgtgtgctgacgtggcaagatgggcgggagtcttcatgaaggagtggytgcctggccccctgacctgaggatcctagggcccctggatgggtttgggggaactgcagcatcctcagatcacagacggtgtgtcgagtgagggtggtgctcttcctgggccagcagtaggtttccaaaagggcacagacacagctcaggagatggatgctgccctgtcagagtggggaaactgaggccccaggcggagacaccacccactgcaggttccagccgtcccccaccccacccctgccccaccatggctgatgtgagggaggtggccagaagtccagagggacactgggtggg

SEQ ID NO: 116923 - DNA, 601 bp, Human
gggcgccaggtctgcccttccagaggcccctcccaagtagctcccagcagaacacttgaagcccaaaagcagtgagaaagggaacacatttgcctccaatcctgactctccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagayttcaggaaggagcagccatggggcagtggggctctggagcaacagaggcctcaaaagctcagcgtctacagatgttagggacaaggaggcagcttgggggatgtgctcgggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgca

SEQ ID NO: 116924 - DNA, 601 bp, Human
ccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagacttcaggaaggagcagccatggggcagtggggctctggagcaacagaggcctcaaaagctcagcgtctacagatgttagggacaaggaggcagcttgggggatgtgctcrggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgcaggaacatggggtagtgtccctgggggaaatcctaccccagactcgaggaataaagaggaggaggaggttgcctgagcttaacagaatgatggctgtctgacatgaggct

SEQ ID NO: 116925 - DNA, 601 bp, Human
ggaataaagaggaggaggaggttgcctgagcttaacagaatgatggctgtctgacatgaggctcacaactggccccagcagctccacggcagggagcaggagcagacaccccggatccgctctcctccctccttgcctcctgccaggggtccagttggctagacccaatctgaagccctgggccaggagcttgtggacataacctgcagagatcagcctcctagggcagagtgagctgaatggagaagggctgtatgcagaagggcgagcagacagagcccaggattccacaacggtgtcratgtacaacaccaagcacctggcctggtgtgggctcgtcttgcactatgaaggggcagggacgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtcc

SEQ ID NO: 116926 - DNA, 601 bp, Human
acgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtccttcagctccttccagagtgttcttgcccagggcctttgcacaaatcccttccaggacttcygatggttctgtcctcccctcacacaggcctcacctcttttgccccctccacctctggagcggccactcgcccacccttctgccctgacttctctgtggcttcccaaggctcttcctggcacctcgtagggtaagtccgaccccaggtggctgtgctctgaggccagggccaggactcttgttcacagtgctatgcctgacccggcgccagccctcaggggaccacagccggctgaacgccaactggttagctgctttttctataggacctaccgagcgtttgactctagaaccgggggtt

SEQ ID NO: 116927 - DNA, 601 bp, Human
ggcatggggttctgctggcccagagtgccagggggacaggaagtccctgagggctccagctgcaggaggagcatctcaggaggagctgaggccggagcagagcgtcctcctggtcctggcagcccttggcccctcagcaccccagagggccggccgcagtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctagggccatgctgtgggctcgagtgactgccctg

SEQ ID NO: 116928 - DNA, 601 bp, Human
agtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctstcccggggccgagggtccagacctgttgccgagaagctgcttagcaaggcctaggggcaagggctggtctggcctagctctttctcccttgagccccctgccacagggctagggccatgctgtgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctg

SEQ ID NO: 116929 - DNA, 601 bp, Human
ggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctarggccatgctgtgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatatgaaattccaaagggatgtccaccaatgggagacgtataagggctctgcatccatggattcaaccaactgt

SEQ ID NO: 116930 - DNA, 601 bp, Human
ctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctagggccatgctgygggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatatgaaattccaaagggatgtccaccaatgggagacgtataagggctctgcatccatggattcaaccaactgtggatggaaaat

SEQ ID NO: 116931 - DNA, 601 bp, Human
gcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctagggccatgctgtgggctcgagtgactgccctggacgtgacaaatctctgtgcctcggtgcccacacctatayaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatatgaaattccaaagggatgtccaccaatgggagacgtataagggctctgcatccatggattcaaccaactgtggatggaaaatgtttggaaagaaagttgcatctgtgctgaacatctgaacttgtacaggctttttgtcttg

SEQ ID NO: 116932 - DNA, 601 bp, Human
tagcaaggcctaggggcaagggctggtctggcctagctctttctcccttgagccccctgccacagggctagggccatgctgtgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgataygaaattccaaagggatgtccaccaatgggagacgtataagggctctgcatccatggattcaaccaactgtggatggaaaatgtttggaaagaaagttgcatctgtgctgaacatctgaacttgtacaggctttttgtcttgtcgttattccctaaacaatagagtgggtcacgcagcatttgtgttgttaggtatcgtaagtggtctggagatgggaggatgtatgtggcctccatgtcagtatcacaccatttcgtatcgggggcttgagtacctgtggatttgggtacctgcgggagg

SEQ ID NO: 116933 - DNA, 601 bp, Human
ccaagaatggaccactgaggggctgggacagacctggcagaccaggagggaggccactgcactagtccaggcggaggatggcagctggaccaggagggcgaggaggaagtagtagattcaggactgttttgagagggaccattttagcttcttacggctgctgtaatgaattcccacaaacttagtggctttaagtgacacgtttattatctaacagctctggaggtcagatgtccgacatgggctacattcaaggagccagcagagctggttcccactggaagctcaaagggaggccccrcctcccttggcttgtggcctttccccacggcccccttgtctctgcttctgtcctgcgctcttcacaacctcccttcctccctctttctcttatggggagtgcaggggtgatctggaggagccggtcaatagcagcgtggtggggtctggcagagacagactgcagggggcctgggaggccccaggaggcaggtggactttgtccctaggcatccagtgcagaggtgagacctgtatggccacagagtctccctatccaggccccattaccctgggggaggcggattatggtatgaactgc

SEQ ID NO: 116934 - DNA, 601 bp, Human
cctgggaggccccaggaggcaggtggactttgtccctaggcatccagtgcagaggtgagacctgtatggccacagagtctccctatccaggccccattaccctgggggaggcggattatggtatgaactgctgcaggtggtccaagaggggctgcccctgggagacgcagggttcttcagtaatggtggtttcgaagggcagaggagggaagaatggagggatgggggacagacgctggagccgttttggtggcaggcctctgtggctgtggccagaagcagggctgggcaccaggccagwtggaccagaggctgcccccagctgaaccaactacagaaatgagagccccggcccagcctcctcccagccgccgctctctgggagcccagctttgctcatagaaaaggaaggcccttgttgccctgcattgggagcaaacacttcctttggcctcacagctcaaccttggacccaaaggtcctcagggacctgggggaaagagagggcagccaggcacctctgttcacggcaggggctgcgttgcccagcctggcagagggaggcagcccctaggtacagtcccctgtgcccactcgaggg

SEQ ID NO: 116935 - DNA, 601 bp, Human
tcctcagggacctgggggaaagagagggcagccaggcacctctgttcacggcaggggctgcgttgcccagcctggcagagggaggcagcccctaggtacagtcccctgtgcccactcgagggggtgctgaattcctcaaggcctgagtcagacctggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttgrtgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccacgttctcacccaggagagggctttcctcccatgtcagagtccccttcgctgcttgaggcaagccctccggaacagacccatcttttgggggaccctgtggtcatggagatcaggttcctagaatcacccccagcagcgcacacagg

SEQ ID NO: 116936 - DNA, 601 bp, Human
ggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttgatgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccasgttctcacccaggagagggctttcctcccatgtcagagtccccttcgctgcttgaggcaagccctccggaacagacccatcttttgggggaccctgtggtcatggagatcaggttcctagaatcacccccagcagcgcacacaggagggcctgaggcccagagaaaggcgcctgaagcaagggaggggagggctggtccagagtccctgtcccctctgccagccacccaggaggctcctatggccccatctcccagctcttccgggtggaagacagtggtgggtaactcactcagctaga

SEQ ID NO: 116937 - DNA, 601 bp, Human
agccagccccttaccttctggagcctcagtttccccctctgtaaaataggaggcatcacccagccttgcacgtctccagtgtccctcagaacggctctggccccgcagctggggtctgaagagcagagccctgagctctgagatccactcccacccccacccccacccccaggcctctctctgccttccctagtgctcctttgtgtgtccagagggaaggggcatcctccatcagcactgaccccactcaggcctctcagctgcactcaacacaggggctccccacactcgccctccttcrctgcgaccccgaccctcactttcccacaaaccctcagtctcctttgctcagcttccttccagacaggctggcccaggccctccccacggcttggcttccctgggcggtgtcaggcagggacagcagccataggtggtacccctagtgagggggactcattctagttgcaaagatacaggtagagcatagggaccccaaagagtagcaggggacccccgaggttgctgctggcagctcctagggagacagtcgggcacggtgggcaccttgagaggaagaacagccaggcctgggcagccc

SEQ ID NO: 116938 - DNA, 601 bp, Human
gcctctggggttagacggtggcccccgtgcctggagagaaggtgcactttggggatgggaggcgctaggtgccaatggccctaggagggggctttggagctggacccttgagggagtcaatgccagctcatcgccatagcggcttgcttagggccgtccctcccaccccccagttacacagcctgcaaaccccaacctagccccttccaggtgtcccttgtgatcttccgccactgacataggtgtggcccagagcaaagggcggcttcccatttcacctgcgcatctgcagctggtatgyggctgccctggtgggttcctggctggctggcatgcgccctgcgcctctgctgggcctggtggggcctaagggtgaaaactcggtcaagataagatgcccacggctcagggaccccacagtcacaggtggggagtggcgcagagcctgggcctgcctcgggctaccctgaagtgccagccgagggtggctgaggaagcccagtcccgacccccaccgcctgccttcccaagacatcctgagtgcccctcgccagcactccctgctcggggatcccattattccaggaggaggagccagggg

SEQ ID NO: 116939 - DNA, 601 bp, Human
aaaataaaagtctcctaattatatttatgatcccaacgtgagtgaatttgactccgttcacggcgaagaagctttgtgtaaaatgccgggaagccttcgtgctgactcggccctcgcagaccataaaacacggctggtgggtccgagcccggcagggatatggggtcacagcaaagtccctattaatgccatgtccacctcgctgccagggagagtggggctgcagcagggtgcgaccgtcacagccctaactctgtgatggatgcctgctgttgtgatcatggacatgaggatgtgaggyggtcataatacaggagtgggctggaggcagggaaaggggttggtgccccctgcccaggggaggcacacctgggggcacagaatgacactgggtcctctcagcttcatccatttcctgctccaggcagggccctgggcctgggctgcagggattcaagggagaaccacaccctcctccactgctgggaggggccgagcctggcctggactgctggccccaggagcctgggcctgtggtcagggcaggaaatggagaagatgaacgaggaaaggagaaactgctccaaatggtggggaggga

SEQ ID NO: 116940 - DNA, 601 bp, Human
ttggagcagtgtcctaagggaggccagcccctatgggtcgggacagaggcctcaccagtgggatccagtcactggggctgaggcctgggtgtgcaggtggggtggtgagccatgcggcagtagcccctggggactagagcaggctccttgtggagctgtgcggagctggccggcctggtccccgtggcttcaccctgagcgtgctgctgcctaggccctgaacagacagaggcaagccctgcatggcgcccagggtgccagtgactctggttgctctcaaaccatgagaaacgttagaacktctttacccctctgtgagatgggctgggcctggcctctgaggagcctccaggaatggcaggagggagggtgggggatggggagtgggtgctgctgcccatcgacgctgctgggcaactaacaaattcagcaaattcttctttttattgtgtatgttcgacaactgccttcacttaaagtcacttttttctggctctccaaatatacttagataaggaaacagagtctatttaaggaacaatgttaagcaaacaatagtacaggtgttcaaagatatggaatgagtgacagatggggcgag

SEQ ID NO: 116941 - DNA, 601 bp, Human
gggggcaggctgaggaagctgtgctcgggccggagcacagccggcctccttgcaggggcagctgcgggcgcgcagacagctggggctgggagcctcttccagggatcctccgcctgtggttttcctccttgaccttcttaggagggtccagttccttctcctggccaaggccccactctctgccaccccaggcagggccagggtgggtcaccatctgcagaagccctcaggggcccccagcagcgcccctcctatccccctgccccagggcgggctgccgccttgtaacccccagaactcytggctctcatgtatatgagtcagcgttgactgtttaacctgttgcaagacactctgctgggtgctgcgacatggttaggttttctccacattagaaggtagaaggaagaaaaataagttctgaaagaaacagacttgccctgcctctgccctgaccttgaggtgaacagaggttttgcacagaacgaccatccctgcagcgggtggcttggggggtaccaccatgatttgagaccctgggtggtgctggccagaatcagcctctatgagatgggcagggcagtccagggcaggggaagcc

SEQ ID NO: 116942 - DNA, 601 bp, Human
gccagaatcagcctctatgagatgggcagggcagtccagggcaggggaagccctgtgccccaagatcagatacatcagctacaatgagaggcatcaggcggcctcaggccctcaagccggtccccatgtgcccatttgcagtctgtctcatactcacggccacctggccactgcaccctgatacagcagtggggccttcatgcctgtggggtgtctgcctgcccagctgtgcccactcatgtggtggattcatcccaatgctggtcctgggggccctgggctccccccggccctttctcgrggcagtttacactttgcagctgaatcaatcaggggcagaaatgcctggcaggggaatgtttaccgatttggttttctggggctgaggatgctcggtgtttgtccaggctctgtcctgctggctcctctaaagctttgcaaacaagagcctcggagagaaggaggccttcccctccccatgtgctgaattcggggcggtcctgacagccatgcgcgggggcccgctgtggcctcctctgcacggctgctgagggaatgcaggtcaaacaaagtaggccagcggcttagggacccccgagta

SEQ ID NO: 116943 - DNA, 601 bp, Human
ggagttgcccccagcaatgacatcggatgcctgtttagtcagcggactgcctcagaaaggaatctcacaggcagcgggttcttctggtagggtgggatatttcagcgggaggtaaacaggtgttgtcacagaacggcagactggggcctcccctggtgggccttgagggtgctggcctgcagacctgctcctgcccgttctggcctgatccggggcctcttgactgcaggtctctcgtgggctctcagccccaggtgcctgccctcacccacgtagcttgggacatcatcagcccattgcyggtacccatggtaccttcaccaccctcttggccgcattctgaaaatcaatgtttagtccctccttgaacttaaaaagtcaaacttaaaaagagattattacagggagctggggactcaggcttgcaccctgcctgtttaggataaaaggccaccgtgtgtccactctagtgtctctgctcaaacaggagacgatgtggcatcgggaacaccaatgcggcactcagagaaggctcttagccagctggcccctgatgggctcactggctgcaccagcttgtgtagcagctgagctcctgcag

SEQ ID NO: 116944 - DNA, 601 bp, Human
attttggaattttttctcccaggagtttattgctggtataaagaaatgccattgatttgggggggttgatctcacacctgacaaccatgtcatactttctatcagctctattgattgatcttttgatcctgctgattgtctaagtggatcggtcctatcaggaggagtcagcgtgaccacaggcccccattccccagcccctaatgttcttgcctcatgtcttcaggtgcggggctggcagaggctggggttacctgacacttgtcatccttctgctgggcctcagcacccggcggaggcrggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcggctcactgcaaactccacctcccgggttcaagcgat

SEQ ID NO: 116945 - DNA, 601 bp, Human
tcatccttctgctgggcctcagcacccggcggaggcaggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcrgctcactgcaaactccacctcccgggttcaagcgattgtctcacctcagcctcctgagtagctgggactacaggtgtgcgccaccacacctagctaatttttgtatttttggtagaggtggggtttcaccatgctggccaggctgatctcgaactcctggcctcaagtgatccatccgcctcggcctcccaaagtgctgggattataggcatgaggcaccatgcccagcctcttgccgtcattttttttattttaaataaactttgattttagaatagttttggaattacaaaattctta

SEQ ID NO: 116946 - DNA, 601 bp, Human
tattatcagcatctcacattagtatgcatttgtcacaaggaaacaacagtgctacatgactgttaactgagtccatgcttgatgcagatttcctcagtttccctactgtcttttttctctccccgggccccacccagggtcccatgtgacattcctcatccgtctccctgggctcctctgggcggtgactgtttcccaggctctccttgttggtggtgacctggacggttcagaggaggacaggtcaggtgtttgtagggtgtcccttactaggatccgtctgctgctgtcctcacgattmgactgggctgtgggtgtgaggagggagagcacagagggaaatgcccttctcatcgccctgttccgagggcccatcctgtcggtgtggctcgtcatgggcgatgctgtctctgtctcctggctctgaggccatggctgtcaatctcttcaactgtgatttgttcttttccccctttgcagactgtccttggacccgccagcatttggctctggggccctagagagaccctgggatgtggatcacactggtgacccctgtgagccccactggggacagatccaggaagggacctcctgggaa

SEQ ID NO: 116947 - DNA, 601 bp, Human
tttgtagggtgtcccttactaggatccgtctgctgctgtcctcacgattcgactgggctgtgggtgtgaggagggagagcacagagggaaatgcccttctcatcgccctgttccgagggcccatcctgtcggtgtggctcgtcatgggcgatgctgtctctgtctcctggctctgaggccatggctgtcaatctcttcaactgtgatttgttcttttccccctttgcagactgtccttggacccgccagcatttggctctggggccctagagagaccctgggatgtggatcacactggtgrcccctgtgagccccactggggacagatccaggaagggacctcctgggaatgaggtctggcctctgcctggatcaaagccatggcccccattccccggggatagggaagctgtgcaggcagcctgggtaatgggccaccgccccaggcaggcgtgggaatccacacatggcccttctcaaagacgggtgctgtccctggggctctggcggggtcctggagcctctctcattgggcacatccgagcccagcctggcccatggtggaaatgcaaatctaattagtctggcattgagcccgtct

SEQ ID NO: 116948 - DNA, 601 bp, Human
gtgctggtggggagggtccctatcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttagggtccagccatctgctgctgcccctccctctgggcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaa

SEQ ID NO: 116949 - DNA, 601 bp, Human
tcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttagggtccagccagctgctgctgcccctccctctgrgcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgt

SEQ ID NO: 116950 - DNA, 601 bp, Human
gggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgtccagcaagtccctgttgccactgatagcataaaaagtaactctgaaacctggtggccctacagttgacacacatggggccgcaggaggaaggaggctcaggcyaggccaaacatcagagacctcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtg

SEQ ID NO: 116951 - DNA, 601 bp, Human
acccgtgagttgagatcatgccactgcactccagcctgggcaacagagtgagactctgtctccaaaaaaaaaaaataaaaagtacaggggctctacacggcgccctgagaattgtgtgtaaatgagtgaaaatggggtgagagggagggagtgggaacagccaagaggccaggaagcggagcctgggtgcaggggcatcttgctggtgaagctggggagagacctgcgcaaccccacctgagtgaggcactgtgggcccagagtccaggtcagcgccaggggcagcaggggctggatctcyggggaagttgaggaatgacatgtattccagggaagaattgggccggaggctgaaacaggacgacagagccctcagcccagggcggaggacatgggagacgggggtatagctgttgggcttgtggctggcctggcctaaccagttgggggaatccatgggaggctttagccctgctctgtgaactgctgggccttccttaggggccctggggagccttcccagcagaatgtccaggctcctgctggcccaagctccaagttctctggctcccagggtctgtgtggaatccaccggtttcac

SEQ ID NO: 116952 - DNA, 601 bp, Human
ctctgtgcaggcagcctcagacctgtaggccctctgcccaatttgggtcacccacagcccccgcaccccacagcaatttcttgggagctgatcatccccaaagcttggaactacaaggcagtgactggttttgccgggctccgctcgtccctctgagcggagggtcaccctggtcaccatgaaaactttatcctcatccacacctttctttctccaactagcatgggaatcagtttagggtcctcccacaccctcatccaaaccctcatctcccaccccccacttgcagagaaagccccaygctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtctcagtgcagagggcagtggagggacagtgcagctccgaaatgagcatctgagttcactgctggtgggcaccatcccggccaacaggccactagtgtgttctccctctttcaaacggggcggcgaccctcgtctgacaggc

SEQ ID NO: 116953 - DNA, 601 bp, Human
agggtcaccctggtcaccatgaaaactttatcctcatccacacctttctttctccaactagcatgggaatcagtttagggtcctcccacaccctcatccaaaccctcatctcccaccccccacttgcagagaaagccccatgctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtytcagtgcagagggcagtggagggacagtgcagctccgaaatgagcatctgagttcactgctggtgggcaccatcccggccaacaggccactagtgtgttctccctctttcaaacggggcggcgaccctcgtctgacaggcggctgttctgagagcggtggctgtcccagggaagccctcggtgagcgtagcgttaccatggtttttaaattaaagcatctgcagatgcgctgtgtccctgcaagggcaggcagatcgggaccccagggactggtccccatagccaaggtgttcagccgcc

SEQ ID NO: 116954 - DNA, 601 bp, Human
tttgccctattccccccatagcatggctgaccttcctctgagcccctcgtggatgcccacacacggcaagacgtttcctcaaagatgctcttctgcaaagctgcactttctcggttgccgctgccaccttggcacctctctggggtaccttgtactgccctgtcctccccacgccctgaggggccgtcctaggcagcactcaccctggtcatccctgtttccaccacaagactgtttgtagccgagcttgggagttgtgttgtgtagtgttgacttgagttgcatcgtgttgtgttgactygagctgaactgtgctgagtgttactgagttgaggtgactgggttgattttagcttcacaggtgatatgaacccagctgagtggcttccatggagctgatctgaacccagctgagtggcttccatggagctgatctgaacccagttgagtggcttccatgaagctgatccggactaagctaaactgagtttcattgagcagcttgtttagctggtgtgtgccaggtggtctctcggggggtccgatgggatacctagtgtcttaatctgttcagtctgctataaccaaataccttagacct

SEQ ID NO: 116955 - DNA, 601 bp, Human
gtccgatgggatacctagtgtcttaatctgttcagtctgctataaccaaataccttagacctggtgattcatacttaggaattcattgttctggagactgggaagcacagggtcagggcgccagcagatctggtgtctggtaaggggtctgtctgattcatggaagtcagcgggctgtgtcctcacgtggcagaagaggcaaaaataaggtgcaaacaagctccctcaggcctcctttccaagggcacgcatcctcttcctgaaggctctgccctcacggccgaatcacctctcaaatgckccatctcctaacaccatcagggctgcgggttagctttcgacatagggactttgggaagacacacacattcagactacagcaccttgctcctggggaaacagaggaaactggttcctttctttcggttctgggttatgtcaaaatgagttccctttgctgaatctgtttcagccacctctcccgaggatcctcgcacaatttcactgccagccaggaaggtctgccctggctggtctgggcttgaggaccagcacgggatcgttctcctctgtgggtcgctgatatgaaaacaatctcaca

SEQ ID NO: 116956 - DNA, 601 bp, Human
acatgcttagtgtcatgtgtgatgcatcaacccagggggaggagagaacgtgcattcacgcagaactctctcagccacaagctctgtttctgttgcatttgggccaggttgcggggagcctggcaggccacccggccagtgtggatgtcattacatgagcagtaggaagccatacagtatctgaggcgggggagtcacgagatcttcagtctgtccctcggaaagcccctcctgccgccactcagggggatgggttggaaggggtgaggctggagcccaaatagggagttcagaggcctcygtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatgttcagagtcatgcaacttcacg

SEQ ID NO: 116957 - DNA, 601 bp, Human
aaatagggagttcagaggcctccgtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatrttcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttgttgttgttgtttttccaa

SEQ ID NO: 116958 - DNA, 601 bp, Human
ctcagtggcttttggtatgttcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttkttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgctcagcctcagcagtcattaaagagatgcagatcaaaaccacagtgaggtttacacccagtaggatgactaaaacaaaaaagacaataacaagtgttggcaaggatgtggactgc

SEQ ID NO: 116959 - DNA, 601 bp, Human
acatctgtggctggttttttttgttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgctcagcctcagcagtcattaaagagatgcagatcaaaaccacagtgaggtttacacccagtaggatgactaaaacaaaaaagacaataacaartgttggcaaggatgtggactgccagagcgaggctagccatgccatgtatctggaggagggccctggaggggtgtgcccattgcatgtctgtgtgttcccatgcagtgggcacaggcagtggtgccagaaagagcctctgctgggctttctcaccaccccagcctctcacctgcagcccaggcatcctccagtgggtttttcagggaacttaacatgatgagtctaaaatttctatggctgaataaagaactgaataaaaataaccaagaagatcaaggaagggccctgccttccagatat

SEQ ID NO: 116960 - DNA, 601 bp, Human
gaagatcaaggaagggccctgccttccagatatcaggatgtggaagaggctatactaactaagatgttgcagtgtaggcacaagggtagacaattagcccattatcccagtggacaagacagagagccctgaagagatccatacaaatgtgggacattggcatgtgaccaaggaggtgttgcaggttgctggaatcaatcatcctccagaaggaaaaagctagagttgggcccccacctcatgcaatctataaaaactgactccaggtggatctaggaattaaatgttaaaagcaaacctyaaaactcttactggataatatacgtttattagtatcttttataactcggcatagggaaatatttattttacaagacacaaaagcattgactatgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcggtcagaggtccaaccccaggtctgatg

SEQ ID NO: 116961 - DNA, 601 bp, Human
taggaattaaatgttaaaagcaaaccttaaaactcttactggataatatacgtttattagtatcttttataactcggcatagggaaatatttattttacaagacacaaaagcattgactatgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcrgtcagaggtccaaccccaggtctgatggggctggagggcgtcattagggctagaggtcctaggggaggatctgtgtccttgcctttttcagcttctaggggttgtctgcattccttggcctttagccccttcctctatcttcagagccatcatgttcctcctctctgacattttttttcgtaatcacagctctctctgaccacagccaggaaagagcctccactgtttgttgttgttgtttttgttgttgttgttgttgttgtatggttttgctctgtgacccggggttggagtgcactg

SEQ ID NO: 116962 - DNA, 601 bp, Human
ttgctctgtgacccggggttggagtgcactggcgcaatcatagtttactgtaaccttgaactccctggctcaaacgattcttccacctcaacttcctgagtagctgggactacacgcacgtgccaccgcgcctggctaattttgtttaattttgtgtagaggtggagtctctctatgttgcctaaactggtcttgaactcctggccttaagtgagcctcccacctcacccttggccttccaaagcactgggattataggcatgagccactgtgcctggccagggccttcacttttaaagayttgtggttaattgggcccacctggacaattcaatatgatttccccatctcagtgttcatgaccttaattacagatacaaagtcccttttccatataacgtaacatattcataggttctaggacatctttgggggagcccttattctgcctaccaaagaaatggatattcacaatacaatgaattgataaagaattggtgtatgtataactaatacataacatgtataatgtatttatatatgtgtgtgtataaccaataaaatcactaatagaaactaaaataacgaatcaataaatata

SEQ ID NO: 116963 - DNA, 601 bp, Human
tacctgttgacccagcagtcccatatctgggcatacaccaaaagggaactctggtgtgtggacgagtgagaatgaacaggagtgtgtgttgcaacgctgttcacaagctccacgtgcaaccagccacttgcctcccagcaggagggagagtgagtaaacatggaatgcccatacaaaagagaattttaaactaattaaagcaaacaagccagagtgacagacaaccatgtgggaaggcttggcaatataataccaaggaaaagcccactgcattcttatcaagtttaaattactaaaattaaaaaaaaaaaaaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccacca

SEQ ID NO: 116964 - DNA, 601 bp, Human
cccactgcattcttatcaagtttaaattactaaaattaaaaaaaaaaaaaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttgrcctcccaaagtgctggaattacaggtgtgagccaccacacctggccgtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaaaaaaaaaaaaaaaaaaaaaaaaaaaaccccacagctaacatcacatcacact

SEQ ID NO: 116965 - DNA, 601 bp, Human
aaaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccrtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaaaaaaaaaaaaaaaaaaaaaaaaaaaaccccacagctaacatcacatcacacttaatagtgaagaacagaatactttccccctaaaataaaaaagaaggc

SEQ ID NO: 116966 - DNA, 601 bp, Human
ggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccgtctagcgtttattttgaataacgagtccttgggagctttctacattgtttttaaaaactaattatatgacattttataagaaaattatattagcacaaccrggagagatttattctaggtaatgcaaggctagttaacattcaaaacttaattaatgtgatctattatggaactttcccaacttgatcaagagcatcttaaaaaaaaaaaaaaaaaaaaaaaaaaaaccccacagctaacatcacatcacacttaatagtgaagaacagaatactttccccctaaaataaaaaagaaggcaagggtatctgttctcaccacttctattcaatatagtactggaagttccagccactgcaataagacaagacaaagaaatgggacatgtagattagaaagga

SEQ ID NO: 116967 - DNA, 601 bp, Human
aaattaactcaagagccaccttggacttaaatatgaagtgtacaactctgaaacctttagaaaaacatagaggagatagtatttaggatttaggaagggcaaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcmacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttata

SEQ ID NO: 116968 - DNA, 601 bp, Human
aaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgaycaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatga

SEQ ID NO: 116969 - DNA, 601 bp, Human
tggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacrcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatgaaaatttatagaagctttattcctaactagctgaaagctgagaacaatctatgtatca

SEQ ID NO: 116970 - DNA, 601 bp, Human
cttcagtgccccactactcaaagttctaggggagcatacagtcggacaggttgtggggctccgaccccacagcagcgtctaggggtgaatgtttacagctgaagccccatgggtgtgtgttacagggtgctctttagtttagccgtccatagacagcttgcgttagtcagctcagttagaccccctgccttacggcaagggcagaggtctttctgtatcccgaggttcttgccttggcgtactggaagaatcagatcacacgtgggcttggagaatgagtgcaaggttttattgagtggargtagctctcagcagatgggggagcaagaagggagatggagtgggagggtggttttcccctggcatcaggcggctcagcagcctgggctctcctgcgtccaccccagccaaacccttcatcgttcctccggtcaatggtctgccggcctgtcggtgcctgttggtgcctgtcggtgtgctcctacgctggtgtgttcctctcgacctaccctcaacgtccagccgcttgtgtcttcttctgccgatgtgttcctcttgatgtccagccgcttgtgtgtctgcccactaaggtctcgagatt

SEQ ID NO: 116971 - DNA, 601 bp, Human
ttccaggctcagagcttacagcagccttgagctcctgggctcaagcagtccgcccatctcagcctcctgagtagcaagaagcacaggtacacaccaccaagcctggctattttttaaatttattttttctacagatggggtctcactatgttgcccaggctgatctcaaactcctgggctcaagtgatcctcccaccccaccctcccaaaacactgggattgcagatgtgagccactctgtcaggcctagaaatataattattatatatcatccttaaaaccggcgttcttgttaaattcrtgtattccaacagtttatctgaggattcttagggattttttttacatgtatggttatgtcatttgcaaataacaaatgttttattttttcctgtccaatccttgtaccttttatctcccttttcctacctttttaacataccagctgggactttctggacaatgtgaaatagaaacgataacatccttgccttgcttcctgtctcaggaggaaagcgtatcacatttcactattaagtatgatgtctgcttagggtttgggtttttttgttttagtttttgtctttttttttttaggtaa

SEQ ID NO: 116972 - DNA, 601 bp, Human
ctagaaatataattattatatatcatccttaaaaccggcgttcttgttaaattcatgtattccaacagtttatctgaggattcttagggattttttttacatgtatggttatgtcatttgcaaataacaaatgttttattttttcctgtccaatccttgtaccttttatctcccttttcctacctttttaacataccagctgggactttctggacaatgtgaaatagaaacgataacatccttgccttgcttcctgtctcaggaggaaagcgtatcacatttcactattaagtatgatgtstgcttagggtttgggtttttttgttttagtttttgtctttttttttttaggtaatggagtttctattcctagtttgctgagagttgtgtttttaattatgaacaggtctcgctttatcaaatgctttcttacaatctgttgtgttgattctattttttctgacttattctgttgatgtgaagagtgacgctgcttggtccttagagggtaaactcagcatgcacaagtggattaaaccacattcgagcatgtgtttgggcacagtgctacatgcagcttgctggtggtggttaggatatt

SEQ ID NO: 116973 - DNA, 601 bp, Human
gataacatccttgccttgcttcctgtctcaggaggaaagcgtatcacatttcactattaagtatgatgtctgcttagggtttgggtttttttgttttagtttttgtctttttttttttaggtaatggagtttctattcctagtttgctgagagttgtgtttttaattatgaacaggtctcgctttatcaaatgctttcttacaatctgttgtgttgattctattttttctgacttattctgttgatgtgaagagtgacgctgcttggtccttagagggtaaactcagcatgcacaagtggrttaaaccacattcgagcatgtgtttgggcacagtgctacatgcagcttgctggtggtggttaggatatttgcacgtatgttcacgagagagattaacctgtgattttttttttctttcttgaaatatccttgtcagattttgatatcaaggttatgctgccttatgaaaatacttgtataaaattgacattattttttccttaaacatttggaagaatttactggtgatgtcgtctagatacagagttttctttgccagaagatcattaaaattccaaatttaacttatttaattaatat

SEQ ID NO: 116974 - DNA, 601 bp, Human
tattttctttgggccgggcatggtggctcatgcctgtaatcccagcacttttggaggccaaggcggacagatcatgaggtcaagagatcaacaccatcctagccaacatgatcaaaccctgtctctactaaaaatacaaaaattagctgggcatggtggtgtgcacctgctactcaggaggctgaggcagaaaaatcacttgaacccgggaggcggaggctgcagtgagccgaggttgtgccactgcactccagcctggcaatagagcgagactccatctatatgtgtgtgtgtgtgtgtrtttttttttttctttgcttagctaggaggttggacttggttcagctaggaggttgttctgttggtgctggctgttagctgaggcctctctcttctccatgtggcctctctaatcagcaagcttgtttgcagggccacattccaaaaggacatgaattatataccgtgtacattccccagtactctttcatcagtgaagtcacaaggtgaccccaaattcaagtaataggaaaacagactccatctcttaatggaaggagctgcaagtatttaaggctgttggaagtaccacacctttaga

SEQ ID NO: 116975 - DNA, 601 bp, Human
ccatctcttaatggaaggagctgcaagtatttaaggctgttggaagtaccacacctttagatctgtatgatctctcttttcccttgccttttagtctttcgtgtataaaattgtagatgctcgagggtattatctccctacagataattttattttcttctgccacgcgcaaagcaccttactccagtaggggattgagagaggtggggttaatgtgatggaaagttggcattgcttagtttctggggctgccttctagatagcttctaaaccccaaagcttctctccacagtgccatgcrtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcc

SEQ ID NO: 116976 - DNA, 601 bp, Human; identical to SEQ ID NO: 18277

SEQ ID NO: 116977 - DNA, 601 bp, Human; identical to SEQ ID NO: 18278

SEQ ID NO: 116978 - DNA, 601 bp, Human; identical to SEQ ID NO: 18279

SEQ ID NO: 116979 - DNA, 601 bp, Human; identical to SEQ ID NO: 18280

SEQ ID NO: 116980 - DNA, 601 bp, Human; identical to SEQ ID NO: 18281

SEQ ID NO: 116981 - DNA, 601 bp, Human; identical to SEQ ID NO: 18282

SEQ ID NO: 116982 - DNA, 601 bp, Human; identical to SEQ ID NO: 18283

SEQ ID NO: 116983 - DNA, 601 bp, Human; identical to SEQ ID NO: 18284

SEQ ID NO: 116984 - DNA, 601 bp, Human; identical to SEQ ID NO: 18285

SEQ ID NO: 116985 - DNA, 601 bp, Human; identical to SEQ ID NO: 18286

SEQ ID NO: 116986 - DNA, 601 bp, Human; identical to SEQ ID NO: 18287

SEQ ID NO: 116987 - DNA, 601 bp, Human; identical to SEQ ID NO: 18288

SEQ ID NO: 116988 - DNA, 601 bp, Human; identical to SEQ ID NO: 18289

SEQ ID NO: 116989 - DNA, 601 bp, Human; identical to SEQ ID NO: 18290

SEQ ID NO: 116990 - DNA, 601 bp, Human
ggtgcagacctttgccaggcagatggcccagtgggagatagcgcccatctggcaggacaggaagcaagacccgggagaggtcagctcacaggattggcaagctcagaggcccagaagccttggcctctctgctgcccggggaacacggtgtttccctggctttctctttgcgcaagggctgggtgactcctggctggcacacccagtacagcagggccgggtaccctgtgttgttggcatggccaggagtttctagacatcaaggaaagccgtggtagagacagggagtggcacccagttycccagcctccactcctgcttccatctcggctgcagccaggcaggcggggcgtgaacatccctgacgtgcaggagtgtcggtggccctttctggacagcacaggctggggacagcccccgcctttccccgccactccctgccaagctctggttccattgcctacactactgtcccagacctttcttacggctctgcccctgctccatgggacaggccaccctctaagcccagacctggagtctggcatcctgcgggggtgatggtgggtggcagacagggcctcctgaagtgcaatggccc

SEQ ID NO: 116991 - DNA, 601 bp, Human
tgttacatttactcctaaatattttatttgtcatgctagtgttaatggaattgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaraaaaaatattgactagaagtgctagagcagatcttctggggaaaatcactcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgat

SEQ ID NO: 116992 - DNA, 601 bp, Human
attgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaaaaaaaatattgactagaagtgctagagcagatcttctggggaaaatcaytcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgatatataatcctttttatatgatgctggatttggtttgctaatattttgtt

SEQ ID NO: 116993 - DNA, 601 bp, Human
agatggtcctgtggtttttattccttattctactgatttggtataatacattaattttcaggtgttaaaccaatctcacatttctggaatatatcctacctgggcatgatatataatcctttttatatgatgctggatttggtttgctaatattttgttaagaatgtttgtgtcttcaacctaggaaagctgattgaaagaaaaaaaaaagaatgtactttatattcataaaggatactggtgtggttttcttttctgactttgatgtcagatttttaaatccttttctttttaatcctasaaccgtaggatttcaggtttgtcttttgtaaacactgtattactgagtttttaaaaaatcatttaatacatttatatttaatataatttctaatagatttggattgaattctagcagtgtattttgtgctttccacttgtactaaatctgtaatatttatttttctcctctttcttgcctctcattagattattacttctcattctacttttctctctactggttttgaagttatgtattctactaccatccttggaaaggttaacctagaacattttaaatgaatatatatcagaagta

SEQ ID NO: 116994 - DNA, 601 bp, Human
ttagtactttgctgttgtatattttagttgaactgtgtttaatttttaactcactaattggtagtgttttatacaatcaatatttgtttaaatttactcacccatttgcctctttgtcatttgttatttcttttttatctcagatcttacatctgggattacctttttatgtgactgagggattcatttaaattttcttcagtgaaaaactctcagattttgtccgcaaatgaccattttactgtcatgttaaaaaatatttccaccaattataaaattataggccttaggttatcaaaaytcttttttcttagcacattaaaaatgttattgaactatcctttggcttccactgttaccgttgagaatgaagatgatgaattgttgctccttggaagacaatctgtcttttttctctggctgcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatt

SEQ ID NO: 116995 - DNA, 601 bp, Human
cactgttaccgttgagaatgaagatgatgaattgttgctccttggaagacaatctgtcttttttctctggctgcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatttttattggccagtagtagaccacctcactccccttcatatctcttaacctttttttttttttaaatcactttgtctctctgtactgtattctggaatccatcttccagttcactagttgtttctttgactgtgtttaatctgctgttaaaactgttcagtgaattttaaacttcaattattattattttatttataaaagttctgttgggttcttattcatatctgataagtcattttaatcgtatcttcctctttacttgcctgttcaaactttaaaattttcttgaagtgtattaaatatggctattctatattgagcttctcttaattccagtatctaaagtatttc

SEQ ID NO: 116996 - DNA, 601 bp, Human
aaacttgtcaccccgtgggtcagggcacagcctgcccccagccggttctgcatattaagcagtggcttggtcaccatcaaaaatagatgtcccgacccgagcctcccctccctcccggggaggggacctggccgtgccggctgggctgggaaaccgcgggcggggaaggaaggacggggcgaaccggcggcacaggcccagcacgtcccgggccctccccgtcaggtgtggaccccgaggttgtgcgggggcttggcggcagctgcgggtgggggtggggggcccgggcctcccgggctcsggttctggccccaggtcagaggtggcgctggcggcaggtggatgcccaggtcctcgccgcgccgctccgggcggtgggaccggcttcctgccctggctccgagcccgcaggtgggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtt

SEQ ID NO: 116997 - DNA, 601 bp, Human
agcccgcaggtgggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtttgggttggcaacctgagccctccccaccccgttccgcgtccgctgcttcccgccctggtccggcgcttccattcatgccttcccgggtccctccgccacccytgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagcccctctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaag

SEQ ID NO: 116998 - DNA, 601 bp, Human
tttgtggattaaacacggggccgaggcgcgctgggctgtttgggttggcaacctgagccctccccaccccgttccgcgtccgctgcttcccgccctggtccggcgcttccattcatgccttcccgggtccctccgccacccctgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagccccwctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaaggtggaaagcgccaggtggataggagggacggggccgtgacccctccctctgcccaagagaaactctctccctcaggtcagacccaggcctttcaagaagaggttgcagggtgtgcgggctgccaggaaaaggtctgtgcgggtgagggagcgcatccta

SEQ ID NO: 116999 - DNA, 601 bp, Human
gatgcctgggtgactcatgctacctggccacccatcctcgctgggctacaaatgggttcagcctcatgggcatcaggcagggcccgcctgggtgcacccgacaaacacaagggctcttgttctaaggctctgtgatagcccctcttactgagagggaccatatccaataacgggtggaaattgcactagcagggtcatgtgagggctccgagctttctccagaacccaggaatatcctcaaaactgaggctgggcacagtggctcacacctgtaatcccagctctttaggaggccaagacggggggatggcttgaggccaggagttcacgaccaccctgggcaacatagcgagaccctgtctctatgaaaataaaaataaaaaattagccaagcgtgatggtgtgtgcctgtggtcccggctgctcagcaggctgagttagaagaatcgcttgagcccaggagttcaaggctgcagtgagccatgatcacaccactgcactctagcctgggcaacacagtgagatcctatctctaaaaataaaagtaagaagtattttttttttaactgaggcccttctggagggatggagggaccagaag

SEQ ID NO: 117000 - DNA, 601 bp, Human
gaggagggttacaggcaggtgaggatgcagttccaggagtggtgaggggctgctgtgggatgagggagagcatcagcactttggactagggtggaggccttggggccagcccccagtctgccagccccaccgatgagaacaagcagactgaggggagaaaggttggagaaggaccccgagcttctgctgtgagcccccacgtggggatgctttgctcggaggggtgctgaggtaggagggtcaggagggtctggagctgtatttggacttggcaggcaaccaaaaccccagtgcttagagrtcaagtggaaaagaaaagaggaagaagatgggggagtgagagagatgggaaggcagtgagggaagccttggggaggccgtggtcaggggcggcacaggggagaagcaggctcatgtgactcagccctgagcccagccgggcccccaaagacgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactgga

SEQ ID NO: 117001 - DNA, 601 bp, Human
cacaggggagaagcaggctcatgtgactcagccctgagcccagccgggcccccaaagacgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactggacccagcaagagagcctgagcctggaggacccctctggcccccatctcccactttcagcttcagctctgaagccaccacccagaaccacatacytgttcttcccaagtttgctctccctagcggagggaaagacgggaggtccacagattaccttgtctcttgaaagcaagatgccaccagtggggaccaatgtacagagaccaggcccagcctagagtgggtatagctcatcacacccccagaagctgtgcggggaggaaggcaagcaggcagcacagtcaagacctgagtttgatgactcagagggtcctctgcctgtggttggcgggggtccaaggggtcttcccatctaactcgccacctcctcccacgtcccactcagctccaccccac

SEQ ID NO: 117002 - DNA, 601 bp, Human
tctcgcctcccctacccccgacctctcgggtgctgtagggatgaggtaggagtggtggctatgaactggaggccttcgcctcgggctggagctcagagcagtccctgctgctgccagacctgcagttggggcactgcacccatgtctggggaggccacggacagggccccagggtctcaggtgacctgtcttgtgtatcccacttcgtttctctctttccctaaaggtgaagttctggagcaaaaagagcctgagctgtgagccgaggggctcctcctcctccaaactgacacccagtcasagagcaattgctaaagacacagtcatgcttgggcccagagtgggccccacggagcttcccccaacccagcctggcttgagcaggcccctgatctaaaccaccctaccccacacccactggggctcacctggggtttggccagcatccctagaaatcagaagcccgcccctaattctgccagcttctggctttccgttgccatggtgacacccagcccccagctacagatcccgccaactcttccctgccattttgcaagaaacaatatttttctgctccacaaacttggcgggaccctgc

SEQ ID NO: 117003 - DNA, 601 bp, Human
tctcatcccctgagtgcctccacaagcaggggtcccatggggcgggggccgggggaacagggggtaagtgtggccaaccccttgcacagggcttggagatggaggcccctccccaggtgagaccggcctttggccccctgccccactcacacagggacaccctttgtgtttttccacatctgagagccaccgacatttcttagatgacgttttcttgaacccaccgtgcttggtgcccgttaagtacttctactgcagcagcctagaaccgacacgtgtgaaaccattggcttatggcgcratgcacttcctcccggcatgcatgaaaacataaacgtaaataccaaaatacacagggactattcggacaccacctgaaatcattccatgtcccaccagaagccagcacggcccctggccccctgccaggtgacgctgccccatggcagccacagtgctgatgaagctctgtttgagatcaccgcctggctaaggccaaggcggccacgtcagttctcacggctcctcccaaactgaggagcatggaggaccctgggcattgatggcagggtggcaggaagcacccatcgctttcctctcc

SEQ ID NO: 117004 - DNA, 601 bp, Human
aaaaccccgcagactcccgtggctgtaccagccctgcacctcctggccacctgcccctgcgtacccaccacccttgctcgggagctcgagggccctttccccactagcatctgaccgccttcttgtatgtcttgaaggttctttgccttctctgtgcagcagggccctttacagtgtagtctggcccctcctcctcccccgggccccgtacttcctccattctgccccttctcaggtgtgcgggacctttttacagccccctgcttgtgcctgcactccctcccctgggagcctgcctcamcctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaacttcagccctctcaccctcacaggggacccaattgcacagccatccacagcggccttgggacaatactgagtcttgagttaggggtgtctc

SEQ ID NO: 117005 - DNA, 601 bp, Human
agtctggcccctcctcctcccccgggccccgtacttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccrcggtgggcagatgcagcccctttccaggccaacttcagccctctcaccctcacaggggacccaattgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctg

SEQ ID NO: 117006 - DNA, 601 bp, Human
cttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaasttcagccctctcaccctcacaggggacccaattgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctggtcacctttcggcttggcatcaggagggcttga

SEQ ID NO: 117007 - DNA, 601 bp, Human
acccttcccctcctggtcacctttcggcttggcatcaggagggcttgaagaagactcctcagccccacctgcagacctagctagttgccaaccacctggggttgtgcccagtcctcagaactcacctgcccatggtcatccgagccgttcccacaaaagccttccttgggatcctcagccgtctggggggcctccttactggggtcacctcaaaaacagctgtagaggggtttgcggcagcagcagcagacgtttttaaactaattcattggtgatggcaaaattatgccgagttccctgaaaaaaaaaaaaaatacccactctatttcctcattaacataattgcaaacagaacgaattttcttgatttcgtgtaaacaacagcttgaaatagtttataatccttgcaggtatcaaattaagttcttacttatggtctggaaattaattacccttgcagcgagacaaatgtgaaaactgtgtatttttgacaagaaaatgaagcagctattggggaaaatgtaacttaatcgtagcagagaaaattgtttataaattggtcgcgttgtttgaactctcgcctctgtggctcagggctggg

SEQ ID NO: 117008 - DNA, 601 bp, Human
ggagaggaagaagaggaaggagagcagagggtacccgcgtgaagggtacccacgaggaaggggacattagacaagaatgcaggtggtcaggcggcacttacctggcaggtgaaatctaaacaggcaccttcaaaggaggacaaagcagctcccttgggtaactaggaagaggacaccagctggcgaggggcaaagcaaaggacctgggacaggcacgtgcctggaacagaaagggagccagtgtgtctgcatcaaagtgagtgagagagcagcgcaggagagaaactctcagaggcaggcrggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgag

SEQ ID NO: 117009 - DNA, 601 bp, Human
agctggcgaggggcaaagcaaaggacctgggacaggcacgtgcctggaacagaaagggagccagtgtgtctgcatcaaagtgagtgagagagcagcgcaggagagaaactctcagaggcaggcaggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgagtgtggtgtgtgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttaca

SEQ ID NO: 117010 - DNA, 601 bp, Human
tgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttacagcaaataccctcctctgcatttttcccttgtgtttgatttgccaggagcagaatttctgggttggaatcgggaacatttagaggagcttctcagtagagttgtacagagtggaaatgagtcggcaggctgcayggggggttccagtcacagcacagagggtgtgtgttttcggtgcctgccctcctgagctccaagtgtcccacgcctgcccgtcagtcctcatgtctacctgggcgaccccattttgaagatgcagaactgaggtccggagaggcctgggtagctgcctaagggtggggtagaagcatggtgccggctcagccaccctcaggtctccaggctcccagccaagggctccgataaggctgctgggacctgggggctgtgagcagatgcagacgtccacagttcccagggctctgaccctgccct

SEQ ID NO: 117011 - DNA, 601 bp, Human
gctgtgagcagatgcagacgtccacagttcccagggctctgaccctgccctgtctccagagcccacagccccacccaaaaggccaggaggtcacagatctgggatcctttcccgccaccttcaagaagggaataaagccacttcctgctccatcccagtggcctgagggtgtgggagggacagaggcctcccccagcagggtaaccctgcaaagagggggctgacagccgttcctgcttcctactgggcagaggctatagaggaggtttccagcgcctcagtgcaggcagctgagcccagmcccctgggctgtccttggaaccactcccagcccctgccagctttgtagcctctttcttccccaccccacttgcctcacctcggcccaaacctgggtactcccagctgcagccctccccactttgcctgctctgaggctgtgtagggcccagggagtgggggaaggggcctgggtcccgcacaggattgaggtggcgtttacagaaccgggggccagagcagctgtggccgtgaaggttccaagcttgaagtggaaagggttttgatgccaaggtccaacgcccagcttatcattgtgtaa

SEQ ID NO: 117012 - DNA, 601 bp, Human
ggccctgtcgccagccggcagcactggggccaccagcacagcctcccagccctcaccagtattaactgtcatcccaagggggccactgaggcagcggggagcctgccctggaatgtgccatcctcgggcgcaggcagcccttcatgggcctgcccaatgtctattaattaagccccctggagactccaggagctgggggccttggctcagtgccctctcataaagttctgctctctggggaccgtggctctggcagccaccctgcctctcaggagccagcctagtgcctcctgggtccccrgggtatagggccagaccccaaggcttagtggcaagaggcccagcagatgctcattctcccggtcaaacccctagatgacactcactggggaacagaggggctgggtccaggaaggaggcgtttgcagggcggggttgtctcctgaagactgcgagctagaggggagaagccactgcatgctcccagcccttcacctcacagtcccggaatggggaagctgagtggccacccacccttggacgttccctgagcatttccccactcagagtccagaagcccccagccccagcagaccctaca

SEQ ID NO: 117013 - DNA, 601 bp, Human
ggggaagctgagtggccacccacccttggacgttccctgagcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagygagcaaggggctcagggtagcccagaaaacccagccgggcccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccag

SEQ ID NO: 117014 - DNA, 601 bp, Human
gcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggaccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgtt

SEQ ID NO: 117015 - DNA, 601 bp, Human
cccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggccccccctcccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccagga

SEQ ID NO: 117016 - DNA, 601 bp, Human
cccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggcccccccccccacgggcacccaggaaccgccctgrctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgat

SEQ ID NO: 117017 - DNA, 601 bp, Human
accctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgatggggagcaggagccagttgttcccaaacctcgcccyttctccctgcaggcactggcagagctgggggtgatggggcttcagtggagcccgccaggactggggacacaagcctaggcctgtaccgtctgcagccccatctccaggtcccggcctgccccagcctgcccacccccagcctgtcccccaaatgcccagggctgtggcctgcccagacttgccagggagctcctgtgcccttctttctcctggcctctcagaagcactccctgatcctctccccacttccctcctcccctctcatccccacctcgggcccaccagctcccaccctgctat

SEQ ID NO: 117018 - DNA, 601 bp, Human
gcactccctgatcctctccccacttccctcctcccctctcatccccacctcgggcccaccagctcccaccctgctatgcccatggaccccagggtcagcttttatgcacactcaggtactcaggacaccccacaccagccattggatggggccgcctctgccacctgctccagccacctggcagatcccactcggctcacacagagccttggccagcatgtggccgcagccccaactgcagcggaaggtatcggggagtcgaaggcagaggggaaaggacgggatggcgggtgaaccacayggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctcggcacatcagcaagcacaggcctcctgcaacgtcattttgcagaagggaaactgaggcacaaaatactccactgccaccaagtcacccaac

SEQ ID NO: 117019 - DNA, 601 bp, Human
tggccagcatgtggccgcagccccaactgcagcggaaggtatcggggagtcgaaggcagaggggaaaggacgggatggcgggtgaaccacacggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctsggcacatcagcaagcacaggcctcctgcaacgtcattttgcagaagggaaactgaggcacaaaatactccactgccaccaagtcacccaactcagtggtagagctgagatctgaatgcaggccgcctggtcaagcccatctgtgaactagaaccccgccgccctgggcagaaacaaggctgtattgacggtgctgggagagatgaggggagggagggatggaggccggaacagagccggctgctcccctcagagggctgggtgtcaccccagttttgtctgtgggtttgtggagagcatc

SEQ ID NO: 117020 - DNA, 601 bp, Human
ggcagaaacaaggctgtattgacggtgctgggagagatgaggggagggagggatggaggccggaacagagccggctgctcccctcagagggctgggtgtcaccccagttttgtctgtgggtttgtggagagcatcactgaaatttctaacttgacagagtggttccagggctcatatagaagcataaagaggtgaaaatagctgatatttctaaaggcaaaagctaacgagtggggttgcactgcccagcgtgaagctgcagccaccattctccacactctcctggcccttggcacaggaygagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacaatgctgacagggacggcagagttccacaggcaatgaggcccccggggtaaaaatg

SEQ ID NO: 117021 - DNA, 601 bp, Human
ccagcgtgaagctgcagccaccattctccacactctcctggcccttggcacaggatgagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacratgctgacagggacggcagagttccacaggcaatgaggcccccggggtaaaaatgaagcagtttgaaaacaaaaccaggaagagtgtctggccatcccgggcctgagtttctgcccatgggcagctgccggacaagccctctggtgtgtcagcgggtcaggctgagccagacgtggagatgaggctgagagccggaagcaagggctttgtctctagaagacgcaggggtggttcacaggccgctggggacccaggtcacagagcctttcccccagctccagcctggctggggagagcaaa

SEQ ID NO: 117022 - DNA, 601 bp, Human
cctattctgctggaagctaattggcccggggtcttcccagccctgtgctgtttgtgtgctattttaattcgcttatgaaaagcccccgctttgatgtccgggaccagataaggccgggaggggaccctccatggagagcgggactgtgccgcccgcggtcgctgcactgggcctcctcgcccccccactccgggcccggggccagcgcgatgtcatgaggtaactgaacaaacagtcctgctgaaaaatatgcttttgtttcactaataaatccctcctcggaacactcccgggccgggcyctcctcgggcccagcctaccaggccttcccgcccagtgcctccgcaacccgcgccaggacagccggcggtgggcacaggcgggcgaggggcacccccaccccctccagggccccccttccctcagcctcctccccacccacccgagctgcctgcctttcccgcactctcctccctgacttcctcccacctaccggcctcttccgacctctctctgcctctttcccccatcacgatactccagtggccaccttccctgcccaccatgcctcctggcccccaatccggtcaccaacttgagg

SEQ ID NO: 117023 - DNA, 601 bp, Human
ggatggatggaggggtgggtaggtgggtgggtaggtgggtggccagacaatggatgtgtgagtgagtagatgaatgagtgggcagacagacagacacaccatcagaagcaaatataaatatggaatcaagggatgcctgcagcttttgaattgttgatttttttctttttttaagaagaaaccaaagtaaaacagaaggaattgctgaattcagataaatgtttcttcaccaaaagagaaattcatttctaaatgtcactttcaggttaaggaaaataaaatgtgggacgctggactcatygtgggtttttgcggtcttctctcagctttgtgtggtagccagcgacgctgcaaccccgcccccgcagcctcctggtgcagcacgtgttcatttatgggttgttgttaccgtggcattggtccaggtttgtgatacttgtgcacagcttgggggctctgcttccctctgtttgttcgtcttggtgctgtgtatgaaggtggcaacagactccccatagtcctctcaccacagacacctcttctcagttcttcgtttccagttggactcatctcctgactggttgggtttctgcctcggtcg

SEQ ID NO: 117024 - DNA, 601 bp, Human
agaggacagtagccaggggcaagacctcacacgcctctgcccatcctgggaaactcaccatggcattgtggttgaagggtcagtggccaccagagagttcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaamgtgagaccacactcaccctgtggtccagtgatctccttctgagaatccgccctggagcagtaacacccttgggactgagaatggcttctgggttgtgtgtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacat

SEQ ID NO: 117025 - DNA, 601 bp, Human
tcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaaagtgagaccacactcaccctgtggtccagtgatctccttctgagaatccgccctggagcagtaacacccttgggactgagaatggcttctgggttgtgygtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacattctggctcactcccgcctcaggcccactgccctggctggactccctgcactgaacgctcctcccagctcatgctttccaaagtcccctgctcaggagg

SEQ ID NO: 117026 - DNA, 601 bp, Human
caggtgtctgttcagggctcctcaaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcaygctcctttcaagggttaacggtgcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccc

SEQ ID NO: 117027 - DNA, 601 bp, Human
caaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcacgctcctttcaagggttaacggygcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccccagcagtcagggaaggacctgc

SEQ ID NO: 117028 - DNA, 601 bp, Human
gtgggccacatgcctcttggaaggcaggtggcacaagaggttcatcccaccctccagcattacccagccccacaggacccacatcctgctcccagctccagcctgaaaggagctagtcctctccagcccctttgaaaagaccagctggacattctccagggagattctgccctacaggattagggagtaccctcacctggcctttgttcattggttcattcattcattcattcattcaacaagtatttgccaagcatccctatgctccaggcatcagtggtaggccagacagccaaagtcyctcctcccaagggctgtggcccactaggaggacagacaatgacagagcattgtgtgctctatgcctgcccatgtgctgaggaaggagcaggagaggaagacaaaccagagtttaagtgaggagtgggcaaggcttttatgaggcccagcccaccctcccctgggcaagctggggatttgggaatgggagacatccaacacgtgtcagcccatacatgagggtagaagtccagttgaaaacacacctgaaacagcagggtccaaacaccaggtgccgagagccttcctgacattgaacctt

SEQ ID NO: 117029 - DNA, 601 bp, Human
taagccacttttggtattttttgccttgaaacttatccatcatattgtgttttcaattttattgatatgaaagtatatatcataatcacttacaattattcaattccctcggtagcagtagtattcattcctaattcttatttgttactttacttgcttaaggtttatctactttactggctcttcaaacaacctgcatttggttttattggtcaattctttttcataaaatatttttctattttgctaatatcttcctttgactttgttcattcttttctttgtatttgttttggtgttmtttttctagcttcttgagttgaaagcttagcacatttattttcaatcttttttattttctaaaattgccatcgatacttctccaaataccctataggaagcatcccacactcttggcatgtaatcagctccttgtaaatccatcctaagattttctctctgccttattttctctttaatcaaagagttatttagaagggtactttttaaacttcaagatgtatccatctgttgctatttttattaataattttctattttacatcaaggtacagatttttagaaatttatggagttttcc

SEQ ID NO: 117030 - DNA, 601 bp, Human
agcttctagaaaaccggagaaggtgaggaatgaatcagccctagagcctccagcaggtatcagccctgctgacaccttgttagcccggtgagactcctgacctccagtgctgcaagatgtcacacacgtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccatyatggcagaatgcaagtgtttagttagaactgtgctaagtgcgtaaagagagctaaaggctacataataagttgtgagcctacctagggtattagcagaggtgtcccaaggaagctccctgtgagccaaaccccaaaggatgggtggaaattagctcaactaagtggagaggtgggatagtcatgggccaaggccccaaggcaggaaggaataggcctggtctgtgggtctgagaggatggagagggctgaacacgggccaaaggagaaagttagggagggaaggtggagtccttggcagg

SEQ ID NO: 117031 - DNA, 601 bp, Human
gtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccattatggcagaatgcaagtgtttagttagaactgtgctaagtgcgtaaagagagctaaaggctacataataagttgtgagcctacctagggtattagcagaggtgtcccaaggaagctccctgtgagccraaccccaaaggatgggtggaaattagctcaactaagtggagaggtgggatagtcatgggccaaggccccaaggcaggaaggaataggcctggtctgtgggtctgagaggatggagagggctgaacacgggccaaaggagaaagttagggagggaaggtggagtccttggcaggggctcagctcagaacagggggagccccaaaggatgtgaggcaagggagcaatgaacaaatctcaccattgtgagatctgaaattcagaacggtggcataggccagagtaggacattgtgaaaaagaa

SEQ ID NO: 117032 - DNA, 601 bp, Human
ggcacagagcaggttcccagtgagttctggggcctcagtgactgggcaaggacaggggcgtttggacaggggaggccgggtgtggatggaagctgtacgatggggcctgggccagggattgtgggccagctccgagctcagacattggtctgcacatgtggctggtgcaggaggcgcagtgtgctgggcctcagcctggacacggctgtcccatgcgcagagacagggtcacggtggaaagagagtccagagaacatgggaggtgccgtttccctgcggcgggactggggctggggcccgrcttccccgaccctgctgtcgggcgtgtgccttcatagcccaggaagccagttcctggcagggtgggctctgcagccaggccgccagggtgcagacccagaccaatgggaggccaagggaggcccgcagcccagaccttccgagccctcagcctgctcagctcagtgtccttccagggaaatgggcgtttcctgtgggaaggtgccaggggccccgggtgctggaagagcaagcaccacgcgggggggtaggggcgccccagccctctactggccagtgtccctccagtcgtccagccctt

SEQ ID NO: 117033 - DNA, 601 bp, Human
gacgcttccttctttgggttagatgtcgtcgtcttcaacaaatattttctgaatgtctgctatgtactagactctgggaacacaggggaaagtatgtggacctgcccatgaggaagtcagtacagtggggccatgaacaataaacagacaattaattatccttcgcggagctgcgcgggggcagctctcccaaagcagtcagtcattcacacttcagtatgaatgagtctccgggtactttgctcagtaacggactggaccagcgcggcctccacgccagggactggggcaagggtggagkttggagtaaagagagaggcagggcaacccctttccacagacactttaccacctccccacattgacaagctggctccccagggccacccggagccccttcctcagatcctgtccccattggcatggtctcagcccctcctgccccagtaccctctccccgaggcctcgtcctccccgccatcctggaaacgattttgttgtctgcagagattatgtgtaactgcctgtgagttataagcctccacagcaagcagcctgttacctaaccaggcctggctcatgccaatgtcttgagtaatta

SEQ ID NO: 117034 - DNA, 601 bp, Human
gctcgaatgtggggaggccagcaacagagggaacactacctgcaaaggggcgagggcaggacaaaggctggcagcaccacacaggagccagcagggaaggggccacagccgggactcagaggaggcagccacgtgcagaaaggcacccatgggaacatggctcctgggagctggaggacctcagcaggcagggactagcacccaagaagaaaactctgagaagtcaggacaggagatggtgtcgtcagggggctgctggaaggtttggtgaccggagcagcaggtgccagagctgaaagcmctggttaaacgtgatgggtaaacacatgtctatttcagcttctttgaatcccactaaggtgacagtaaaggcatgaaaaacatggaaacatgtaaatcaactagggtaaagtggtcaggagaaaagaggagaccaaaaatatgttgacaaaggtttggaagctgggaagcaggaggacagatggagactggcctaggagactggagagggtagacaccaagccctgcaggaagaagagccaccaagaatgaggcagttcccaacccaggaccctgacaggcaggtctcaccccagcccat

SEQ ID NO: 117035 - DNA, 601 bp, Human
agctgctcagcatgcctacagtgcaaacagtcctgctaagactccaggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaaygcaaacagtaagtacttatttagcctagaattctaatttaactgtattggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaataccaaggtaaagccaagagatagtcggtagggttgaagggctgcctctgggaacagaaattagagatagaagatctagcgcccagggaaggctgtttaaagatgggagagctt

SEQ ID NO: 117036 - DNA, 601 bp, Human
ggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaacgcaaacagtaagtacttatttagcctagaattctaatttaactgtrttggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaataccaaggtaaagccaagagatagtcggtagggttgaagggctgcctctgggaacagaaattagagatagaagatctagcgcccagggaaggctgtttaaagatgggagagcttcacgggttttctcactaagggtaagaaaatctaagaaggaagtgat

SEQ ID NO: 117037 - DNA, 601 bp, Human
ccatttgtaacccaagggaaaacaagaagatgtaatcataacagaccacaggacacagctaaaaacagtgattacatagtgacataaagagttatatactgtttgtgtaaaacgcaaacagtaagtacttatttagcctagaattctaatttaactgtattggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaatrccaaggtaaagccaagagatagtcggtagggttgaagggctgcctctgggaacagaaattagagatagaagatctagcgcccagggaaggctgtttaaagatgggagagcttcacgggttttctcactaagggtaagaaaatctaagaaggaagtgatggtgccagagaatagggaattctgccaataccctggtggggagggggagggggagggggaggaggatgagaaggaaggaggagggaggaggaaggaagagggaggaggaaggaggaggaaggaggaggaaggaggagggagg

SEQ ID NO: 117038 - DNA, 601 bp, Human
ttctaatttaactgtattggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaataccaaggtaaagccaagagatagtcggtagggttgaagggctgcctctgggaacagaaattagagatagaagatctagcgcccagggaaggctgtttaaagatgggagagcttcacgggttttctcactaagggtaagaaaatytaagaaggaagtgatggtgccagagaatagggaattctgccaataccctggtggggagggggagggggagggggaggaggatgagaaggaaggaggagggaggaggaaggaagagggaggaggaaggaggaggaaggaggaggaaggaggagggaggaggaaggaggagggaggagggaggaagagagagaaggaagagattggccaaggagctctgagaggggaaggtgggtgcatgccaccctggctgggaacagcaggtgtgtggtgaaggggaaagaccagcaggccctttacacc

SEQ ID NO: 117039 - DNA, 601 bp, Human
tgggccttcccctctccccatcatcaggtaacccagcacaggctggcccaacccctctctaggcctcagctttcctgtcaggaaaatgcagggttaggagctgaccagggagtctttgaaaccgcaagggtacccttgggagaccccgtgcaggtcttgtcaaggcaggacagggaagtggtgatgatgagaggcagctggtctgggtgctcagccccaccccagcacccgcccaatgggccccctgagggaagctgcccatgctctctgcgccccattttctggcctctggcatgcagakggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtacgtggcccggcctgccctacaccatcagggggtgcttggaccagtggcggctggaaataacccatgaacaggggagagaaggggtgaatgccttgtaggc

SEQ ID NO: 117040 - DNA, 601 bp, Human
tctgggtgctcagccccaccccagcacccgcccaatgggccccctgagggaagctgcccatgctctctgcgccccattttctggcctctggcatgcagatggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtaygtggcccggcctgccctacaccatcagggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccat

SEQ ID NO: 117041 - DNA, 601 bp, Human
ggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccatagtgtcccctccgctcctctctcccccrcttccttccacattgcccctcctcccctctccccttccccaccactgctcccctccttcctccagcacccttctccccgctgccctcccctcccctccccgctgccctcctctgcctctctccgttgccccctcctccctcccccaccagagccctggaaggctaggtacagcgaggaagtggccactccatgacccccagtgatttcacttctctgagcctcaagagtctcacctgtccagggtccatgggatatgcctgactcagcccctggcacatggtcttgcagtggcctgagct

SEQ ID NO: 117042 - DNA, 601 bp, Human
ggccttggcagggtcaggagagccagtgcaggcaaagcaccaagcaccctgctgcctgggagaccacagttgcagcaggaagccctcctcaggtctgcccgcctccccggagcatgttccctctgtagctcccggtagggcctgtgtggagaaggttgctgatggcatcactgagcggcccagctgtggggtgaaaggcaaggctggggctgatgctccccaaggcaggaggagaccatggtctggctggggctgccccaggtgacaactgtagggtgtggggaaggtggctgccaccgcmgtggtccacagggcctggccagggctccatggggcagaagccatgcccagctcagggggcttcactccactctcccactttgacctggtccctcccctctcccccagagtgacctggacactagcctcctcccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcct

SEQ ID NO: 117043 - DNA, 601 bp, Human
cccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggasacaatggcagagtcagggcagccaagccgggccagtgccctggagccgagtcctccccccacctgcccacatgccccacccctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggca

SEQ ID NO: 117044 - DNA, 601 bp, Human
ccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggagacaatggcagagtcagggcagccaagccgggccagtgccctggagccgagtcctccccccacctgcccacatgccccacmcctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggcaagaggctgggttcctggggtgggcaggcttccccgcttcactccatttgcagcccctgtcttgcagaggcaaaatggagg

SEQ ID NO: 117045 - DNA, 601 bp, Human
aatgaggggatgggtctggtagagcaccccagattcaaggcgggtggcttggggaaagcagggagaagggtctggaaactgctgctgagcaggagcccccacacccacagagcaggtgcagggaggcccatctgtccatccgtctgtctgtggggaggcatggtgacgtttcagcccggaggtagaagttttcacccaggaggtagagggtgaggccggactgcactccaaggggaggaggtgggagagcacagcctggctgctgccaccaagctccccagaagaggggacccctcccccygaacaccagcacatgtaggcagaaagacttggcctgtggagccctcagcctccacgcccaccagcagggactgggtggtgatgtcagcaatccccacagaaaggagggctgcacagccgtcccaggagccagcactgtccccgtgattctacatgcagcctccacaagtgtgtcgcatggaaacaagcagtggagagccacatgtgtgtcacatcacgcctcgcctcactcgtgctaaacctcgctgaccaggcagaaccaggcacgagctgcgtatcaaagttgctggaaggagaaaca

SEQ ID NO: 117046 - DNA, 601 bp, Human
agaggacaccgtcttgagccagcagggacagccaagagcgcccggggagaggcctgggtggagacagaacacagcaggctgtgggcgtggccaatgttgagggacggaggtggccagaggcctctcagtggtgcccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactcccyggcccctccctgctcgagaggtgaccaaggcccagggtctcccagcgagcaagaggccattgaactgttgttggctgtgcagtgccctgccctcggggaggcggcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagc

SEQ ID NO: 117047 - DNA, 601 bp, Human
acggaggtggccagaggcctctcagtggtgcccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactccccggcccctccctgctcgagaggtgaccaaggcccagggtctcccagcgagcaagaggccattgaactgttgttggctgtgcagtgccctgccctcggggaggcsgcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcagcgcccagggggccacaggggccggcggcgagggaccctcagccg

SEQ ID NO: 117048 - DNA, 601 bp, Human
cattgaactgttgttggctgtgcagtgccctgccctcggggaggcggcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcrgcgcccagggggccacaggggccggcggcgagggaccctcagccgaggctggtatctcgagaacagcagggatgcctcaaaggttctcgcccagcaagtggacattgtggtgtgggagatcagcaggtgccggtgctttctctgtctgcaggaaggagagggggtcatgggccccagaggcctctgtcttagagaaaaatggtggcaacgtgggacagactgaggaagccagcccagaaacgtcccgtcccaaattcaggaatatttagggtatacctgctgcacgccaagggcagtttc

SEQ ID NO: 117049 - DNA, 601 bp, Human
gtcttagagaaaaatggtggcaacgtgggacagactgaggaagccagcccagaaacgtcccgtcccaaattcaggaatatttagggtatacctgctgcacgccaagggcagtttcaggaaggggacctacttctgagaagcaaacaccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaagraggaagcaggcttggggctgggggccagggaccggcgcgctgggaagcaggctgcagagtgaggccagggatgggggctgggccagaccacagggttgtgagcggactctggcattgatccggagccactgagggttagagcctatgacaggggtctgacttccagtggtatggggccaccctgctgggctggggaagggaggcgagaggaagtatctaaggtctgcttgtggacttccggggacagcgaggggtattgctggggtcctaggggctggtgcactcagaggttccagatgg

SEQ ID NO: 117050 - DNA, 601 bp, Human
accaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaaggaggaagcaggcttggggctgggggccagggaccggcgcgctgggaagcaggctgcagagtgaggccagggatgggggctgggccagaccacagggttgtgagcggactctggcattgatccggagccactgagggttagagcctgtgacaggggtctgacttccagtggtatggggccaccctgctgggctggggaagggaggcgagaggaagtatctaaggtctgcttgtggacttccggggacagcgaggggtattgctggggtcctaggggctggtgcactcagaggttccagatggcccagcaagtggctgagggcccagggtaggggaggatgtgggggcagcagggccgatgtgggcagacctggagcaatgacacgagaacggccaggcagccctggcttcccctgcccacctgcccccgtggccgggctggggtttg

SEQ ID NO: 117051 - DNA, 601 bp, Human
ccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaaggaggaagcaggcttggggctgggggccagggaccggcgcgctgggaagcaggctgcagagtgaggccagggatgggggctgggccagaccacagggttgtgagcggactctggcattgatccggagccactgagggttagagcctacgacaggggtctgacttccagtggtatggggccaccctgctgggctggggaagggaggcgagaggaagtatctaaggtctgcttgtggacttccggggacagcgaggggtattgctggggtcctaggggctggtgcactcagaggttccagatggcccagcaagtggctgagggcccagggtaggggaggatgtgggggcagcagggccgatgtgggcagacctggagcaatgacacgagaacggccaggcagccctggcttcccctgcccacctgcccccgtggccgggctggggtttgg

SEQ ID NO: 117052 - DNA, 601 bp, Human
gagaggaagtatctaaggtctgcttgtggacttccggggacagcgaggggtattgctggggtcctaggggctggtgcactcagaggttccagatggcccagcaagtggctgagggcccagggtaggggaggatgtgggggcagcagggccgatgtgggcagacctggagcaatgacacgagaacggccaggcagccctggcttcccctgcccacctgcccccgtggccgggctggggtttggctgaggcagcagagcgctcgctggctgcccgaacaaagtgttctgcctggtgtcccctkgcctccgggcctctgcgggctcgccagagggggcagctcaggaggcagcggcagagaatcaaatgcaggtggggcctgtgcccaccgccagcacaaacacggctcctgggcccccagcctgcccgacgttcctgcccgcctggcccccaaacagaggccgatgggacgagccctgcccggggttgcactaggtgggcaggtgggcaggtgggcagctgcctcgggctcttggacagagccgcccctgcctggcgtctgccggcaggaagctcctgaggccgggctagggataggccagcc

SEQ ID NO: 117053 - DNA, 601 bp, Human
tcaaaaacccatgtataacttttgactccccagaaacttcactaatagcctcctgttgactggaggccctaccaataacataatcaattaacacattttgtatgcttcatgtattacaataaagtaaagtaaggaagagaaaagatattcattcagcataagcagatcattgtaaaggtcttcatcctcgtcatcttcacgttgagtcagctggggaggaggaggggtggctcttactgtctcgggtgacagaggaggaagaaaatccacgtagaagtgcacccacacggctcaaacttgkgttgttcagggtcgatgatacacaaaaaggacattctaatccagtggggaaaaggtccatcattccataagtggtggggtatcagcaggataacctgcaaaagtaagtctgtaggtcagaaatcaatcccaggcgattcaaagatttagggggtaaaacacaaatcaaaaaagtattaggaaaaaagattttggcgttggaatggaggaggcccttccaagcacgcacaggatgagaaggcataaaggaaaagatggatggctttgaccacgtgaaaaagtgaaaacataagtaagacct

SEQ ID NO: 117054 - DNA, 601 bp, Human
tgaaaacataagtaagacctctgtgtggcaaaacaaaaaaataataaatgccataaacccatacacgagacaaatagcacactagggaaaaacatgtgtgatgtgtacttgacatctttcttaacatagagtccttacaaatcaatgaacgtgaaaaggcccagtcccagcctcagcttctctgctcagcacccaccctgggagggagtgggcttggggggcttctaccccctcactccagccttggggccccgggaaattggccggggcctcacttactaattcaacaaacatttgtgcmgcgccaactctaccctccatgtatttactgggcaccttctaggctccaggctccaggctctgggagactgtctagggttaagacggtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcaga

SEQ ID NO: 117055 - DNA, 601 bp, Human
ggaaaaacatgtgtgatgtgtacttgacatctttcttaacatagagtccttacaaatcaatgaacgtgaaaaggcccagtcccagcctcagcttctctgctcagcacccaccctgggagggagtgggcttggggggcttctaccccctcactccagccttggggccccgggaaattggccggggcctcacttactaattcaacaaacatttgtgcagcgccaactctaccctccatgtatttactgggcaccttctaggctccaggctccaggctctgggagactgtctagggttaagacrgtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcagatcaacacgggcatgctcagtgccggagaggggccagcggagcctctgggggcactgcaaaaggagactggattttactcccagtc

SEQ ID NO: 117056 - DNA, 601 bp, Human
gcagtgaggtggttgtgacagtccaggcagaagatgctgccagcctgggcaaggggcatggggggcaggctcagagcacatgctccagaccagagagccacagacaccaggtgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaaygagggtcgtgtggtgacgatcttgagatattcccccacagtcgtcagccagggacatggcgcccctgaggcccttggggggccaagcatccgtcagtgggcagaggctggcaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgct

SEQ ID NO: 117057 - DNA, 601 bp, Human
tgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaacgagggtcgtgtggtgacgatcttgagatattcccccacagtcgtcagccagggacatggcgcccctgaggcccttggggggccaagcatccgtcagtgggcagaggctggyaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcagcagagcttcctctggctgctcggcagacaacagacaccagggacagagacaaggttgaggatttggtc

SEQ ID NO: 117058 - DNA, 601 bp, Human
cgtcagccagggacatggcgcccctgaggcccttggggggccaagcatccgtcagtgggcagaggctggcaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcrgcagagcttcctctggctgctcggcagacaacagacaccagggacagagacaaggttgaggatttggtctgcagcctctgagcggacacactcaccctcagtgcctgccaattcagccccaccacaggcgccagtcccgagcctgagcacaggggctgccacgacgctcgactctctgggccaagactcacacacagcctggacactgcccgggtgaagggctctgggggacagggggagcagctggtatgtgtgtgaccatgggtcccagactcagtgccatctgtctccccattagga

SEQ ID NO: 117059 - DNA, 601 bp, Human
agggggagcagctggtatgtgtgtgaccatgggtcccagactcagtgccatctgtctccccattaggagaggacgcctggtacctgcccaagcacccaagccatgggagttgctgcttgctctccacgcagctttgtcccagcagcacccccaactcctgtgatgggttgcagggggtgctcacctctgtggcacacacaaaggcccaggggcctgggggtgcaggcaggtgcactccaacccttgggcagcccagagaacaacctaatggaaagtgaagggaattgtacaagtgtgtacmagggtgcagggtggttcctgccttcttgcacgcacagtctcccacactcatacagccacaggttcgtacgaggtacacatatgtgggctcacctagcatgcctcccgtgtgcacagcagtgctcctttggcctcaggccacaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtgctacagct

SEQ ID NO: 117060 - DNA, 601 bp, Human
agccctgtctcctgtggccaccaacagagctgtgcgccctccccgaaccctcactcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagaycacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataat

SEQ ID NO: 117061 - DNA, 601 bp, Human
actcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagatcacctggctgtccactcgtttggggcttctctgctgcctccgcagcactgcraggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataatggttcctgggggatgacaaaaaaacccacccccacccccttgcagaaagcat

SEQ ID NO: 117062 - DNA, 601 bp, Human
ccagcctcattccccagcggtgctgtccttccaaggagctctcagatcacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgyctgggaaaatagtggtgtccccgctaggttaaagacatggcataatggttcctgggggatgacaaaaaaacccacccccacccccttgcagaaagcatcacagaggcacaagccctgtgccctgcaagcccctcctggaagtggcccagcaggggcatcccctgcacacccaggcaaagcccaagccctctgcctcctcaaccaccccaggccctgcccatgagccagccttgctgaactctgccctctgtccagttctcctccagacacagtagacatagcccccagcctttcttgacc

SEQ ID NO: 117063 - DNA, 601 bp, Human
aagcctggcctcaagaagccaaaggctgccgcaaacccaaatatttcaggtccgggtccctggtgcagaccctgccatgcggggatgtggcacagaaggccggccagcctggggagcagagaaggaggagaggagagctcctggccctgagcctgaatgcctgtggacacatatagggactcccagcacgcacgggatggactccaatcggcacacatgcacattccttgcacacacacaggcgcgaccgagggccttgcagacatagggtgcacacgtgcgtgccgcctgcatacagcaygcacttgcagagacggttggcaccttcccttctctggccccaaacctgggccctgaggctgtctgcacacctgggtgcttcccaccactgactctctcgtctgcctttgtccccgcaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccct

SEQ ID NO: 117064 - DNA, 601 bp, Human; identical to SEQ ID NO: 18291

SEQ ID NO: 117065 - DNA, 601 bp, Human; identical to SEQ ID NO: 18292

SEQ ID NO: 117066 - DNA, 601 bp, Human
tgaaagccttcgtaaagccccaagcccttttactgtgtgtacgcgtacccctggcgtcctctgccccatttccctaaataccaacctcaggtgccctccgcccacctcccggaagctgccaggtctgggcagaaaaccaaaacaacccttgggcctttgtctcccctctaaaggccagctggggcaagagggagcgagggcccgcccaggcaccggctggggaaaggctgtttgatgtagggccacctcccggggtgaggatgcaaggggacctcggcaggaaccaagtgaggaaactgargctgggtggtctgggcagcgccccgctcgggctcgggtccccgcggggtctgtgctccagccacgggtctggcagaccctcacgcaggagtcccaggggtcccagtggccgtccctcggagccgggcacccgttgtccttcggatcctaggacgtgccacccctcgaacctcaggacccgccgtccctcagaccccgggcactgacacccctcagaccccgagcacccccgcccctcggacccaaggacgtgccgtccctcagaccccgcgcactgacacccctcagacctcgggcactg

SEQ ID NO: 117067 - DNA, 601 bp, Human
ctacccgctggtgacatgagtgactgggggagctgacacagctgtgtccctggggaacctcccgggttggcaataaaatggggcagtaatgctctgacaatcagcttgcagtggactgcctgcggaactggagatgaaagccttcgtaaagccccaagcccttttactgtgtgtacgcgtacccctggcgtcctctgccccatttccctaaataccaacctcaggtgccctccgcccacctcccggaagctgccaggtctgggcagaaaaccaaaacaacccttgggcctttgtctccccyctaaaggccagctggggcaagagggagcgagggcccgcccaggcaccggctggggaaaggctgtttgatgtagggccacctcccggggtgaggatgcaaggggacctcggcaggaaccaagtgaggaaactgaggctgggtggtctgggcagcgccccgctcgggctcgggtccccgcggggtctgtgctccagccacgggtctggcagaccctcacgcaggagtcccaggggtcccagtggccgtccctcggagccgggcacccgttgtccttcggatcctaggacgtgccacccctcg

SEQ ID NO: 117068 - DNA, 601 bp, Human
ggaggcgatagtaaaggcaggtgggccatgccctggggcagaagaacactggctggagatgctgtgcgcaggctgaggactgggcaatctgcctgctgccctgacagcccggagagggcaatcccaacctatatggcaagctccaaaaagaaggcaattcttacaaggctctgaaaacctaaaattctaaagctatttttaaaaacaagatacaaaacactactaatacgtcatttacgttcacaaatgaacaaaaacacatttttagtttgaaaacaaacaggccctaactttcagcacrgacacagcacttaattgagtgccaggcactgttctacgtccttcccatctattaattcatttacactccatgctccaaggtaggagccattacgcatggtttgctgtggggcgggaggcagagttgggaccctggcccttccagggtggttccagagttggggctgttaactatgatgctgttttacaggaatctgggtgacttctgagggccgcttggctctgggacgggtggagatggtgctggaatccaggcacacaggtagggtggtaggcggcgtgcctggaaggtgaccacctc

SEQ ID NO: 117069 - DNA, 601 bp, Human
tcctaacggcggctgcagtggcttttgagtgctgaggaagcagtctgggaactgaagccgctgtgtatccgctctctggagacctgaggggcggccccgacgccctccagggctgagtacctacactcacacacacggcggcatttcctcacggtaaaacacgctcataacatcagccctgtaaagctgcaggccattaagtcaaatgacacttgtaaaatgtttaaaagctgcctggcacagagccaggggccccatttgccatcattattatcataatcgctctggtattattaatgtyattgtaatagccgcatgctacacacagagaatttcctggagttttcctagggctcacacacccatttttatttaattaattttattattttaaaagtttattaccaaatctgccttgatcttggatcacataattcttaaatgtaccgtctagagcaggctagacggctcatcaaaagggaaccaagtccatgcttgggaaggatcttctcagagcagaaaggtgctggtgcccagggaagcacaggagaatgacaggcttccatgagatggacgcagacagtcatttgggtaatcgtgg

SEQ ID NO: 117070 - DNA, 601 bp, Human
caccagtggtgggctggcgttcccctgtggcactgggcctcatgcacccttctcagaaagacacctgcacaaagaccagtgctgggaaccggccacagcctctgctgctttgagcccccaggggcttgcttagcaggagccctgctgcccaaagataccagagacacaagaacaagtcacttttcacttcagctcttccaacagtccaaggaaagagaaagacaggggtggactctggccccactgaaggcgcctggggggtgccgggagctcttgagggcctctcacctgccccatcccyacagttacaggcccagtgtcagcactgacactgccggggcttccctctgagaaggaggaggctgcttacatggagatgcgctctcctcccaactggagatgagatcagggaggacggaggcggaggcagacccacagaggcagctccaagcaccccaaagcgaggtcctggaaaactaactctaaataaatatcagactcctacaaactcttttgcagagcaacttccagccaggagacttctagtttagctggatatttccctccaacagctctgcagctgccagcaggggtcccattt

SEQ ID NO: 117071 - DNA, 601 bp, Human
agataaaatctggctgaagtgcactggcgcaatctcaactcactgcaacctccgcctcctgagttcaagcgattatcctgcctcagcctcccaagtagctaggactacaggcacctgccaccacgccccaccaatttttgtatctttagtagggatggggtttcaccatattggccaggctggtctcaaactcctgaccttgtgatctgcctgccttggcctcctaaagtgctgggattacaggtgtgagccaccgcgcctggcctgtgcttttgtttctttggaaaaaatgaacacacattcgttgattccagagtcccaccctgacctgagtgatccaacaacagaccaactatgaaccgctcatgagagacatggctttgaaacagggatgtgggaggctgaagataaaatgatggagagggaagccaggaagtggcaagcagtctgcctacaacacaccagatgcagataggacccaagcaaggggttcatggagagaaatccttcatcaggaagttaagggtcctccatcggaggggtgagagcaacaccaaaccttcatgttcctgaaactatggcctcggcgtctgacagaccc

SEQ ID NO: 117072 - DNA, 601 bp, Human
atgactaacaggccaaggggaggaaggagggcggctgcactgtgtctgggcagtgggggtactgtgggcaggtgggagatggggcaggagacggagagagggccagtgctcagcaggagcccccactctaggtgagttccagtggtcacaggtggtcagattctaaagcgtaggcaatctccaatcttaatcaaacatcatgtgcttattgaggccaagtgcagctcggcctcagtgtactttaaatgcctcacaagcccttgaaggagaatctcactcaatgcctggaggcattcaaccsgccactctaggatcccatcactctcctccctcacaaagaccctggagctccttcaataggacactgctgccatctcagacagctggagacgctgcccagaaacacagccatgaggccacgggatcatcacactcaccctgctatgaggaaacggcccagggttcacaggactgaaagcttgtccaagaagcctggccacagccagcattcctgctcccctaaggctgctatctccacacagctggcgatgggctccccaggaaaacgggttaccaggcccagatatacaaattcagattt

SEQ ID NO: 117073 - DNA, 601 bp, Human; identical to SEQ ID NO: 23165

SEQ ID NO: 117074 - DNA, 601 bp, Human; identical to SEQ ID NO: 88218

SEQ ID NO: 117075 - DNA, 601 bp, Human; identical to SEQ ID NO: 88219

SEQ ID NO: 117076 - DNA, 601 bp, Human
cataatttttctgccagaaaactgagatggatgaccctgaagtccagtttcttcataagtgtctttatccagtgacaaaattaatttccctataaatcaaataataactcccataagataccaaaactagaacttacgttgtctgactaaaagaaagcaaggcaaattgagcagttagatatcaatgtaacaaactgcatacaaggatcttatttatatcacaagaatattatttatgtgtatacatgtcttgtaacagatattatttatacattatacatccaaggatattatttataayagtgaaatttaaaataatctgaatttctactaaagatgaaataaataagtcatggtatactcattcttttgaatatcttctttttttttttcagacaatctcattctgtctcccaggctggagcgcagtggcgcaatcttggctcactgcaacctccgcctcccaggttcaaagcgattctcctgcctcagcctcccaaggagctgggactacaggcatgagccaccacgccggctaatttttgtatttttagtagaggcagggtttcaccatgttggccaggctggtctcgaactcctg

SEQ ID NO: 117077 - DNA, 601 bp, Human
aaggggagaaatagataaaatttagctgctctgaagccactctcaagatctctggatctacatataacccaaagagacgcaggcagaaaggcctgcgtgcctacatgatcctgaactatggttttcagagatgtcagaagggctagtttccttaataatatttttatatatacgtatagaatattccttgactaaagagtgaatcaccattcaatcctccattactcctctttaattaacaattactttcaaaatcactgtatcattacataatttattcctcatacctgttttatgccargccaaaagaaaatcaaatttcaatggcttcttttctttgaaagaccaagatattctttcatacttcttagaatccaagtttaaggataattccatcaaatcaatggaaacaactttaaaaatgaaaaaaagaacatatatttcattcatatacgtacagcttctaccatggaaaaagtgttacatttttaaaaactagaattttgggaaattttatggatagtaaaattgttttattcttcttccactccctttggtttgccaaataaataagatccctttggtgggcacttctaacctt

SEQ ID NO: 117078 - DNA, 601 bp, Human
attacgctgtgtggtgaatagcaaactttgaactaaatttagtgtcctaatcaattaaaagttagaataaattcatctgacatttaatggtaggcctgagtcagtaccctgtgataataaataagcagattgtgtatataattggtgctacttaaaaatattatagtcaaggctgttcaaggtaagctggagagaggaaaggggagaaatagataaaatttagctgctctgaagccactctcaagatctctggatctacatataacccaaagagacgcaggcagaaaggcctgcgtgcctrcatgatcctgaactatggttttcagagatgtcagaagggctagtttccttaataatatttttatatatacgtatagaatattccttgactaaagagtgaatcaccattcaatcctccattactcctctttaattaacaattactttcaaaatcactgtatcattacataatttattcctcatacctgttttatgccaagccaaaagaaaatcaaatttcaatggcttcttttctttgaaagaccaagatattctttcatacttcttagaatccaagtttaaggataattccatcaaatca

SEQ ID NO: 117079 - DNA, 601 bp, Human
gctttaggaatagggagctatccagaatccaacgtctggatgatctgcatagaagacttcacgcaactgaaacttcaataagcctttttgccctcttttctatctaccatatatggaaggagaggcaccgaaggccagacctaggactcatgggagcaacttggagcacccagtgaccagacacttcccatgaggagcagacagatggggctatttctaaaacagaccaccatgcttcctatcctccaaaagagagtactacaccataattcctgatgacttgatccattattatctgggycaaagatacacttctaaaaggagcaacatacatggccgttttaggcagattacgctgtgtggtgaatagcaaactttgaactaaatttagtgtcctaatcaattaaaagttagaataaattcatctgacatttaatggtaggcctgagtcagtaccctgtgataataaataagcagattgtgtatataattggtgctacttaaaaatattatagtcaaggctgttcaaggtaagctggagagaggaaaggggagaaatagataaaatttagctgctctgaagccactctcaagatctctg

SEQ ID NO: 117080 - DNA, 601 bp, Human
acccagggcttatgtgtcttctgccagcatccctgagactgtagcaggctacctagttagcctgcaagtatgaggaaatctcagaactttcacagtcctgacaaatccttaaaacagttaggagctttaggaatagggagctatccagaatccaacgtctggatgatctgcatagaagacttcacgcaactgaaacttcaataagcctttttgccctcttttctatctaccatatatggaaggagaggcaccgaaggccagacctaggactcatgggagcaacttggagcacccagtgacsagacacttcccatgaggagcagacagatggggctatttctaaaacagaccaccatgcttcctatcctccaaaagagagtactacaccataattcctgatgacttgatccattattatctgggccaaagatacacttctaaaaggagcaacatacatggccgttttaggcagattacgctgtgtggtgaatagcaaactttgaactaaatttagtgtcctaatcaattaaaagttagaataaattcatctgacatttaatggtaggcctgagtcagtaccctgtgataataaataagcaga

SEQ ID NO: 117081 - DNA, 601 bp, Human
ccatcctattggtcctttctctctggagaaccctgactaatacattttggctactaccattcctctgaggaattaagtcctgtgtctctgacccagggcttatgtgtcttctgccagcatccctgagactgtagcaggctacctagttagcctgcaagtatgaggaaatctcagaactttcacagtcctgacaaatccttaaaacagttaggagctttaggaatagggagctatccagaatccaacgtctggatgatctgcatagaagacttcacgcaactgaaacttcaataagcctttytgccctcttttctatctaccatatatggaaggagaggcaccgaaggccagacctaggactcatgggagcaacttggagcacccagtgaccagacacttcccatgaggagcagacagatggggctatttctaaaacagaccaccatgcttcctatcctccaaaagagagtactacaccataattcctgatgacttgatccattattatctgggccaaagatacacttctaaaaggagcaacatacatggccgttttaggcagattacgctgtgtggtgaatagcaaactttgaactaaatt

SEQ ID NO: 117082 - DNA, 601 bp, Human
cttgcagacagcctgtcgtgggactcctcagcctccataactgcatgatcaatttccctaataaatctcctctcatccatccatccatccatccatccatcctattggtcctttctctctggagaaccctgactaatacattttggctactaccattcctctgaggaattaagtcctgtgtctctgacccagggcttatgtgtcttctgccagcatccctgagactgtagcaggctacctagttagcctgcaagtatgaggaaatctcagaactttcacagtcctgacaaatccttaaaayagttaggagctttaggaatagggagctatccagaatccaacgtctggatgatctgcatagaagacttcacgcaactgaaacttcaataagcctttttgccctcttttctatctaccatatatggaaggagaggcaccgaaggccagacctaggactcatgggagcaacttggagcacccagtgaccagacacttcccatgaggagcagacagatggggctatttctaaaacagaccaccatgcttcctatcctccaaaagagagtactacaccataattcctgatgacttgatccattat

SEQ ID NO: 117083 - DNA, 601 bp, Human
ccctccctctctccgggcagatatcagcaggcttactgtcccttacaaaggactggagttcttaaactccaggttcctctcctgtaatgcaacctactgcatgtgccagcatcgcttggtgtcactctggaaatgggacttggtgaactggtgcaaatggtgatattcggtgtgatggttaattttaggtgtcaacctgactggatgaagggtcatctagatggctggtaaagcattatttctaggtgtgtctgtgagggtgtttctggaggagactggcaggtgagtgggtaaactgagygggaagatctgccctcactgtgggtggcaccatctacccggctagggccccaggtagaacaaaacgtcagaggaacagtgaattcgctgtcccttggagctgggactcccttcttcccctgcccttggacagcagaactccaggttctctagcctttggactctggggcttgcaccagcagatccacaggttgtcaggctttggccttggactgagaattataccatcttctttcctgattctcaggccttcatatttggactgagccaggctaccagcatccctgggtctcccacttgc

SEQ ID NO: 117084 - DNA, 601 bp, Human
ctgttctcagagtctcagttaactgaaacgttgcaggataattcaccagatttttcatatccagccttcctatcgaagaaagtcaaagtactaaaccaataaatgtgaaaaaggatgttgggcttaaaaaggaaaaccttcaagacttaaatctgacatttcaaaagggaagactgagaagatatgcttactaaataggattatactcaatgtacggtctttgcaataggcgatttgagttcctttcaatgtacattttatttatataccacctcccaaaatgaaaaaatctatactattygacatactgttctatagagcactgatgagcgatataaaaggtaaagagttctcaccagagatgttccaataggagacagatcttctctggaagtatgaagccagtgattgtacacaaataagcttttgccaccactgtgcttggctcaggacagcaataggttgatatgaaattattaggctcattatttctgtcaccaaaaaaataaaagagagagagataacacatgtatatccatcacatgatcacttccaaagtattaaactcctattaaaaacaagcagcaggccagagccctgg

SEQ ID NO: 117085 - DNA, 601 bp, Human
tgactgaaaaaaaggtagttgttaaacagagttttaaaagagagttaggaatgtctgcattttaaaaaatttattcaggataagtagtatttctgatattctaataaagcttagatcttagctttaatttttgaaaatcaagaggtgtgtgataagttcctgatgtcacactgtgaactccataaggattaactaatatacaacacacgaaacaaacctcagctgttcccaccctcattctgggaggtctttaagacaaaaagaacccaaaacaaaaaaccccacaggcgtttaaggatcstttccctcctattaagagtactgttctcagagtctcagttaactgaaacgttgcaggataattcaccagatttttcatatccagccttcctatcgaagaaagtcaaagtactaaaccaataaatgtgaaaaaggatgttgggcttaaaaaggaaaaccttcaagacttaaatctgacatttcaaaagggaagactgagaagatatgcttactaaataggattatactcaatgtacggtctttgcaataggcgatttgagttcctttcaatgtacattttatttatataccacctcccaaa

SEQ ID NO: 117086 - DNA, 601 bp, Human
ccatgttcatttttttcccaagaaacagggctgtctgcaaagccttgaacggacagtgtaacccatggagctaacttcggttcatcaaagtagtgactgaaaaaaaggtagttgttaaacagagttttaaaagagagttaggaatgtctgcattttaaaaaatttattcaggataagtagtatttctgatattctaataaagcttagatcttagctttaatttttgaaaatcaagaggtgtgtgataagttcctgatgtcacactgtgaactccataaggattaactaatatacaacacaygaaacaaacctcagctgttcccaccctcattctgggaggtctttaagacaaaaagaacccaaaacaaaaaaccccacaggcgtttaaggatcgtttccctcctattaagagtactgttctcagagtctcagttaactgaaacgttgcaggataattcaccagatttttcatatccagccttcctatcgaagaaagtcaaagtactaaaccaataaatgtgaaaaaggatgttgggcttaaaaaggaaaaccttcaagacttaaatctgacatttcaaaagggaagactgagaagatatgc

SEQ ID NO: 117087 - DNA, 601 bp, Human
accccctccctcaccaccccatctgcacacacataggcaactacgtaaactcacttggacccctcatccccatggatctatgtacaaacccccatacttccgccacacacccacacacaggcacacatgcttccatacacctacccgcacacactggcacatgtgtgtacacacgtgcacctttccacatgcacacctacatgcacacccccccataagtacatgaacacgtacacatccatgcatacacggctccccacatacccacctgcacacacacaccgtccaaacatgggtaggrcagaggctgacacatacgcacccctctgcagtgcatgactggcccgggacccgcatcaggaacgtaccttctgcagttctggctgttcatggaaggcacaggtgtccaagttgggctgggacttggtacatatggtgcggcccacctctacgtcgaagaagtaattcacccccccaaaggtctgcacacaggagaaaacaggaagcacggacagcgcccccatcagttcatgcactcacaggcacttcactgtggctgagtcactggacttgcttgggggcttcgtgagctgcccacatg

SEQ ID NO: 117088 - DNA, 601 bp, Human
ctgggattagacagatccccttctccctgcccagcacccagccccgcaggtgattcttcctgtccaacaggcaacaccccaaagcaggcagttgaccttctagtaaccattcccaagctaaagccttcctagcaaatcaaacacatcaccccctccctcaccaccccatctgcacacacataggcaactacgtaaactcacttggacccctcatccccatggatctatgtacaaacccccatacttccgccacacacccacacacaggcacacatgcttccatacacctacccgcacacaytggcacatgtgtgtacacacgtgcacctttccacatgcacacctacatgcacacccccccataagtacatgaacacgtacacatccatgcatacacggctccccacatacccacctgcacacacacaccgtccaaacatgggtaggacagaggctgacacatacgcacccctctgcagtgcatgactggcccgggacccgcatcaggaacgtaccttctgcagttctggctgttcatggaaggcacaggtgtccaagttgggctgggacttggtacatatggtgcggcccacctctacgt

SEQ ID NO: 117089 - DNA, 601 bp, Human
atggtgatcttcttgctggtcttgccattcctggacccaaagcgctccatggcctccataatattcatgccttctttcactttgccaaagaccacatgcttgccatccaaccactcagtcttggcagtgcagatgaaaaactgggaaccatttgtgttgggtccagcatttgccatggacaagatgccaggacctgtatgctttaggatgaagttctcatcttcaaatttctccccatagatggacttgccaccagtgccattatggcgtgtgaagtcacgaccctgatacataaaccctrgaataattctgtgaaagcaggaacccttataactaaatcctttctctccagtgctcagagcacgaaaattttctgctgtctttgggaacttgtctgcaaacagctaaaaggagacgcggcccaagggctcgccgtcgatggcaatgtcgaagaacacggtggggttgaccatgcctaataatacaaggttttcctcggcagcagcgtctgtctggctccatcaccaaggctggagtgcagtggcacaatctcggctcactgcaacctccacctctcgggttcaagcaattctgctgtctc

SEQ ID NO: 117090 - DNA, 601 bp, Human; identical to SEQ ID NO: 18137

SEQ ID NO: 117091 - DNA, 601 bp, Human
aagaaatgcatccttaggcaattttgtcatgacgcgaacatgatagaacatacttacaccaacctagatagtatagcttactacacacctaggctacatagtatagtctatcgttcctaggttacaaacctgtacagcatattactgtactgaatactgtaggcaattgtagcacaatgttaagtatttgtgtatctaaacatagaaaaggtaaactaaaaatacaatataaaaaattaaaaatggtacacttatatagggcacttactatgaatagagcttgcaggactagaagttgctstgggtgagtcagtgagtgagtggtgagtgaatgtgaaggcctaggacattactatgcactactgaagactatataaacactatatacttaggctatagtaaaataatttaaaaattaagtaattctgctgctatgttatgatggccacagtgtcaccaggtgacaggaatttcttagctccattataatcttatgggactaccatcatatatgcagtctgtcattggccaaaatgttgttatgcagcatacaactgtacttacattgatgaaaacaaagatgtttggtgggtactaaaac

SEQ ID NO: 117092 - DNA, 601 bp, Human
caatactaaatatagtcatgtgttacttaacaatggggatatgttctaagaaatgcatccttaggcaattttgtcatgacgcgaacatgatagaacatacttacaccaacctagatagtatagcttactacacacctaggctacatagtatagtctatcgttcctaggttacaaacctgtacagcatattactgtactgaatactgtaggcaattgtagcacaatgttaagtatttgtgtatctaaacatagaaaaggtaaactaaaaatacaatataaaaaattaaaaatggtacacttrtatagggcacttactatgaatagagcttgcaggactagaagttgctgtgggtgagtcagtgagtgagtggtgagtgaatgtgaaggcctaggacattactatgcactactgaagactatataaacactatatacttaggctatagtaaaataatttaaaaattaagtaattctgctgctatgttatgatggccacagtgtcaccaggtgacaggaatttcttagctccattataatcttatgggactaccatcatatatgcagtctgtcattggccaaaatgttgttatgcagcatacaa

SEQ ID NO: 117093 - DNA, 601 bp, Human
ttggactcatctttgttcccctttttgccctgtaaatccaatcaattgttaagctctgtttgcttctaccacttgcacctttgaagctccaggctgtccccactccaatttctcctatatacttctggcagaaaaatcttcctgagttattccccaggtaaaaaggctttgaaggttcattatgacctacaccaaaaatctaaactgttcaccctggcatcaccacctctgagccagtgtgcatgctgctttctcatggaatgcactcctttccctatctccttattaaaaccctacctayattttaaggccccagtcaaacaccatcttctccatgaagtcttctttaatatccatggacaatctgtcattcctttaagtccctacccctcttgccaatttctccccaaatgaagacagagactacatcataagcatatcatagctccctgtagagcctagcttaaagtagacacctactaaatctaatttggataaatgaactaacataagggactctgagtaaataaagtttacagctacatttctatgctgctcctcaatactaaatatagtcatgtgttacttaacaatggggata

SEQ ID NO: 117094 - DNA, 601 bp, Human
caaccactgactgatccagttctttctcctttgcaggctctttctcttcccaccaccccctatagataggtttttccttaggttcagacttcttgctgaacaatcaaccaggctaactcaactagccccacagcttcaatgatcatttctgtgtatgggcctctctccaatttcccattttcaaaagcacttctccacatacccctccaaatccactttttgttatcctattttcagttaatggcacatcatttcccagtttcccaggctttggactcatctttgttcccctttttgcccygtaaatccaatcaattgttaagctctgtttgcttctaccacttgcacctttgaagctccaggctgtccccactccaatttctcctatatacttctggcagaaaaatcttcctgagttattccccaggtaaaaaggctttgaaggttcattatgacctacaccaaaaatctaaactgttcaccctggcatcaccacctctgagccagtgtgcatgctgctttctcatggaatgcactcctttccctatctccttattaaaaccctacctatattttaaggccccagtcaaacaccatcttc

SEQ ID NO: 117095 - DNA, 601 bp, Human
taaagtgaccaataacattcagagatgtatgccatctttacaacaaaggttgtttttgaatattattcatttcaggacactccataccagaatgaatttttagtctgtgaaatgaaaggaacattataaaacaatcctatgctgcacatcacctaccaagccacaataattgctgtccgcagtaacttagaggctcttctcactcagttgctgagtgacccctgattgaccatgattacaaccactgactgatccagttctttctcctttgcaggctctttctcttcccaccaccccctawagataggtttttccttaggttcagacttcttgctgaacaatcaaccaggctaactcaactagccccacagcttcaatgatcatttctgtgtatgggcctctctccaatttcccattttcaaaagcacttctccacatacccctccaaatccactttttgttatcctattttcagttaatggcacatcatttcccagtttcccaggctttggactcatctttgttcccctttttgccctgtaaatccaatcaattgttaagctctgtttgcttctaccacttgcacctttgaagctccagg

SEQ ID NO: 117096 - DNA, 601 bp, Human
taaaagtacaggttgcacaaaggttgtatgattcaaacaaaagaatactgcaatgaagcgttccaaaaggaaacagtgagccttaagagtgatgtttcccagatttacgccagtcacctgtattcatccaccaaaaaaaaagtttaatgaagtaaggaacatacatatttgaactatttacatatattatttgactcaaacatgttttttaaaatggcttaggggattacacaacgtatcagaatagggcactttctacagtctcctaataaccaaatgttaactatgaaacaggggaatyactgctgagatgtgcagtattcttctgagtctccccgccccaaccccatttccaagttctaaaaatttacctagggttctgttaactactgctacaaaaacaaacaaaaaacaaacctgtagtcccagctactcgggaaggggaaacggaggtggaggctgaggtgggaggaattctagtcgcacctgggcaacatagtgagacccagactttcgagaatacatacatatatttctcagtttgttttagtgttactcaaatttcctaaataatttcgtatatatcttatccatgtttttc

SEQ ID NO: 117097 - DNA, 601 bp, Human
ctaaaccaatgctggggcctcgggagccaggcagggaaaggtttagaacagaacagacagagcaactctgcctacttgtaccagagaatttttccatcagaaaacaatgaactttcaagaaaaatttatattgaagaaaagaattcacggtttttaagttttaaaatcatttgtctaattctattttgcgccttctgttttatttcattagaacagaatcaaagtgttcataatagcaattttttaaaagtacaggttgcacaaaggttgtatgattcaaacaaaagaatactgcaatgargcgttccaaaaggaaacagtgagccttaagagtgatgtttcccagatttacgccagtcacctgtattcatccaccaaaaaaaaagtttaatgaagtaaggaacatacatatttgaactatttacatatattatttgactcaaacatgttttttaaaatggcttaggggattacacaacgtatcagaatagggcactttctacagtctcctaataaccaaatgttaactatgaaacaggggaattactgctgagatgtgcagtattcttctgagtctccccgccccaaccccatttccaag

SEQ ID NO: 117098 - DNA, 601 bp, Human
gtgcaagtccaatttgagctctttagtatttcattctactttttctaattccattctcttgtccagaagttacaggagggcctcaaattcattctttcacccttaaaatgcctttggggttctgaattcagtcatgcttaagctaatatgtaactacttgaagctctggcttatggcactggccataaaataatctagacacagtttttttgtttgtttgtttttttaatctcaacagcagtgcctcctttacaactgtaggactaaactgtgatccactaaaccaatgctggggcctcgrgagccaggcagggaaaggtttagaacagaacagacagagcaactctgcctacttgtaccagagaatttttccatcagaaaacaatgaactttcaagaaaaatttatattgaagaaaagaattcacggtttttaagttttaaaatcatttgtctaattctattttgcgccttctgttttatttcattagaacagaatcaaagtgttcataatagcaattttttaaaagtacaggttgcacaaaggttgtatgattcaaacaaaagaatactgcaatgaagcgttccaaaaggaaacagtga

SEQ ID NO: 117099 - DNA, 601 bp, Human
cctcctgcaagactcttcacctaccaaaagagattaatctttaaaggcctttaatcataaaatgaccatatcatacattagcaaaaggtggttacttcctgttgggaaagtgctatcagagaagggggggaggaggctgggcacagtggctcacgcctgtaatctcaacactttgggaggccgaggcgggcagatcacttgagggcaggagttcaagaccagcctggccaacatggtgaaacctccatctctattaaaaatacaaaaaattagccaggtgtggtggtgcgcacctgtagtmctagctactcgggaggctgaggcaggaaaatcacttgaacccgggaggcggggttgcagtaagccaagatcaggccacttcattccagcctgagagacagattcgtctcaaaaaaaaaaaaaaagaaaaagaaaaaagaaaaggtgggaaggagaggatagtgtcaacacctttacagagaaagctcctatctgaaggtccttgtcttttcttcagggactatgactattttaaataaaagaggattaaagcttcttgtatatttgtagcactatacttatcgtactaaattacaggtct

SEQ ID NO: 117100 - DNA, 601 bp, Human
catataatccatttgaaatgcccaaaatagctaagacaattataaaacagtggggaaaaaacagacaattcaatccacagtgattagacaattgattattgtctattgtcaactggttatccaattcaattcctccgcagaccttatacaaaaattaattcctggtggatcaaagacctaaatgtgaaaatcaaaagtttagtaaaacttgcagaagaaaatatgaaaatatctgtataacctcagggtggagaagggtttcttttctttactacaggtgtgagccaccacactcagcccygaagcctttcttaagaaaaataaaattaagggagaatgacaaatatcactaagtgaaaacccacattttctttacaataaaagacaccagaaacaaacagaactagaatacagatttgtaacatacatacccaactaaagattagtaagaaatgtatctggaactctaaaaatcaattttgttttattttttggtgttggtttttggtttcgtttttttgttttgttcgggagacaggatctggctctgtcacccaggctggagtgcagtgacgcaatcatggctcactgcagcctcaac

SEQ ID NO: 117101 - DNA, 601 bp, Human
agggtacgtttaccgaccaagaaaatagtttgcgagttttcagatacaataacaatttcactgaataacagatttttcatccaactgctatcatttaaaaattacactaaatatgagggagactgtacataataaaattttttaaatccttcatcatttcccttcatgctttttttaaatatgagattaaacacagttctgagcttgcattaaaagtcagtaagaactggaactacttcacaagacacttcattttcaacatttcttaactggaggaaactaaagaaaggcctccctgaakgcaacagagatcgccataacaggtctccatggtgaagaactgtaaatgttccacaaggtgctatagggacagagaggtgcttgtcctttaagcatagcagccacagacccattaagaaaataacgctaaaggaagtctaaaagctgggagcaacacttactacaccaaaaaagatagcagatgccaataagtcaatgtgaaacttaatcctaaaaaacaaaggatgagggaaaagaatgtttcaacaataccaaaatgcctcaggaactaatatccttctcacccatggtgttggacaaa

SEQ ID NO: 117102 - DNA, 601 bp, Human
gctttcttactagcttataagctttggagtagttcacctccattctgactcaaacccaaatccatgttctcatttgtcaaatggagattaaaatagctgccgtgcttaaaagagttgtgaaaattaagtgaaaagaaaaatggacaaaatatttaaacaagtagtactttgaaaaagagaacattcatttagcaaataaatatatttaaacgtgcccaaaatcaagagttatcaagtaaatgcacattaaaactacaatgaaggccgggcacagtggcttatgcctgtaactccagcactkcgggaggtcaaggcgggcggattacataaggccaggagttgcagaccagcctggccaacacagcgaaactctgtctctactgaaaatacaaaaactagccaggcatggtggtgcacatctgtagtcccagattgaacctgggaggtggagggtgcagtgagcccagatcacgccactgcattccaggctggggggcagagcaaggctctgtctcaaaaacaacaacaacaacgacaaagcccacaatgacatacccactagaatagctaaaaattttaagactacatcatcatgtagtga

SEQ ID NO: 117103 - DNA, 601 bp, Human
ctattaaaaaaaaaaatacaaaaaattatctgggcatggtggcatgcacctgtagtcccaactcctcaggaggctgtggcaggagaattgcttgaacccaggaggcagaggttgcagtgagccgagatagcgccactgcactccagcctgggcaacagaacgagactctgtctcaaaaaaaaaaagtctccaaggcagccactaacatgccaaaaagttacagatagagaatcaaaagcaaacaggccaggcagatgattacattacctctgcagactgagaaaaccattatgcacactcygtatgcacctgtggagtactgtcaggcttcaggggggtggcgcgggatacacatcaccaataaaacaacgaggacctgccttgcctacatccatctctgaagctttcttactagcttataagctttggagtagttcacctccattctgactcaaacccaaatccatgttctcatttgtcaaatggagattaaaatagctgccgtgcttaaaagagttgtgaaaattaagtgaaaagaaaaatggacaaaatatttaaacaagtagtactttgaaaaagagaacattcatttagcaaataa

SEQ ID NO: 117104 - DNA, 601 bp, Human
caatcccagcactttgggaggccgaggcgggcagatcatgaggtcaggagatcaagacgagcctggctaacacagcgaaacctcgtctctattaaaaaaaaaaatacaaaaaattatctgggcatggtggcatgcacctgtagtcccaactcctcaggaggctgtggcaggagaattgcttgaacccaggaggcagaggttgcagtgagccgagatagcgccactgcactccagcctgggcaacagaacgagactctgtctcaaaaaaaaaaagtctccaaggcagccactaacatgccaraaagttacagatagagaatcaaaagcaaacaggccaggcagatgattacattacctctgcagactgagaaaaccattatgcacactccgtatgcacctgtggagtactgtcaggcttcaggggggtggcgcgggatacacatcaccaataaaacaacgaggacctgccttgcctacatccatctctgaagctttcttactagcttataagctttggagtagttcacctccattctgactcaaacccaaatccatgttctcatttgtcaaatggagattaaaatagctgccgtgcttaaaa

SEQ ID NO: 117105 - DNA, 601 bp, Human
ccatctattaaaaaggcaaaaatcctggggccagcctttattttcctacaagttcactttcttcttggctgatatttccaaaataccctctgtaatcctgttaggtgagaaccacgtccccctaactccacaaaacgagcacactcatttacacacacccttactcaggagacagggcagaagcatacatgttataatttccattgtaataggcctattaggaagcataatgtgctagacattttctagtggctgggataaaggaaaaatgagtcggtcgggcgcggtggctcatgcctgyaatcccagcactttgggaggccgaggcgggcagatcatgaggtcaggagatcaagacgagcctggctaacacagcgaaacctcgtctctattaaaaaaaaaaatacaaaaaattatctgggcatggtggcatgcacctgtagtcccaactcctcaggaggctgtggcaggagaattgcttgaacccaggaggcagaggttgcagtgagccgagatagcgccactgcactccagcctgggcaacagaacgagactctgtctcaaaaaaaaaaagtctccaaggcagccactaacatgccaa

SEQ ID NO: 117106 - DNA, 601 bp, Human
gtgcaatggcacgatcttggctcaatgcaaacctctgcctcccgagttcaaacgactctcctgcctcagcctcttgagtagccgggattacaggcatgcgccaccacgccgggctaattttgtatttttagtagggacagggtttttccatgttggtcaggctggtctcaaattcccgacctcaggtgatctgcccaccttggcctcccaaactgctgggattaaaagcgtgagccactgcgcccagctgattaactccatttactaaaccatataataatacaatatatttaagagctgyttcctctgatggaatacagatcagtcattgccattctattcatttctcatgtcaccaccaacatttctggggcgactaggaggagttgagagaattgagcataaggggagccaggacgaaaagaagggggaaaaacacataaaaattaccttttactgtcctttaatattttaaaccatctattaaaaaggcaaaaatcctggggccagcctttattttcctacaagttcactttcttcttggctgatatttccaaaataccctctgtaatcctgttaggtgagaaccacgtccccctaa

SEQ ID NO: 117107 - DNA, 601 bp, Human
gaagatttcatggacatttatcagttcccaaataatactcttataatttcttatgcctgtctttaatttcttaatcctgttatcttcgtaagctgagaatgtatgtcaactcaagaccctgtgatgattgcattaactgtacaaattgattgtaaaagacgtgtgtttgaataataagaaatctgattgtaaaacacgtgtgtttgaacaatatgaaattggtgcaccttaaaaaagaacagaataacagtgattttagggaacaagagaagataaccataaggtctgactgcctgcgggktagggcaaaaagagccatatttttcttcttgcagagagtctataaacagatgtgcaagtaggagagatattgctaaattcttcttctagcaaggaatactaaatattaagaccctaggaaaagaattgcattcctgggaagaggtctataaacggccgctctgggagtgtgtgtcttatgcggttgagataaggactgaaatacgccctggtctcctgcagtaccctcaggcttactaggattgggaaactccagcctggtaaattttggtcagactggttctctgctcttgaactctgt

SEQ ID NO: 117108 - DNA, 601 bp, Human
tgagctatgattgtgccactgtactccagcctgggctgggttattttacaactttgcatataaaataaataaataaaaataaaaactatataaatggggaagctgagacacagaaaattattcttattattataatttgagatacagtctcactctgttgcccaggttggagtatagtggcgcgatcttggctcactgcaacctacgcctccctggttcaagtgattctcccgcctcagcatcccaagtagctgggatataggcgcacgccaccatgcctgggtaatttttttttttttttaatttttgtatttttagtagagacaaggtttcaccatgttggtcacactggtttcgaactcctcctgacctcaggtgatctgcccgcctcagcctcccaaagtgctgggattacaggcatgagccactgtgcctggtccagaaaattattaaataactagcacaaggttatacagctagtaagcaataaaatagatttcaatttgtgccatctggctcagggtgtgtgctccaggttcaaatcactatattaaactgcctcttgagaggaatttttgttcaaaattgccaaattaacata

SEQ ID NO: 117109 - DNA, 601 bp, Human
tagcaattaagcaataactcctgagcattttacataagctaaatcacttgctcctcaatcaaatgaaggatccccataagtggggactgggcccggtggctcacagctgtaatcctagcactttgggaggccaaggcaggaggatcacttgagagtccaggagttcaagaccagcctgggcaacatagtgagatccctcacctcttaaaaaaaaaaattgaaatagtagtctggtacggtgatgcgcacctgtagttctaggtactcagaaggctgaggcaggagaatacatgagcccagragtttgaggttacagtgagctatgattgtgccactgtactccagcctgggctgggttattttacaactttgcatataaaataaataaataaaaataaaaactatataaatggggaagctgagacacagaaaattattcttattattataatttgagatacagtctcactctgttgcccaggttggagtatagtggcgcgatcttggctcactgcaacctacgcctccctggttcaagtgattctcccgcctcagcatcccaagtagctgggatataggcgcacgccaccatgcctgggta

SEQ ID NO: 117110 - DNA, 601 bp, Human
ctgaaacatgtgctgtgtccactcagggttgaatggattaagggcagtgcaagatgtgctttgttaaacagatgcttgaaggcagcatgctcgttaagagtcatcaccactccctaatctcaagtacccagggacacaaacactgcggaaggctgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaaaaaacattatatatacttactaggtttctagactacacaattcttgtgtagtgaaatttagattaaaatatttaaatgcccaatacctcaacctgatagactgtaaataattctactccttctctcccttaaatgacaatgactctatttagcattttatagttaaacttaggtttaccataaattttctcacttaattttccaccccatttaatgttctgtttgggttaatgtttatcgatgcaaatctttaccctggggaaagcagcaatacacatagttcttaaaaatacattctgcatac

SEQ ID NO: 117111 - DNA, 601 bp, Human
gcccctctgcccggccaccacccccgtttgggaggtgtacccaacagctcattgagagtgggccatgatgacggtggcggttttgtggaatagaagggggggaaaggtggggaaaagattgagaaatcggatggttgccgtgtctgtgtagaaagaggtagacatgggagactttacattttgttctgtactaagaaaaattcttctgccttgggatcctgttgatctgtgaccttacccccaaccctgtgctctctgaaacatgtgctgtgtccactcagggttgaatggattaagggcrgtgcaagatgtgctttgttaaacagatgcttgaaggcagcatgctcgttaagagtcatcaccactccctaatctcaagtacccagggacacaaacactgcggaaggctgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaaaaaacattatatatacttactaggtttctagactacacaattcttgtgt

SEQ ID NO: 117112 - DNA, 601 bp, Human
ccaacaatttttaaaatatctaattagactattgtttatttaatttccatagaaaatgggaaattcctgatttgaatactctatcaagcatagtttagtctctacaaatataagactcacaattactctttttaaaaatataaaatctgaagacttcataatggcctgccaaaaaggactttgtttttcaagggagctaaataacatttaaattatgcacttaggagtattttaaacccctggaaaattttaaatattataattaagaaaccattcttttatagcatgtcactttgcccartgttggggccctatatcacattattctgtgtcaaacgcatagagaggtagaaaattaaaagagccctcctggggcctaaatgctaaatcgccggcatttggtgggtgtaagtcataacatttcatcaccaggctttgattactgtataaaaagagcctcaaatacaatgtgaaatagcttagaaagattctaacaatatgataaagaataattccatcaatatctacctacaaggaacaaaaaggctcccccccttacagtcattatgttcaaagtacagctttaaaaagaatctagctc

SEQ ID NO: 117113 - DNA, 601 bp, Human
ctacccacattcttttctgtatattattcccctttcacatgtaaatctttaatgtatttagaacttcatttagtgtatctggaacctcacacgtggtgtgaggcaggaacagaaaaatatttttacgaattttttgtcagttctattatttaagaatctatcctttcttcactgatttgaggagccagtatcatcaattatcaaattttatgagtatggatatgtatgagtacaaagacacacacataatcacgtgaatctgattttagaccatctaataacctacctagtccagctagawctcaacttttcatgatatttttccaattctggtcatgtaatacattaaatatgaagcctatctcatgccttctaaagccgcccaacaatttttaaaatatctaattagactattgtttatttaatttccatagaaaatgggaaattcctgatttgaatactctatcaagcatagtttagtctctacaaatataagactcacaattactctttttaaaaatataaaatctgaagacttcataatggcctgccaaaaaggactttgtttttcaagggagctaaataacatttaaattatgca

SEQ ID NO: 117114 - DNA, 601 bp, Human
gctttaactctgatgcccatctgtggacatagtttggctgatgtgtgcaaagttctggaccaaccaaagcttcactgctgagcatacaaatattcaacgggctacataggatcaaacttcaatagcaacaccacatggcaacaaaacgtaacagcactagtgagcttatgaagttctagttctcctcttgtttactgaagagaagtaactctccgtttgggagtctcaacaaggagacagggtaagtggggaaggcaatgcttcaaaagcttcttagataggtaactaactttatatactragtctgaaaagcaaatcatatatattacagcttcatgctaatctttcctgtttgtttatgatgcagtttttgctataacagaatctaccatttttctttttatagtgtcatttagcatactgtttgaattacctgaagattaaatatctacccacattcttttctgtatattattcccctttcacatgtaaatctttaatgtatttagaacttcatttagtgtatctggaacctcacacgtggtgtgaggcaggaacagaaaaatatttttacgaattttttgtcagttctattatttaa

SEQ ID NO: 117115 - DNA, 601 bp, Human
ggctggtctcaaactcctgaccttgtgatccgcccacctcagcctcccaaagtgctaggactgattacagacataagccaccgcacccagctacatgagttttttaagacagctttatcgctataattcatgtatcaatacaatttacacatttaaaatgtacaattcaatgttttgactatattcatagagttgtacaactaacaccagtatctaatttgagaacatttaatcacttccaaaagaaatccatacccattggcagtcactgttcattctccccacatattcccagccctasgcaaccacttgtctactttctgtctccaaagatttacctattccggatttttcatataaatagaaccacacaatatatgttcttttctgactggcttctgttatttggcataatgtttgcaagggtcatccacgttgtagcatgtaccagtacttcatttcttcttatggctaaataatattccattgtatagatataccacatttattcattcaccagttcatgaacatctgggttggttggttggttggttggttggcttactgagacagggtctcactctgttgcccaggctggtgt

SEQ ID NO: 117116 - DNA, 601 bp, Human
gggtctcactatgttgcccaggctggtcttgaactcctgggctcatggaatcctccttggctcccaaatgttgggattacaggccactgcacccagcctgaagcactgttttcaatagcaaaaaggaaaattgattaataaattcatacaacgaaatatgaaatgaggaatacaaaattaaatgaacaaaaatttatgaatctcaaaatatgatttgcttgggcttataacgctgagtcaaaaaagctaacagcagaagaatttataatatttacatgagttctttttttttttttttttycgacagtgtcttgctctgttgcccaggctggctggagtgcaatggcacgatctcagctcactgcaacctccacctcccaggttcaagcaattctcctgcctcagccgcctgagtagctgagactacaggcgcctgccaccacactcggctaattcttgtatttttagtagagatggggtttcaccatattggtcaggctggtctcaaactcctgaccttgtgatccgcccacctcagcctcccaaagtgctaggactgattacagacataagccaccgcacccagctacatgagtttttt

SEQ ID NO: 117117 - DNA, 601 bp, Human
gtggctttttctataaaatatattggcatacacaacaatgaggacacatctcatataacactaaaataccagtaaaggtccaacagttaagaaatcctaccttttctattgccgaagatactacagacgaccttcagaagacaaaagtacttctactaacttcaattttaaattgtataattaaatgaactaaatatcttgaggtaaagcaataaaatgccttctaaataaacaaattactaagtatcaataatcccatcaaattctaatttggaagaaagttttaaagatgtataatccrggccgggcatggtggctcatgcctgtaatcccaggcatgggaggccaaggcaggaagatcgtttgaggccaggagttcgagaccagcctgggcaatatagatagaccctgtttctacgaaaaataaattttaaaaattagccaggcatggtggcaaatgcctgtaatcttagctacttgggaggctgaaatgggaggattgcttgagcctatgacctcaaggctgcagtgagctattatcatgctaccgcactccagcctggatgacagggtgagactctacctcttaaaaaaattagaa

SEQ ID NO: 117118 - DNA, 601 bp, Human
ccttaaataactcacctatacattgttatcatgtatcctattgtgtcaaggctttaattatgtgtgttactatagcagattttcagttgaactctttttcatgtaagttaatcccataaatccagcattcaggcttttttaacttttatgtcccaaaagtaaaacaactgaccctttaactacatgaaagttaaggacaccaacaccccacgcagccgaaaatctgtgtataacttttgattccccaaaaacttcactattaatagtctactcttttttttttttttttttgagacagagyctcgctctaccgtccaggctggagtgcagtggtgccatctcggctcactgcaagctctgcctcctgggttcaagcgattttcctgtctcagcatctcaagtagctgggattacaggcgcacaccattatgtccagctaagttttgtatttctagtagagatggggtttcaccatgttggccaggctggtttcgaactcctgacctcaagtgatctgctcgcctcggcctctcaaagttctgggattataggcgtgagccactgcgcccagccaactaacagcctactcttgaccagaagc

SEQ ID NO: 117119 - DNA, 601 bp, Human
tattatttgaagacttttttgttatattatctactgtgttatctacttcattatttaaaagttcccatacatatagaagtcccagaggaattccttaaataactcacctatacattgttatcatgtatcctattgtgtcaaggctttaattatgtgtgttactatagcagattttcagttgaactctttttcatgtaagttaatcccataaatccagcattcaggcttttttaacttttatgtcccaaaagtaaaacaactgaccctttaactacatgaaagttaaggacaccaacacccsacgcagccgaaaatctgtgtataacttttgattccccaaaaacttcactattaatagtctactcttttttttttttttttttgagacagagtctcgctctaccgtccaggctggagtgcagtggtgccatctcggctcactgcaagctctgcctcctgggttcaagcgattttcctgtctcagcatctcaagtagctgggattacaggcgcacaccattatgtccagctaagttttgtatttctagtagagatggggtttcaccatgttggccaggctggtttcgaactcctgacctcaa

SEQ ID NO: 117120 - DNA, 601 bp, Human
tgaaatattaacttactgtaattaaaaacacatttaaaatttgcgtcaaataataacatgccttgtactcacagttagtgcttgcagagcaacatgtggaaccttatgatttacccttttcattatggcttttaggcaatctttcgctctaaaaaaaaaaagagagagagagacagttaagtatttactgataaatttaattcaaacattaaggtattattctattaccaaataattttatatttaatggctcatgcctgtaattccaacacttcgggaagccaaggcgggaggatcactygagcccatgaatttgagaccagcctggaaaacaaagtaagatctcatctctataaaaaacttaaaaattagctgggcatggtggcatgtgtctgtactcctagctactcaggaggctgaggcaagaggactgcttgagcccaggaagctgctgtgagctgtgtcatgccactatactccagcctggatgacagagaccgtgtctcaaaataaagaaagtataaaataaaaataaactaaactaaaatcctggaaatttcatattgttaaaggaataaatctataaaatgattttacacaa

SEQ ID NO: 117121 - DNA, 601 bp, Human
aagtcttgagcctctcaattccatgaatttgttcatttcacttacctcctgatatgacttcttcacttctctctaacaaaatattaatacattcaagtctcaaaattctacctctttaccttcttcaccattccaatctgtagtcacctctttctctctttggtattaagatagacagtatgcagtctattcccctcatcctgtatttgtcacttacaatctaaattagttatttttcacatgtataaagctatcattcaaatttgctacaaatttcttgaatataaggggtatgtcatayacctatgccttttgcatgactgtagacttagaggaacattaaatacactatgtctgattaacttcacaaggttctgatatgtggaagaaatacacataaaaactagaatgtctactaaacgtaaggaaggcactatgctagagagtcatttgggaagtaaaggtggaaaatgataatctagacataccttgcctagtctttacataacatacataccttcaaaatattatagggtcaaccatgggtctgaataaatctctcacctgagaacctgctggaggaaaagtaattccttcttct

SEQ ID NO: 117122 - DNA, 601 bp, Human
atctttttttctctttaatctatgatttaaaataaaagaaaatatagtacttctcatcgtctctttccctagcccatatcttaatattaatgggaaggaataaggtactgagagcaaaacccaaggaatagtatttttctcccctagacctaaaaaaaccagcccactccatgagtcaacatccctgcctccacaccccagttctactaaagctatcccttctcccagcaaataaatttctagtcttacatttccatccatcttgtatgtgaagcattcactctaggcatattcactcttsaacaaacaagtcttgagcctctcaattccatgaatttgttcatttcacttacctcctgatatgacttcttcacttctctctaacaaaatattaatacattcaagtctcaaaattctacctctttaccttcttcaccattccaatctgtagtcacctctttctctctttggtattaagatagacagtatgcagtctattcccctcatcctgtatttgtcacttacaatctaaattagttatttttcacatgtataaagctatcattcaaatttgctacaaatttcttgaatataaggggta

SEQ ID NO: 117123 - DNA, 601 bp, Human
atgtaagacaggtatccaggactgatccatcaaccggttctttacatagatttttcagaaaaatatgcagaaaggacagaacaggaaaatgtttcctttttattacttataagactcttatctcaaaacgttaccttgtacccttaggtctggtcagctataaagaatcttttttcggccagcgtggtggctcatgcctgtaatcccagcactttgagaggtcgaggcaggtggatcacctgaggtcagaagtttgagaccagcctggtcaacatggtgaaaccccgtctctactaaaaayacaaaaaattagccgggcatggtggtaggcacctgcaatcccagctactctaaaggcggaggcaggagaattgcttaaacccgggagacagagattgcagtgagctgaggttgtgccactgcactccagcctgggcaacaagagcaaaactccatctcaaaaaaaaaaaaaaaaaaatctttttttctctttaatctatgatttaaaataaaagaaaatatagtacttctcatcgtctctttccctagcccatatcttaatattaatgggaaggaataaggtactgagagcaaaacccaa

SEQ ID NO: 117124 - DNA, 601 bp, Human
ctgtcagccaggttgcagtgcatggcacagtcatagctcactgtaacctccaactcctgggctcaagtgatcctcttgcctcagcctcctgggaagccggaactagaggtgtatgcatccacaaccggctaatttttattttttgtagagacagggtctcactatgtttcctgggctgatctgcaactcttagcctcaagtgattctcctgtctcagcctaccaaagtgctaagattacaggcatgagccaccatcactggtctaaaagtgaagttctttataataattttaaataattgttttcaaatactaaaataaaacatcagatttttcaagaaaacattataaactcacacagggatcaaactggcttagattttgcataaatgtaacacagaacttggcatacagaaagtacttaaatattaatagaatttaaaaaagactcttttctgattgtattcccgatctcaattgtccaaggtctcttagtgagaggagctctgctataggagtacagctacacgaggagtgccagcaagaagtcatgatcatcactgaagagagaggaatggggacagagacaagaggtgcagttct

SEQ ID NO: 117125 - DNA, 601 bp, Human
aacacaactatcttttcaaacaaaacacaagctccataattacttgcagatggtaaattttaaaaaatactgatataactgagtttcatttaaaagtgaagttcttttttgagacagggtctcattctgtcagccaggttgcagtgcatggcacagtcatagctcactgtaacctccaactcctgggctcaagtgatcctcttgcctcagcctcctgggaagccggaactagaggtgtatgcatccacaaccggctaatttttattttttgtagagacagggtctcactatgtttcctggkctgatctgcaactcttagcctcaagtgattctcctgtctcagcctaccaaagtgctaagattacaggcatgagccaccatcactggtctaaaagtgaagttctttataataattttaaataattgttttcaaatactaaaataaaacatcagatttttcaagaaaacattataaactcacacagggatcaaactggcttagattttgcataaatgtaacacagaacttggcatacagaaagtacttaaatattaatagaatttaaaaaagactcttttctgattgtattcccgatctcaa

SEQ ID NO: 117126 - DNA, 601 bp, Human
cattataatatgggtagctttccatataggataagccatgaacatatttctctgcttgactcataactttggcattaaaaaaaggtgaaatgtaatctctccaaaggtagcacatcaaatacatattactgaaaaaagataatgaattaaattcatttgatagcatgtcatttgttttccttactttttggatgctactagtttttagatttgaggtaaaaataaaagtatgctagttttattatcatttttatttcaaaaaaatgttctggcaaatacatatatatattttttgagatgsagtctcactccatcgccaggctggagcacagtggtgccatctcggctcactgcaacctccgcctcctgggttcaagcgattctcctgcctcagcctcccgagtagttgggactacaggcgcccgccaccacgcccagctaatttttgtacttttagtagagatggggtttcaccttgttggtcaggctggtctcgatctcttgacctcatgatctgcccacttcggcctcccaaagtgctgggattacaggcgtgagccaccgcgcccagccctggcaaagatattttaagcaacactaa

SEQ ID NO: 117127 - DNA, 601 bp, Human
atcatataaagctctcactttccgtgcaaccttattatttaactgaatttctgaagatggatataaggattttgtttctgtgtgttgctgtttctgttcttgcagcgataattcaatagctagtttcaaaaattaaaatgcaaagaaactggaattaattttgataaaataaacattagatgacaatgtaaaatttaataagaataaatcaagcattttatttgtctaattacatgctacagttaactttcgggagggtggggcagggcagggaaccatgacatttttaaaataaagtttgtgctcattctttattatcacggtctgtcatacacagcagcaattatttttatagcaaacagattgtgacattataatatgggtagctttccatataggataagccatgaacatatttctctgcttgactcataactttggcattaaaaaaaggtgaaatgtaatctctccaaaggtagcacatcaaatacatattactgaaaaaagataatgaattaaattcatttgatagcatgtcatttgttttccttactttttggatgctactagtttttagatttgaggtaaaaataaaagtatg

SEQ ID NO: 117128 - DNA, 601 bp, Human
tctggatgacttccttttaaccgaagactgtcatttaactttagcatgcaagtttgcatttgtctaccagcgattaccaatcacctaaaatgacaatattttacccataagcatgcttacagcaactataaaagtagggtgtcctatcgtcaaaatgacagcaattgacctacaaattccatcacattcatgttgaattctcttagcagttacaaataaaaaagttcttttttgaggtgataaatcttaactgaaaattgttttgtgagcagtaatttattttagaaaattttgttatatraagtaatgctctaaattaaaatcttagacaaaaccactcattttgtttttattttataaatatctttaacttcatagttgtataagagtatcaaaacggtaaacctaagttcttttgtaagtactctaactaaaagacactcataagcctgacatttcagactgtcagtgttcagagcccacactatctctccatctttacagacagtgtcaaactcatgatggcatgacttacgatggtgcaaaagtgatacacactcagatacccataaaccattctggtttttactttcagtacagt

SEQ ID NO: 117129 - DNA, 601 bp, Human
gcgccaccatgcacggctaatttttgtatttttagtagagacagggtttcaccatattgaccagggtggtctcgaactcctgacctcgtgatccgcccgcctcagcctcccaaagtgctgggattacaggtgttagccaccacgccctgccagctccatggttcttaaatggagatccaagaatgatatattttcaagggacttcaagggacttctgtgtgtgaaaattttatgcttcaaattccacaaaagtataaaaacaatgaatagagtcattttctggatgacttccttttaaccraagactgtcatttaactttagcatgcaagtttgcatttgtctaccagcgattaccaatcacctaaaatgacaatattttacccataagcatgcttacagcaactataaaagtagggtgtcctatcgtcaaaatgacagcaattgacctacaaattccatcacattcatgttgaattctcttagcagttacaaataaaaaagttcttttttgaggtgataaatcttaactgaaaattgttttgtgagcagtaatttattttagaaaattttgttatataaagtaatgctctaaattaaaat

SEQ ID NO: 117130 - DNA, 601 bp, Human
caacctttatgaactcctaccacttgtaatagtttatccatcggactcttgaactttctatatggaaaatcatagtatctggaaataatgataattttatctattcctttccaaaaatctgacttattgaatagacattcttaagtatgagtcttatggatgaattaatgtctatgattatgaaacatcatttcatttatgagcactagaaagagacgaaagagttatatatcatccaagttcttaaagccagaaaataactgatgtattgatgtactgacagttctaagatatcatatckgcaaatatctatggaagataggaaaaattttctttctcttacaaacacatttttaagttaacttttcattttgaaaaggagagctgaacttgagaaatttttgtataaaacgagaaaacccaaacctgtgaaatggatgcaagcgttttatatgaacctaccaacaactgtatgtgtgtacccttccttagtggttctaccaatataggataattttcctcccagccactactacaaactctttgatgaagcataaaagtaggcaaagcaaccaaattgacaactccttcccagccctaa

SEQ ID NO: 117131 - DNA, 601 bp, Human
gagaatgacttttttttactacattttctaaaaagttgtaattaaagcatactactgagttttgtatgttgagcttgtatccaacaacctttatgaactcctaccacttgtaatagtttatccatcggactcttgaactttctatatggaaaatcatagtatctggaaataatgataattttatctattcctttccaaaaatctgacttattgaatagacattcttaagtatgagtcttatggatgaattaatgtctatgattatgaaacatcatttcatttatgagcactagaaagagaygaaagagttatatatcatccaagttcttaaagccagaaaataactgatgtattgatgtactgacagttctaagatatcatatctgcaaatatctatggaagataggaaaaattttctttctcttacaaacacatttttaagttaacttttcattttgaaaaggagagctgaacttgagaaatttttgtataaaacgagaaaacccaaacctgtgaaatggatgcaagcgttttatatgaacctaccaacaactgtatgtgtgtacccttccttagtggttctaccaatataggataattt

SEQ ID NO: 117132 - DNA, 601 bp, Human
aaaaaatatcatttgttccccacattttaatacaataagcaaagatgaattaaaaattaaatttagcctcctttgaatatatccgtttacaagcagctataattaagtcatttttcttaaatttaataaacgatattaaaaagtacaagtaaaacaaatatccacatccctatatctaaacttagaaccagccaggcgcagtggctcacgcctataatcccaacactttgggaggccaaggtggacagatcaccagaggtcaggagtttgagatcagcctgtccaacatggtgaaacctcrtctctattaaaaatacaaaaattagccaggcatggtggcacacacctgtagtcccagctacttgggaggctgaggcagaagaatcgcttaaacccgggaggaggaggttgcagtgagccaagatggcaccactgcactccagcctgggtgacacagcaagactcgtctcaaaaaaaaaaaaaaaaaaaattagaaccaattagcaattaatcattttttattctggactttaaaaaagtaaggccggatgcagtaggtcatgcctgtaatcccagcactttgggaggccgaggcgagtgg

SEQ ID NO: 117133 - DNA, 601 bp, Human
atttggttaaaaagtaggttagattgtcatgcctataaagaaatgatttaaaacaaaagttaaatgccaatctactttacatccaaaactgaaacataaaatttaagtgaaaaaaacttaaatagatctaatgtcgtctaagatttaacttacctgcctcagtctctatgtttaaattagttgttacaaaattggatgggaaaagtcctattcctctgtgattttctcctttccaccaattggcatcactaaaaatacagtgcaaaaaatatcatttgttccccacattttaatacaatatgcaaagatgaattaaaaattaaatttagcctcctttgaatatatccgtttacaagcagctataattaagtcatttttcttaaatttaataaacgatattaaaaagtacaagtaaaacaaatatccacatccctatatctaaacttagaaccagccaggcgcagtggctcacgcctataatcccaacactttgggaggccaaggtggacagatcaccagaggtcaggagtttgagatcagcctgtccaacatggtgaaacctcgtctctattaaaaatacaaaaattagccaggcatggtg

SEQ ID NO: 117134 - DNA, 601 bp, Human
ttcggcacttgccaaccacaacctccccacaccactcccgctttgcctctgtggttcactgatgaatcaaaacactctttgtacagaatagatatgaactgcctcttacactacatagttaggttgatttaaatacctgcatggtcacaaatgattttatgcctgacatttaactatgtatgctaactctcagaggatgtaaaataagaggaaataattcttgggattgacacaggctaaattaaccccttaatttggttaaaaagtaggttagattgtcatgcctataaagaaatgatttaaaacaaaagttaaatgccaatctactttacatccaaaactgaaacataaaatttaagtgaaaaaaacttaaatagatctaatgtcgtctaagatttaacttacctgcctcagtctctatgtttaaattagttgttacaaaattggatgggaaaagtcctattcctctgtgattttctcctttccaccaattggcatcactaaaaatacagtgcaaaaaatatcatttgttccccacattttaatacaataagcaaagatgaattaaaaattaaatttagcctcctttgaatatatccgt

SEQ ID NO: 117135 - DNA, 601 bp, Human
aaaaaaactatttcctatatgaacaaaaaataaaacttattttaagctaacttcgataatagttaaaacaacactaaacacaaaagtttttcatgaagagaaggttgaaaaaaaacttacaaatacataaacccagaaaactatttaaatgttccctggagtattgctagaatgtaccatattttaacaaagtaaattttggtaaaaataaaactacaataaaaacctatgtagccaaacaattttaaatcccaactgttagtcatttatttcaaatatttggctaactttcaaagaacagaagtcagcataacacaaggataaactgaaaatccacaatattttttcctcttaatactctccagcctatgtcaaggagaaactgctatatagaatcccctgagcatgatctataaagttattttttaaaggtatctccaatattcctatctacttagagagtcagttaagaggaataaaattataaataatggcaaagtactctatattcaaatcagtgagtatcaacctctcacgacttcatttttctgaatgtatcactctacacatacaaagacgatgttacacatgcataatgctt

SEQ ID NO: 117136 - DNA, 601 bp, Human
gttacatctacgagttccttctacactcttcccttctatttaaaaaaactatttcctatatgaacaaaaaataaaacttattttaagctaacttcgataatagttaaaacaacactaaacacaaaagtttttcatgaagagaaggttgaaaaaaaacttacaaatacataaacccagaaaactatttaaatgttccctggagtattgctagaatgtaccatattttaacaaagtaaattttggtaaaaataaaactacaataaaaacctatgtagccaaacaattttaaatcccaactgtkagtcatttatttcaaatatttggctaactttcaaagaacagaagtcagcataacacaaggataaactgaaaatccacaatattttttcctcttaatactctccagcctatgtcaaggagaaactgctatatagaatcccctgagcatgatctataaagttattttttaaaggtatctccaatattcctatctacttagagagtcagttaagaggaataaaattataaataatggcaaagtactctatattcaaatcagtgagtatcaacctctcacgacttcatttttctgaatgtatca

SEQ ID NO: 117137 - DNA, 601 bp, Human
tactagagagtaggcacactggctatcactgatccaggcagttctaatatcactagaagcatgctagaacagactggttaaaagtaagccatgcaaaatttttatttaataaaacttgtcagagcttgttttttagaaaaacaaaaacaagataaaaagcaccaccttgctataaatttgttaaaagcctgggaaactgaaaaacaatttccatgaattgtacagttccacaaaaactttccctactttactgtttgccaaaacacaagtgaaccccccaaaactatactttttattccttgcacgaaaaatctcacctatcaatttcttcaagtttttcatctatcattggacccatctgttggcagatatctgtaaatacaaaaatacttacaaatatagaaacttaatccagtttaagccaatttcaacaatttttaacaatatagcaccaatatacaacactatgcataatacacacagattaagctcatgctagagaaagactactattcagcactactactacatattactatcatgtgactaaaagcaaggtcaactttaaaataaaaacctcattatgttttcttgaaactat

SEQ ID NO: 117138 - DNA, 601 bp, Human
gggactcattgagagaccacgaccagggactctacatggacaaagggggcggagaatgaatgctgagatccaggtagggcacacataggctgtgtgacaatggttaggccctcggtctctctgaccttgcgcacagatgccccatacctggcacttggcattctccacctcggccgtcagcctctggatcatgcggttcagctcgttgatctcctccttggtgcggcgcagggtctccccgtgcctgatcaccgtggccttcatctcctcacactgggggaagtagagatgctcatgaggytcagggtgggacctcccatccattcaggacaccacagatgattttgcaggttgtacagtgctcagcctgtgcagccacacatggcagtcctgccctgccaccccaacctcagattggcagccctctcttctcatccctagggaccagcatccccagaaaaggaagcctatttaatagatacctcacatccctcccactgccacgtctagcaggcaggtgtcctgtgccactcaccttgctgcggtaccaggactcggcctcggcccggctgcgggtgacaatgtcgtcatactgtgcctt

SEQ ID NO: 117139 - DNA, 601 bp, Human
agagtccctgggtctctctgatgctcatccaaatgagaccacactccccaccaagctgggagcaccccagaacagagcctcttgcctttatcacctgggactcattgagagaccacgaccagggactctacatggacaaagggggcggagaatgaatgctgagatccaggtagggcacacataggctgtgtgacaatggttaggccctcggtctctctgaccttgcgcacagatgccccatacctggcacttggcattctccacctcggccgtcagcctctggatcatgcggttcagctcrttgatctcctccttggtgcggcgcagggtctccccgtgcctgatcaccgtggccttcatctcctcacactgggggaagtagagatgctcatgaggctcagggtgggacctcccatccattcaggacaccacagatgattttgcaggttgtacagtgctcagcctgtgcagccacacatggcagtcctgccctgccaccccaacctcagattggcagccctctcttctcatccctagggaccagcatccccagaaaaggaagcctatttaatagatacctcacatccctcccactgccacg

SEQ ID NO: 117140 - DNA, 601 bp, Human
acagaaagaacaaggtagattagagtccctgggtctctctgatgctcatccaaatgagaccacactccccaccaagctgggagcaccccagaacagagcctcttgcctttatcacctgggactcattgagagaccacgaccagggactctacatggacaaagggggcggagaatgaatgctgagatccaggtagggcacacataggctgtgtgacaatggttaggccctcggtctctctgaccttgcgcacagatgccccatacctggcacttggcattctccacctcggccgtcagcctytggatcatgcggttcagctcgttgatctcctccttggtgcggcgcagggtctccccgtgcctgatcaccgtggccttcatctcctcacactgggggaagtagagatgctcatgaggctcagggtgggacctcccatccattcaggacaccacagatgattttgcaggttgtacagtgctcagcctgtgcagccacacatggcagtcctgccctgccaccccaacctcagattggcagccctctcttctcatccctagggaccagcatccccagaaaaggaagcctatttaatagatacct

SEQ ID NO: 117141 - DNA, 601 bp, Human
tgaagagaacagaaagaacaaggtagattagagtccctgggtctctctgatgctcatccaaatgagaccacactccccaccaagctgggagcaccccagaacagagcctcttgcctttatcacctgggactcattgagagaccacgaccagggactctacatggacaaagggggcggagaatgaatgctgagatccaggtagggcacacataggctgtgtgacaatggttaggccctcggtctctctgaccttgcgcacagatgccccatacctggcacttggcattctccacctcggccrtcagcctctggatcatgcggttcagctcgttgatctcctccttggtgcggcgcagggtctccccgtgcctgatcaccgtggccttcatctcctcacactgggggaagtagagatgctcatgaggctcagggtgggacctcccatccattcaggacaccacagatgattttgcaggttgtacagtgctcagcctgtgcagccacacatggcagtcctgccctgccaccccaacctcagattggcagccctctcttctcatccctagggaccagcatccccagaaaaggaagcctatttaat

SEQ ID NO: 117142 - DNA, 601 bp, Human
tccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgagcgggactggacctcgcctctcctcgagccgcgctccagaccacaccagccgccctaactagccctgcctgcgcgcgggccaggcgctggggagcactgccgcccttctgtctttccgccagtgttggggacacgatctgggggtccttcctccttcgcwtgaaccccgtggctattttatcccctcggtttccaagccctcccttccagcaagctgcccagctgcccctccctttcctcccggagtgcgggcctgagtcctgtagggctgccctcgctggctgcctgttggtcccctggaccagttttgcctcggactaggagttccagaggcctaggccaggagttctctctctgggaccctttccctgagagaggaccgtgtggagtcaggaatggagttggatggcacgcccttcccagagggggagacccaggctctctcagatgctgatgcgga

SEQ ID NO: 117143 - DNA, 601 bp, Human
caagctgctccaggcccaggttcccccatgtgttgagctgcaccgtcttactctctgtggtccccagggcctggggccctgagctgctggttttgcagaggcctctattgcctcccacctccagtcataccggctactccttaagggcctttgtgggctccaggctggggtcattttaccatggattgactgtcctgaggccttgctggagaaaggggaaggagagaaaggatattgaggaaggaagagaagaggtcccagacagaagggagggctgggcctggtcatcctcatgatccaytgacaggaagaggtggctgttcagatagggaggtggagaacaccacctgtaatgtgatggggagtgaagtggagaggaggccctggagcacattcgtcgagagtcaaccacggggcacttccgtgcaccaggcagacctgcttcctggatcactctgtaggacacttgatttggagtccaaagggagagggctggaagccccaggcagggaaacagccagggggagcatggctctgctaagtggctaaagatgatgttcctcaatcccgctgtgggtggcacgctctggctcctcttgag

SEQ ID NO: 117144 - DNA, 601 bp, Human
tcctgtggagccagtctgagatccaggctgggactgaaagaggaactggaagggagtccagggaaggagtacagggagggtccctgtgtgcagctgctcagggagttccgatctgtgcaccctcttgacctggctgtgcactgccaaggcaggggtggacggaaagccttgcagatattttccagcttctacagaacttgagggagtgcaactttgagggtatgggcacctccaaccctgagtctgggctcctgaaggggcttggcctacctggatgtcctgccttccaccccaggttgtycctactgcttccagcagctcttggaactcttgtttccaacacctttttttgagtctcaacataaacattagattaagccattgtggtctcttcctctgtgccttgtttgcccaggtcctcctaagggccaggagtggctccttgggaggaagagtgatgggagctatgggaggaaggatgggggctggatcatcaggcgggacctggttctttcaggactttgtgtatccctcatcctgattctacagggttcctccccttcagactccttctttgcccctgaggggtgggattaggtag

SEQ ID NO: 117145 - DNA, 601 bp, Human
tgagctcatgcataagaagcacataatggtgcacaccccatagaacacagtctcatgcatatggctgttattatttgctttttttctcccaggacatgcagcttttgtgctgtcattcacatgtttcctatgtgccccaccaacaaccccccatgccaagactcaaagccctaggaatggccgcgtggaagtcagggaaatttggttttgtagctgacacctgttttttcaggtgtgtctttaaagagtaggggaagggaggcagggcagatttcacagctgcatatggcggaggggggaygggagcatggaggcaaagctgcatcaacaccaggccctcctctactgtaggtacgaagatgaaattaaccgccgcacagctgctgagaatgagtttgtggtgctgaagaaggtgagtgggaaagacaggctcgaggagggttgtctgaaaacatatgggacaaaggaccacaggatcctctcacctgagcagcccatggggacctctggccaaggcctgcctgagctgtccaagaggaagtctgcacagcctgtcctgtgggtgcgtgtatgtgtgtgtgtgtgtgtgtgtgtgtgtgtg

SEQ ID NO: 117146 - DNA, 601 bp, Human
cctaggaatggccgcgtggaagtcagggaaatttggttttgtagctgacacctgttttttcaggtgtgtctttaaagagtaggggaagggaggcagggcagatttcacagctgcatatggcggaggggggatgggagcatggaggcaaagctgcatcaacaccaggccctcctctactgtaggtacgaagatgaaattaaccgccgcacagctgctgagaatgagtttgtggtgctgaagaaggtgagtgggaaagacaggctcgaggagggttgtctgaaaacatatgggacaaaggacyacaggatcctctcacctgagcagcccatggggacctctggccaaggcctgcctgagctgtccaagaggaagtctgcacagcctgtcctgtgggtgcgtgtatgtgtgtgtgtgtgtgtgtgtgtgtgtgtgtgtgtggtgactgattagactcatttctaggcctctaggggttagaactaagagcaaaggatggaggttatagagggagatttcaacactgaataaggagtgctctattcaagccagaacattttcatcacaaaggtgttgcttggctggcctgaaatgtttgctgaat

SEQ ID NO: 117147 - DNA, 601 bp, Human
atgcagtctggagggtcagcagggcaagcttcatgctgtgaccatgtacagcagctgtagaaactgtttctgggtagggcagtagtatttggcctgtgggttggacagggcaggcctgcttccacccctactaaatgttccctgtactgaggacatggtctccctctgccccatcttgccccaacccccaggatgtggatgctgcctacatgagcaaggtggagctggaggccaaggtggatgccctgaatgatgagatcaacttcctcaggaccctcaatgagacggtgaggaccatggrgctgggtgacatgtcttatcctacccattctaaccagggagccatctggtccagccccccgcctctgtgtcagtccagatatgtgtcagtgtgagaaacaaactcatccgtccaaacccaaagaatggactcagagacctggagaacagcgaaagtgagattttaatgacagtcttgcaagatgggtgtctgatgggcaggcatgcccagcacagccacaacaagcaatttatcctctagtgcacaggtccctccctccgttcctcacaggctgagtactatggggtcacgatcttcctg

SEQ ID NO: 117148 - DNA, 601 bp, Human
gataagtgactgttctgtcaaagtttaaggactgtaacccttagatacattttattcaaaataacaatttctattgtcacacactcaaagcaacccagacaaacaggcttggaaactaccagccaacttcattctgtgagtaaccattaagttttaatcagatgtggttcaatttctggaacagtgagcattaagaggggctcatcaaggaaaatgggcaaaagtaggaggagaaggaggaggaggaggagaggaggaggtagagaacaaaagaactgccccgcaagccagtcattgaacrtggactcttgactcgaattctctgcccctctttgcagctgttgtctcctgcagttggcacgaagcgttgccagtctgggaccggcttccagtgaggacagcattgttttattggctacttaggcaatgcacacaccattaatggagtttttatctctccattttcctgtcagtacagaaccagccagtctgactctgttattatcatcaagaaagcttttccccccctccccacacacactctttaatccaaacaacatctgggaacttcagcctctatcatgtaaaagcgaaacagatt

SEQ ID NO: 117149 - DNA, 601 bp, Human
ttgcccgtgaccttactttgccatctttagtgatgagagaagaaaccaggcttgagatactgtggccactggccacttggtgtggcctgagagtgagaagtccgcagccaggaaccttgagacagctcacaatctacatggggtttccaaaaaggaaacacaggttgtacctaaaagcattccttattgctcctccctacacattttatccaccaccttatatctgcacacaaagtcctccatttcaggaaggaaaccaggacaagcgtcactcccagctgagctcttcgccaggtacttyactcaagattcatctcctccagggtgcttggatacccacccttgttctcccttcccatggctttcccaaccaggaaatcatcaccaccttctgacagcagaaggactttgtcctctttagcactgagtccccagtccctaccggggtgcctgacacagtgagcacactcaagggggtgtgctgcaagataaaggaatgtctctcctcctctgtgaagccttccaggatttataaggcttccagaatttaaaagtaatgtgtgcccttaccccacaacaccagcattctgaagggcctaga

SEQ ID NO: 117150 - DNA, 601 bp, Human
tagtaagggtcctgatgtttcctttttaggaaactgccagcactccacatcccaccacatcccatgtgtcctcaaccactatgcccccttcctcccctacactgtggttaaaacccagaactgagccagttagaactgcggtcctgccatgcgctatctttaaggcctcaggagctaacttaatgtgcctcattcccttcatctgaaaaatttcaattaaaaattatacctgcctcacagaattatcctaagaattaaatgagttaatatatgtaaagcactcacaacagaacatgatatragcaccattaaagggtaagttattaatattattgatgctcttataaccataatgctgacttttgtgatactcatttctttccttaacactttttctttttcttaatagtatattttactaactaaaacatacagttctttgacttgtctttgagttccatttttttctcactctgaaagacataatggaacacatgggagagtattgtgctgaatcagctccaacgtatgtcaaaatttctttacctcaataatgaataataaattacttagcaatactcacaatgcactgcagtgtagc

SEQ ID NO: 117151 - DNA, 601 bp, Human
ggtaactcttagataacagcttttttaaaaatccattttagttgtttcatgtgcagcacttttgttggttctgccagcactgctgtgcactcaggcttaagacaacacatactagcatgaattcaactgagtctcttagaacttctaaccaaatttagactggtttaacacaaccatgaggtatccttccagttttttaataatactttgttcatacaaagggcaggtcacatacatgtctagaagctattttcttttaaatataattttggattaaatttaaaatcacctgtcgcccagrctggagtgcagtggcgtgacctcggctcactgcaacctctgcctcccgaattcaagcgattctcctgcctcagcctcctgagtagctgggattacaggtgcgtgccaccatgcccagctaattttttgtgtttttagcagagacggggtttcaccgtgttagccaggatggtctcgatctcctgacctcaggtgatctgcctgcctcggcctcccaaagtgctaggattataggcgtgacccaccatgcccagcctggtaatttttttttaagaggcaaataaatgtgaatgctacacag

SEQ ID NO: 117152 - DNA, 601 bp, Human
tagaatggcttattttctaacactgtcaggaaggaaaaggctagctcctgttagttttaattttgaatgcgttaagtattggtggaggtaactcttagataacagcttttttaaaaatccattttagttgtttcatgtgcagcacttttgttggttctgccagcactgctgtgcactcaggcttaagacaacacatactagcatgaattcaactgagtctcttagaacttctaaccaaatttagactggtttaacacaaccatgaggtatccttccagttttttaataatactttgttcayacaaagggcaggtcacatacatgtctagaagctattttcttttaaatataattttggattaaatttaaaatcacctgtcgcccaggctggagtgcagtggcgtgacctcggctcactgcaacctctgcctcccgaattcaagcgattctcctgcctcagcctcctgagtagctgggattacaggtgcgtgccaccatgcccagctaattttttgtgtttttagcagagacggggtttcaccgtgttagccaggatggtctcgatctcctgacctcaggtgatctgcctgcctcggcctcc

SEQ ID NO: 117153 - DNA, 601 bp, Human
gctccagcctgggcaacagagggatagcaaaactctgtttccaaaaaaagatagctttccaatctacctctgtactgcgatggcacccaacccactaattaaagaaaaaaatgtaaaaataacataatactttttatttaatttagcagtttcattcttaactcagagattagttttttgtttttttgtttgtttgtttgttttttgagacagagtctcactctgtcgcccaggctagagtgcagtggcgcaatcttggctcactccaacctctgcctcccgggctcaagcgatttttgtrcctcagcctcctgagtagctgggattacaggcacccaccaccatgcccagataatttttgtatttttagtagagatgggggtttccccatgttggccaggctggtctcgaactcctgacctcaagtgatccacctgcctcagcctcccaaagtgctgggattacaggcgtgagccactgtgtctgactgaggtttgcttttaatttaatttgctcaccaatcatttgctctccaattgaaggataactgagtacgaaaatgtacaaacagaagtacagtaacagtgggtctaccaagaac

SEQ ID NO: 117154 - DNA, 601 bp, Human
gcaggaggcttgcttgagcctggaaggcagaggctgctgagatcatgtcactgcgctccagcctgggcaacagagggatagcaaaactctgtttccaaaaaaagatagctttccaatctacctctgtactgcgatggcacccaacccactaattaaagaaaaaaatgtaaaaataacataatactttttatttaatttagcagtttcattcttaactcagagattagttttttgtttttttgtttgtttgtttgttttttgagacagagtctcactctgtcgcccaggctagagtgcagtkgcgcaatcttggctcactccaacctctgcctcccgggctcaagcgatttttgtgcctcagcctcctgagtagctgggattacaggcacccaccaccatgcccagataatttttgtatttttagtagagatgggggtttccccatgttggccaggctggtctcgaactcctgacctcaagtgatccacctgcctcagcctcccaaagtgctgggattacaggcgtgagccactgtgtctgactgaggtttgcttttaatttaatttgctcaccaatcatttgctctccaattgaaggataa

SEQ ID NO: 117155 - DNA, 601 bp, Human
ttaattaaaggtgctgtttttgggccaggtgtagtggctcacgcttgtaatcccagcactttgagaagccgaggtaggcggattgcttgagcccaggaattttctgggcaacatggcaaaacctcgtctctacaaaaaaatacaaaaggccgggcgctggggctcacgcctgtattcccagcattttgggaggtccaggcaggcagatcacctgaggtcaggagttcaagaccagcctggccaacatggtgaaaccccgtctctacaaaaatacaaaaaaaattagccaagcatgatggcsgatgcctgtaatcccagctactcgggagactgaggcgggagaatcgattgaacttgggaggcggagcttgcagtgagccgagatcacgccactgcactccagcctaggcaacagagcaagactccgtctcaaaaaaaaaaaaaaaaaaaaaaaattaggtgggcatagcagtgggtccctgtagtcccagctactcaggaagctgaggcaggaggcttgcttgagcctggaaggcagaggctgctgagatcatgtcactgcgctccagcctgggcaacagagggatagcaaaactctgtt

SEQ ID NO: 117156 - DNA, 601 bp, Human
actgctctaaaagaaataaggtctattttaaaagaaaaaattagggccgggcacagtggctcacacctgtaatcccatcacgttgggaggccaaggcaggtggatcacaaggtcaggagttcgagaccagcctggccaatatggtgaaaccccgtctctactaataatacaaaaaaaattagctggctgtggcggcacacacctgtagtcccagctactcgagaggctgaggcaggagaattgcgtgaccctgggaggtggaggttgcagtgaaccgagatcacaccactgcactccagcytaggtgacagaacgagactccgtctcaaaaaaaaaaaaaaacaaaagaaaagaaaaacttaatgtagtggccctgtaaggtgaaaaggatggcaggggcattttataggcagggaaacactggtagtatttatttgaaaaacttggccaaatttaaagaatagctgtgcagatccacccaacaaagcctactatgaaggcaacgccagaactaagaactattaggctggtcctaactttcttatattggattcatataaaaaaacaaaataatcatttgtggcaaagaatttaccctgta

SEQ ID NO: 117157 - DNA, 601 bp, Human
atcctggctaacacggtgaaaccctgtctctactgaaaatacaaaaaattagcagggcgtggtggcgggcacctgtaggtagtcccagctaattgggaggctgaggcaggagaatgtcgtgaacccaggaggcagagcttgcagtgagccaagatggcgccactgcactccagcctgggcaacagagcaagactccgtctcaaaaaaataaataaataaaaagaatgcagcgctactatggaagaacttccaagaaatattatttcaataagaaaacgtataaaaccgtggatactgttaycatgtgtgtaaaagaaaaattgtaatatatgcatgtatattatatgcatgtatattatatatactctgaaatcactgaaagaatacacaagaaaatggtaatacagtggctgtttctagaagggccactgggtacttgggagacagaaaagggagacttagttttcactctacactcttttgtgcctttttaatcttgtatacattaattacattacctttctaaaaataaatactttataaaataagaaaaatacaaatattcattgccaacaccagataccggaaaacttctctggtg

SEQ ID NO: 117158 - DNA, 601 bp, Human
acaggcaagggcatgagaaaactgttctcacccatcgttgttaaatctaaaatctgtcaaggtctataaacagagcaacttggcaataaatttctaccaaaattataatgtgtataacctttgacccagcaattctactagaaatggatcccatagatacactcacacgtttgaaatgatgtatattcaaagttattccctatagctttgttcacgataataaaaactggaaatgatctatatacccatcaatattgttaagtaaatgacagcacatctctacaatggaataccaggtatytactaaaaatgaatgcgcccgacacggtgggtcacacctgtaatcccagcactttgggaggccgaggtgggtggaccacctgaggtcaggagatcgtgaccatcctggctaacacggtgaaaccctgtctctactgaaaatacaaaaaattagcagggcgtggtggcgggcacctgtaggtagtcccagctaattgggaggctgaggcaggagaatgtcgtgaacccaggaggcagagcttgcagtgagccaagatggcgccactgcactccagcctgggcaacagagcaagactccgtc

SEQ ID NO: 117159 - DNA, 601 bp, Human
gaaggagaatggaaatagaatacaaaaaagaaattgttttcagttttcataactagcagtatagtgttagcattgtggcacttctgagaatactgtgtgtataatgtggaagaaagcaaatgagtacctatgaagtattctatcaccccgttgtgtttgaggactagaattttgtgtcaaataaaggagataaagatgttatatagaaaaggttaagttaaaaccttataaactgaatttgaatcacaaagtatcagaatgaactcatgaagtattttataaatatttaattcctggttckgtccactaaacgggcctagaaataaggacccactcagtagcagtgagcatccctggtgcccagattgtggtgttaatataacatatgccactaaaagaaaaacaaattgaattgaaccatgtggatgcaatcaccaaaatctagcaagaaagaagctggaggtcaaatggccaggttcttcaacagagaaactgtaagggaaagaaagggctggagggggaaaccccaggtttaagagacttacaaaacataaagagataatacgagaccaatctgtaggtctgaacacctggttgatgg

SEQ ID NO: 117160 - DNA, 601 bp, Human
gccttagtcaatccagtgaaataccccttgttaaggttctacgtcgttttagtcttaccttatccttcaggttcacaagggagcttcctcaaaatatggattcccaagcctcaccccctagagattttgatctgtgacgaggcctaggaatcccccaccctccagcaaatcgggtgatgctgagaatgacaaggaggtctcactcactgattatgtaggatgtggtgttgtgaccaccttcttcccttggcttcctccctagctgggatttgtgggctgcactctcaggtatctttactttaatgctttgatccttctcagtttccttgcatagaagcttcctcttctgtcactcatgccttaaatcttggtttaggccccacagctcagccttttcttttcactcaagatgttactcgttttcttagactcgggaaccactgtaggccaccaggctggaccaccaggttgagaatgaaatcacccattctttagtcatttccccactccctgtctattctttccttattaccctcctccccatatgttcttttcttttcactgtttataaaattaatatttaaattttttattacagata

SEQ ID NO: 117161 - DNA, 601 bp, Human
cattccttccttctttctcaaggatgggccagaaaggcccaataagaacttgagaaggaaaggcactgagaaggctttgaggcctctcctcccttaatatgtaattcaaaatgctaacaagtgaaagaaacatctaatccatgatgaacatttccaagctttccctgaaccatcaaaaatctctctttccaaaaaataatctctctggcagtggggggcctaagcacatgtgtagccaaactactcagttatcctgcactgaaaaccacccacatccttcccatttataggcaatctctcytacatcatcataagcaacaatttcaactaccaccacctcctcagccccaaggtctccaatatccaccctcttcatcctttcaccgaacactttctagaacagcaactacacaggcttcctccatgtcccccatccagtcttcagtccacagtgttctgccttagtcaatccagtgaaataccccttgttaaggttctacgtcgttttagtcttaccttatccttcaggttcacaagggagcttcctcaaaatatggattcccaagcctcaccccctagagattttgatctgtgacgaggc

SEQ ID NO: 117162 - DNA, 601 bp, Human
attgcttggatctctagttgcagacaccagctgataggcccagagccatccctaatgacctctgagacagcgtctgtctcttgaatatgcatctcctacaagtcagaaattgacatattatctcccctgaaggcttctaacatttattgacgctatttggaaagccatgcttccatgcctattaataaccttcagagagaaccccaaggaagtgtcaggagaaaaatagatccggctgatggaagccaaagacttgaccagaggtaacagtcagtaatacatttaaaaaaaaaaaaaaaaacagaaagtagtaacatttctgaattagatgttatcttttcaggaggcttcaaacaaaatacttagccaatgaattacagcaatgtgaggcaagaaccctggtctttacaaaaaggaactcttgaaagaccccttatctatttaaatagaccagcagcagcaactaactttatctgcacatcaatttattccaaggaattttgcctacacggctgttatcattaaacctttcatagttatttttacagttatttaaactttgtaaagtttctccaagtcacacattaaatagcaaccagat

SEQ ID NO: 117163 - DNA, 601 bp, Human
tatgaatacagctaaatatttttgaaatgggatataaacttgtatgaaggtagtcatagctgcatatcttgcttgggttcaactaaatccttgtgcaaggctgtaatgccaaaatctctaactgaaaaatcacaggctactggggactgcaaaatattatctgaagggttcagagtatgaatccgtgcctctcgtgtacgcacatctcccttctgttcttggataagaccgtctatccctggtaactgattttagtatgtcagacacaagaaaaatcgctattcagaaaatggttagagamctcctgccttaactaaggtaccctctttaaatcaatactgtttcttacaatgtctcaggcctactttcttagaagacagaacattcccatgatattctactaaaaacagacacatcaccagggtagtacaaaacgactttccaaatcccatgttacttttcaaattccacttaaagatcagactgtatgtagttaagaagctagcgcttagctcaatttctaatgtatgtgggcttgaaaccaagtttggcactttttttgctcatcacaattttacagctagataaagccacagatacc

SEQ ID NO: 117164 - DNA, 601 bp, Human
tcaactctcctgctctcaaatatttttggctaaggagcgttcatatgtaagttggcaagaaagagaaactagtagtggaaaatgggagtggcaataattcaatagttctgggattgccttactccagtattttttaaatgtttttggtctcagaatctctttaaactcttgaaaattactgagaagcgtgtgtatgtaggctacatctcttgatatttacagtgttaaaaatttaaacagaatttttaaaatattatattcataataaaataacaataacatactaccttattttttttttattttaaaagagctatgatgtatttttaaaaaacatgttatgagaaaagtggcattgttttcctgctttttagaaaatctctgttcaataaaacacagctggattctcatatatgatctacattcattctgttacaacatgtactggctgaactatatatagaaaatccagtatcacacatatcattggaagaaggaggaccttgtgaaacccctgagaaagtctcaggcgcctttggagttcttggacaacacttcaagtaactgccttagtccttaaatgctcagtctttgtactata

SEQ ID NO: 117165 - DNA, 601 bp, Human
cagtttaattagaatttttcctgaattaatcaactcaatttaagtttaaattctaaagaattagtagcatcccttccccaccatgcacacagacacacacagagagacctgcaaaggaatggcaagattaagagatttatcatctctataactttaatctgtagaatttagctcaagtaatagtaaaagtcaacagttaacaagcttcaaatcaagactccttttactattaaaaaaaaaaatctaagaaacaatcaccactggcatattttccacgtcacaaagccagcaaaagcccacrtcccaaatacctattaacagattatcattgtgcgaacaaaattaaaacaataatttaggctcataaatagaagacagaaaaagaattataaattcagaccctcaaacagtagggactaattccgtctctagtgtttaaagacagctcaaaatctgccaaaaatctttgggaaaaaagtcaacttactggttgccattttgttcagggtctgcagtgcttatcctgaccagtaaactcagctattaaaaacagcacccccaaaaggaaagaaaaaaagaatgtggaaaggggaatgttctg

SEQ ID NO: 117166 - DNA, 601 bp, Human
ttttctggatggtaaaataaacaaaaagctggtaaagttctttaatgataggttagtgtgcttgtactctttcagctttaaagcaaagagtggaagcccattgctatctagcatgtctggagtgttgacctttaaaatcaaattatttaggctgggtgcggtggctcacagctgtaatcccagtactttcggaggccgaggtgggatgatcacttgagcccaggagtttgagaccagcctgggcaacacagtgagaccccatctctatttgtttttaattatttttaaaattaaaaaaaaatcaatttttttggctggcggtctgtttacaaaccatacctccatcatatcttaccacccttcacttaaatttatttctctttggttccataattatagttcagtcaatccctttcctaaaagcaaggtaagggaggaggtaaaggggatttttatttaccttccttttctatttttaaaagcatatgaaacttgaggaagatcctactactgttgttgtttttattatttccatgttcacatagatctttcctatagtggatccttttggggatatacaaatccttcatcttggcccctc

SEQ ID NO: 117167 - DNA, 601 bp, Human
agacagggtttcaccatgttgtctggctgatctcgaactcctgacctcaggtgatccacctgcctcgacctcccaaagtgctgggattacaggcgtgaggcaccatgcttggccctatatttattttaagtagaaaattaggttgaattttttaaaaaaataggtgtatgtaaatattcagatataatgtatataagaatttccttcaaaatagtcaataatcaccaaatatttattataaaaagagtgttttaagtttgataggcttaagaagtagtttatagtaagccaaaaaaaaaaaatcacagtatacttatcttaacccaaaaagatgtgagtcacttaccttccatactaggggaggggagagcaatcatgataagcacaggaagaatcatcactccatctaccattgtacaactgtaaagggaaaagaagagatgtaagtaaagcataaatatctaactgcaggaagacaaattaagcataccaccttcaaactgccattcaaggcccttcttactaatcaccctcagatatattgccttacttcttactacatttaaacacataccttttatgtggacctaaacatatcact

SEQ ID NO: 117168 - DNA, 601 bp, Human
taaaataaagtgggcactgctcaatgtgcaatagagtagagtttaggctttctctatctagaaagatatataacaacatgttaaaagcaattacatgtaagtgaagggaatgatgagtaacttttactatctttctctcttgattatctattttgtccttttcaacaagggcaggaccatccctgagcaactttttggaaatgaggggatgggaaagtgagtaatgaaagtaagtaagcaagggtcagagatgccaaaggcactgaaatgcctgggtggtgccacacaactaagaattagmctcctagggcctgaatgtttgtgtctccccaaaattcatgcgagtatcttaactgccaaggtgagggtattagggcagacccctcaggattgggatttgtgctgatataaaagagatcccagagggctagctagccccttctaccatgagacaacacagagaaggtgccgtctatgaggaacgagcccttaccagacactgaatctgccagcaccttgaacttagacttcccagcctccaggactatgagaaataaatgtttagtttttgatccacccagtttctggtatttttgttgta

SEQ ID NO: 117169 - DNA, 601 bp, Human
ttgtggtggcacaagcctgtggtcccagctactcaggaggctgacgtaggaggatcacttgagcctgggaggagaaggttgcagtgagctgatatcacaccattgcaccccaacctgggtgaaagagaccccgtttcaaacaacaacaacaacaaaaccgtaacaacaaaaatatcatatagaattgatatggtaactaaggaaggcagtgaaatttggagggactttagttctcaatattccttagatttttaaataataatcattatttaccaatttaaaagaggtaaaaaaaaaaaaagtcctagaaacttgactgttagaaatgtctccagcaattatcaagtatcccctgggggataaaactaccccaattgaaaaatcactgttaactcaccaaatcctcccagctttaatataagcccatttcctcgtattaattccttcaacattgccactcaggatcccttccccataccttcttggcactaactgacacaactgccatattatgggaatatctttaacaacactgcttagagtggaatataaactagatatctaaaatggtctataacagcactggccaacagaaacaaaa

SEQ ID NO: 117170 - DNA, 601 bp, Human
gaggcagagtgtggtggctcacgcctgtaatcccagcacactgggagatagaggtgggcggactgcttgagcccaggagttggacaccagcctaggcaacacagtgagaccccagctctacaaaaaatacaaaagttagccaggcatggttccctgcctgtggtcccagctacttgggaggctgagacaggaggaatgcttgagcccaggaggttgagaccacagtaagccaggatcgtgccactgcactccagccctggtgacagagtgagactctgcctcaaaaaaaaaaaaaaaaaaattaaaaggcaaaatatcatacagaatcgatagccggccaaggtggctcaagcctataatctcagcactttgggaggccgaggtgggtggatcacttgagctcaggagtcggagaccagcctgggcaacacggcaaaactctgtctctactaaaaatgcaaaacaattagctagttgtggtggcacaagcctgtggtcccagctactcaggaggctgacgtaggaggatcacttgagcctgggaggagaaggttgcagtgagctgatatcacaccattgcaccccaacctgggtgaaagag

SEQ ID NO: 117171 - DNA, 601 bp, Human
gttttgtttgccaccatttagttgctacagttgggatgcctttgaaaatggagtatgtgtgcctgcctgtccctaaactgcaggaggattagtttttcccatccctttacttctcatcttgccacactctatgatccactttcaccacacaccactctttcaaaacacaaactgcacctacttaatctctccacagttctccattgccttcaggatagaagacaaacaccttagcataaggctctgccatgcctgcagggctcaactctcaaccttaattccgtctcatgacatggtgacygctcatgatctcatgatctcacgtctctggacttcacccttcccctgcctgcaatgtccttcttagtccctcctcggctggtctaatggctacttatccttcaaaacttagcttccctgcatcaccagccccaaacccagctccatgtggaatgcaggcctttcctgtccatacgcctcatgctatgctgtgacctttgctgtatccaactggactatgacttcttgaagcaggaaccacttcttgcttatgtttacgtcaccaatgcctaccagtgttgtcaactggtactcctgttta

SEQ ID NO: 117172 - DNA, 601 bp, Human
cagaaatgaacatttcctaagttctaagttatatgctgtttgagtagcatgatggaatctcacgttgtccagctccatcctgcccaggacatgaatcatccatttgtccagcgtacccacactgtagatgctaccatcctgctagtcactgagcagatgtcttggttaccagatccactgccatggtattgcaggtgcgttcaaggaacccttcctttacttaataactgccccaaagcacaagagtggtgatgccagcctattgttataattgttctattttactttgctattgttgttmatctcttcctgtgcctaatttataaattaaactttatcctagacataggaaaagatgtagtatagataaggttcaatactatctgtggtttcaggcgtccaccgggggtcttggaatgtattccccatggataaatagggggttactgtatttactttccatcctagatgaagccaaagcgattttaaaataacagtcaaaagggtaaaaacttggggcagagtccaagcctctgataatgctacttccctatcctccaatttccccattcatttcccaaggccctaccaagtccagaac

SEQ ID NO: 117173 - DNA, 601 bp, Human
catggactgggcctcctccaaggttgccaatcttagctgtggttaccatcagcgagcctccaccacacccctacagcctttctggaagctttcaaactacagagacaaacccttcaaaagttaagcagggctccaatttgtttaacaagtcttgaaatgcagcctttaggcactgtgacacccacagctaaaggtgaaaatgtcctgacttagttaaactccccttccctagctccacaacctatcctgccccacagaaaagcacagagtgaacaaagtaacttccagactacagtagtcyccacttatccccccttatgcaccgtttcactttccactatttcggttacctaccatcaaccacagtccaaaaatattaagcaaaaaattccagaaatgaacatttcctaagttctaagttatatgctgtttgagtagcatgatggaatctcacgttgtccagctccatcctgcccaggacatgaatcatccatttgtccagcgtacccacactgtagatgctaccatcctgctagtcactgagcagatgtcttggttaccagatccactgccatggtattgcaggtgcgttcaaggaacc

SEQ ID NO: 117174 - DNA, 601 bp, Human
ttatgattctctgaatgttgcaaagacttggctttaacaaatacagcatattaaggagttgttttaactccttaatacgggagaaaataatgacccctttcttcattctgtcttcaaacttcttgaatctctgctttggagaaacaaaggattacaaggcctaccgggaactgcctactgaggaatactttaaaaaccaaaaaatactgtctcctcagcgtatgtgccaatggccatgtctaagtggagctctagttatagggagagtaacagagagtagaataatctggaggaacagggragaaagtcccagtgaattgtaaacacttcagaagtcattccttgtttagtcttaggagagagccaggaatgtggttccatcgattgaatgtctcaggctggaagctctgttcgcgccacaggaagaatggttgattctgaggaatcactttttgttgtttcccccacctcctcgggctaaccagagagtgtatggcatttcagtaagggtttcctacctgggctctacactgagaattttggttttacaggaaacatttaacaatgggctctagatgagatagaacagtggagaaaaagc

SEQ ID NO: 117175 - DNA, 601 bp, Human
caagccagaggtattccctctctgcagagctcacccacattgtttgttctagaaggcacctcccggcattactcagtgttatggctggcactgcgtgccctttgtatcaccagagccagagccgtgtgaaaacactcgcagcctgggctggctgggaacagcagggagttctgaccacaaacagggactgcttcggaaccgccagggagaatacggggctggctccacaaaccagcggtgcaggctgggaatcccaggagttcaccatggccagctctttaaaaagatttttcctgctctstatgatcctcagttcaccacctgggcacacctcctccgagtctaatgccggactagcagagagagaggcagaccaaagaacatcgtggacttttaaaaactgtccacaatttggtataatcttgtacttcatggtaaaagtattcacatttatgtttaagtgggactttagcaatcacaacactgtggacttacctattcacgcctgcccagtcatgcactctgcaatgctttaaggcattgaaactgagtattactctaaatggtgcacaaaaaccaacatttcccactaatgtctttg

SEQ ID NO: 117176 - DNA, 601 bp, Human
tccatgggaacctttagtgggcagctgggccgtgatgttcctgttacaccagtccccttggcagcactccacggcttggccaggggacggcggggtcttacaggtcatctttccctgctcataaacctggaagcagcctttctggtagacgtggaagccatcgttgatgctcagtgaggaaaagcactgctggccttcacagtggtcctcattaccgcaggagagaccttcacacacacacatgtagagtttggggttgaccttgggcttctcatctgcaaaggagagaaaggaagggggraaaaaaaaaaaagaggaattaccgtatgagtttcaccttcattgagggaatgaccattccaaacacctctatcaacagaaagtcaagctaagcatcaccatcaaccatgaggtccacattctgtcaccttgtcacctaaccaaccaacaaataataattgcctctcaacatagcgattcatttatataagctgtgcacccttttagatcatattaggacaaagactggctatcatctgtccacagacttctgaaaatgagcttctccccctgtggtgttcatataaccttcagcgtgatt

SEQ ID NO: 117177 - DNA, 601 bp, Human
agcaactcccagcaggcaggctaaaagacatactgcgaacactacagagagaataatgaggccaacctccaagtggaaattctgtgttccagggaaggattttcctggagttggagggaaaagggggaattagttgtaaggatcactgcttacttattattagcataaccaatatcctaacaagtagctcctgatcctgaccacacagtctcacaactcacgaagtattaaaactaaaacacttcctaatgcctggccaatggcccagacattttaaccatcattcaattagacacaactrgaatttgaaaaaattccactgagaatcaattgcattaatgtatgaatgtgagagtgcttttaaaatataaagtactgtacaaatctttgatattactctcattaacttggatttggtatgtttcgccatcaagcccttacagacactgtactatccttaagagaaagggctacctgagctaaaaccaaattacccatctgtggtctctgtctttaatatatcctgggtgtctactgctggtttctcactgatttttttacatcacaatttctgcctaggaacccattcattcctctcttc

SEQ ID NO: 117178 - DNA, 601 bp, Human
ttaaactaatgtgttattttttccataatgtatgatcctgcttctaaaccctgttcacagacctaaggaaagaaaaataaaaaatcaacccaagactaacaaacgtatatcccaactctcagatgccaagccttctttttgttcttttcttttctttagttcaagacagagtttcactatattgcccaggctggtctctaacccctggtctcaagtgatcttcccccttgggctcccaaagtgctgggactgcaggcatgagccaccatgcatggccaaggcttgtttttcaatgtagacrtgctgtttagtaagggcatgctttgttgaaacatacaaatgagcatattgcttaaataagcaagtatgtagaccaataatgacaacttgttttaaatagtgttctttactgtgttattatatcatgatacactgtcacatgacatggttgagtttaaaggactattttggcatatgctccattcctctctcaaaattctaaaagccatttaaacagtaatttataccagatattcctattattgcccttggtaattagttatgttagcagctctgaggaatgaagttctaactaacctat

SEQ ID NO: 117179 - DNA, 601 bp, Human
ggtgatctgcctgccttggcctcccaaagcactgggattacaggcatgagccaccacgcctggccaggaaaagttttatttcttcggaatactagaagctagcacttcacctaatatatgataggttttcccgaaggataagtagtcctttcttatacacagagtttccaaataaaatatataatgaaagaagctgagcagacaaagttgaaggtgtaaatcagaaagcccaagaagcagatatgatctcaaggaaagcagtagagagaatagcaggtggaacagaaaagggtggggggggtcctttcaacttcaagaactgggtataatttacatattttgctattctcactaagtatctgtcaaatgattcactttagttgccataccaactaaggaactctaattaggaacaaacaaactaggaataaggaacaaacaactctaatgtgatttgtaacgaaaagactccaatgaccatgtggatcattaaattggtaagcgcaggcagcaacgggctgcctggatggaggtttccttttaggcaggtgaggagcaaaactatatcaacacctacttatcatttcttaatgtgaatcac

SEQ ID NO: 117180 - DNA, 601 bp, Human
gagccccacaaaaaggctcccttaaggcacctgaaatttgtagtttcactgatcgtcatccagaaatgactcccctaacccaacttcccatgtttttgaaccaaaaataacataccatccatgcagttcatcacatatatttttactaaaagctgtaccacatgaacacactaactacaagctaatgaaaggcactgcttttattaaagtctttagtcctaacccaagaaaatgcaataatgatatttatactgtttcaaaagaatgctgaggaatatctatagaaccagaaactacataytttaaaggtgcattactattttgccatttggactctggagccaatctctgaagactaatcttgagatagcttgcatggaatagtagtggagaggggagatgagacagggaaatgtaccccttcaatgtcttcccaccactatccagataatcttgttcataatcaaataagatactagttagtacaagaggacaactctggttgaaattaatgagcacatttggggcttttccatctttattttctccattcacaatctgccgtggaggagaagcgagaagcagcaaacagtgacaatag

SEQ ID NO: 117181 - DNA, 601 bp, Human
tgccagaaaatggtatgctaatcttttcctgcctttggttctgttttgtatctttattttccctttgtcctcattttgtcattagggatgagagcaaaatatcccagggaattatggatacaaaattacctcaaatcctttttttggttgttgttttaaagaaaacagaagatgaatgtcgaggtaggtaaattaaaatagaaatattgttcaatggttttcaaatgcttttaagttgttaaatgctttttgcaaattcatcattatgcagaagcccctaaaacaaaagcagagctgcccraaagccctggccatggagccccacaaaaaggctcccttaaggcacctgaaatttgtagtttcactgatcgtcatccagaaatgactcccctaacccaacttcccatgtttttgaaccaaaaataacataccatccatgcagttcatcacatatatttttactaaaagctgtaccacatgaacacactaactacaagctaatgaaaggcactgcttttattaaagtctttagtcctaacccaagaaaatgcaataatgatatttatactgtttcaaaagaatgctgaggaatatctataga

SEQ ID NO: 117182 - DNA, 601 bp, Human
tacaaacccatatatctaattggaaggttacaagccaaaagaaatgtagttgaagaattaattagctggacttactgcaaagttcccctcaactccttccctaccaagtcccataaaccaaaaccaagagccacctcaatttgtccaccctccccagaccactggattataacagaagctacaacttgaatccttattgtttaccagacatttataatacttctgggccttaccagaatccggtgaggtgggcttattttttagttacatgagtaatatatgatcacactatatatatatwtttttttagacgaagtctcgctctgtcgcccaggctggagtgcaatagcgcgacctcggctcactgcaacctccgcctcctgggttcaagcaattctgctgcctcagcctccccagtagctgagattccagacgcacgctaccacgcccggctattattattatttttcttttttttttttttttgtatttttagtagagatggggtttcatcacgttcgccaggctcatcttgaactcctgacctcaagtgatccttccgcctcggcctcccaaagtgctgggattacaagcgtgagcc

SEQ ID NO: 117183 - DNA, 601 bp, Human
tccctctcagctcaccatgcaccatgttataaagacactcaagcaaccctgtggagaggtccccctgcaaggagctgagacctgccgccaatcatggctttaagtgtgtcctcacagagttggaaactccagctctggttgagcgttcagatgattgcaacctccacgagaccctgagccagaaccacaccgctaagtcattccaagattcctgactctcaagagactgtgtgagataacaaatctgtgttgttttaagatgctaaattttacaggtgatttgttcttagtaataagtaayttttacactaaagatgacaaaacaaccggatgcaatttgtaaactttggctgagttcctctttgaaaaaactgaaaacatctgaaaatgaatataaaatgatactagagaattatcaataatctgtagatatgaaaaactgattatgaagaagatgcatttttaagtattttcaagggatgaattttgaagtattgaggggtaaagtgttgtgatgcctgtaacactttattttcaaatggattggcaaaaatatacacatggtcacagattgataaagcaaacatcacaaagttttaac

SEQ ID NO: 117184 - DNA, 601 bp, Human
actcactttttctaggggtgattttgaatgctgcacagggaagggaaggaaataatagtcttaacttttcttaaaggataccagaaacattgctggatataatttaagattagtgttttctctttcatagaaagaacgtacatactgggacatgagtacagttacagcaagtctaggtgtgctaacaaaacagggcacattcaagtacagtaagattttgcttgaaattaaaaacaaactacatgagattaaagcattaaaatcatatttctcaatctgaatacatgttaaaaaaaaaaaatcaaaaggaacgcagaagtgctagctcacatttttaccatattacaaaagcaattggtacccatgtccataaaggcagcaacaaagctgcttgtctattgaagattactactgcaaattggactgcattcaatgctagttgtaaaaacaccagcttttcagaagttggtatctgtacaaaattgcagcttattttcttcacttctgtcccttcaagtctttacacagtaatgctaaaacacccagctttgagatcctgagtcaatatattgccactttctttttggtagcttgagcttca

SEQ ID NO: 117185 - DNA, 601 bp, Human
aaggacacatacttgcctccaccgagtcctggagggaggctggaagttagctatgcagatgtggggatggtccggccctcaacctcacccaataccacatcccactcccttgcctgcaccctacccactccgttctttgacccttgtcccacctacgatggggcgcttgcagctgctgcacttaggtgcaaagagttctccaaaacaggccacacagtagggatcttcatcccgggaggtgaactgctgccctgccaggggcgtctggcatccggtacagaccagacattctcgatgccayggctgatcacggtatgtcactccaccctgtgtcagcgtctgtgggggcagcatccattagtaggtatgagtggggattcccaccccacaacaggcctcactcacccccacctggctggcccagcccccaccttgctgcagcgggcgcagcgaggagcaaacttgttctcatagcagggcacgcagtagtgagcacccttgtcgggcacaaaagaacgggagcccagtggctgttcacagccactgcacaggaagcagtgctcatgccatgtctggcctccatattccagcttccgggacc

SEQ ID NO: 117186 - DNA, 601 bp, Human
tccacatgcagctgggggggccccagacccagtgctccagcagctataagccattgcaaattgatttgctacagtaaagggtgagcatgaaggaattctgcctcccctggccagggcccacctctgaagaagtccagcagcctgtctctctttatcataacccacccctttcactcccccttagtccagggtttgaatcaattccatctgccccagtcagctgcaaatcagggaaagagacgatggggtcagaatttcagccttgttttcccagctgggtctctgtttaacaatgggaagagaattcataggatggggctgagactctccccaaataggagccaaaggaactgtctgtgggcgtggcaaactgggacgacatgttatgcactcaggcttcaggggtggctagtagttattttggtgggcaaatcagctgtattactgacagatgccaaatcaagaaagtcactgggaggccaggctaattcttttcaggatgtggcctggagctctagcgtggctaaggttgagcgagagggcagcaccaaaaaagaatgaacatgccagattcttacgatactgacagtgaagaatggaa

SEQ ID NO: 117187 - DNA, 601 bp, Human; identical to SEQ ID NO: 32255

SEQ ID NO: 117188 - DNA, 601 bp, Human; identical to SEQ ID NO: 32256

SEQ ID NO: 117189 - DNA, 601 bp, Human; identical to SEQ ID NO: 32257

SEQ ID NO: 117190 - DNA, 601 bp, Human
cacgtggacaggcaggcgggtgctctcacacccacagcagcacagaaacaaggcacactcaggcagacccacccgtccacaccctctgagtcactccaggactgggaggaagatgtgtgagttaaggcctgaacaaagcacatctttccaccacaaggccctggcaactagtgtggctgggggtggctgggcttccccaggcccagcacagggagcagggagttttctctagatattccctggatctagtgtcctcccaggagtcagatcataaggctccatgcaccccccacctgaactsgtctcccctcttcaccacccagcagctgtgagaccttgagctggttatttctcctctctgagcctcagtttccctgctgtagaatgggactcataactgcaacttcacagtatagtagtgaggcatccacaaagtaaacgtttcaagaatctggtctagggcaggagtccagcggagaagggaagaggaggtggtggagagcacaggctctggtacccaacagcctggccttgaatccacctcttgttttaagtgagtgacttgacctctctaaatttcacagtaatgagtagccagcat

SEQ ID NO: 117191 - DNA, 601 bp, Human
cgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaayctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggc

SEQ ID NO: 117192 - DNA, 601 bp, Human
acttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcrgtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgta

SEQ ID NO: 117193 - DNA, 601 bp, Human; identical to SEQ ID NO: 19566

SEQ ID NO: 117194 - DNA, 601 bp, Human; identical to SEQ ID NO: 19567

SEQ ID NO: 117195 - DNA, 601 bp, Human; identical to SEQ ID NO: 19568

SEQ ID NO: 117196 - DNA, 601 bp, Human; identical to SEQ ID NO: 19569

SEQ ID NO: 117197 - DNA, 601 bp, Human
aaaagaaaagaaagagaaagaaaaagaaaaagaaaaaaactccaacagacactccttagcctcaagagaaggcctaaaatcctcccacctctttcaaggccttttatgacctggtgccagcctacctgtccactcttcctgccccatattgccccaaccgtgctgcgcccccttcacagacacgtgcatgcacacgctgtcaaccatattacatgctgggcttctctcctaagaaccctctttgggccgggcatggtagttcacacctgtaatcccaacacattgggaggccaaggcaggyggatcacttgaccctgggagtttgagaccagcctgggcaacatgaaacctcatctcaacaaaaaatagaaaaattagctaggcagggtggtgtgcacctgcagtcccagctattccagaggctgaggtgggaggatcacttgaacctaggaggcagaggttgtcctgtgaggcgagattgcaccacagcactccagcctgggtgacagagtgagatgctgactcaaaaaaaaagaaccctcttctttctcagaccaattcctcttcctccttaatgccaggtcagttctcctcaccatgg

SEQ ID NO: 117198 - DNA, 601 bp, Human
atctcattataatgacatgggtgtgtacacttcatggcgctgtacacatgatgtgggaacttttctgtatgtttgttagacttcaatcacatttacattttgaaaattaacagtggctctctttggatgacatatatttttttccatttgtcattatttagcaaatcaccagtaataatcacatatcacatacatatgtatgtgtgtatgtatatatttttcaagtccctgttgacctaatatggaagcaatctctgtcctcagttttttttcgaagtaactgaatgggtaacaaagaaasgtgagctttccttttgaaatattctaaggcgagtatgaattcttttctgaaaatcactaaactcaaagaggactttgaaaccagccaacctgagggtgtccagagctggcctggatgggtgtgagcagggcctgggggctggagaggacacagggtgggcagaaagaagaaacagatgagctctctgctgccttcttttgcaccttgacctccaccttttatctattttacatatttgggcttcaaaaagtttcatttaaagaaaagattctgtagctaaaagaagttttttaaaatgct

SEQ ID NO: 117199 - DNA, 601 bp, Human
gtcttggcatcttgacttgccacgtgcatctcattataatgacatgggtgtgtacacttcatggcgctgtacacatgatgtgggaacttttctgtatgtttgttagacttcaatcacatttacattttgaaaattaacagtggctctctttggatgacatatatttttttccatttgtcattatttagcaaatcaccagtaataatcacatatcacatacatatgtatgtgtgtatgtatatatttttcaagtccctgttgacctaatatggaagcaatctctgtcctcagttttttttcraagtaactgaatgggtaacaaagaaacgtgagctttccttttgaaatattctaaggcgagtatgaattcttttctgaaaatcactaaactcaaagaggactttgaaaccagccaacctgagggtgtccagagctggcctggatgggtgtgagcagggcctgggggctggagaggacacagggtgggcagaaagaagaaacagatgagctctctgctgccttcttttgcaccttgacctccaccttttatctattttacatatttgggcttcaaaaagtttcatttaaagaaaagattctg

SEQ ID NO: 117200 - DNA, 601 bp, Human
caacctggtgtcttggcatcttgacttgccacgtgcatctcattataatgacatgggtgtgtacacttcatggcgctgtacacatgatgtgggaacttttctgtatgtttgttagacttcaatcacatttacattttgaaaattaacagtggctctctttggatgacatatatttttttccatttgtcattatttagcaaatcaccagtaataatcacatatcacatacatatgtatgtgtgtatgtatatatttttcaagtccctgttgacctaatatggaagcaatctctgtcctcagttttttttcgaagtaactgaatgggtaacaaagaaacgtgagctttccttttgaaatattctaaggcgagtatgaattcttttctgaaaatcactaaactcaaagaggactttgaaaccagccaacctgagggtgtccagagctggcctggatgggtgtgagcagggcctgggggctggagaggacacagggtgggcagaaagaagaaacagatgagctctctgctgccttcttttgcaccttgacctccaccttttatctattttacatatttgggcttcaaaaagtttcatttaaagaa

SEQ ID NO: 117201 - DNA, 601 bp, Human
tggtgaccctctgattaaacctctttctctgctgcaacctggtgtcttggcatcttgacttgccacgtgcatctcattataatgacatgggtgtgtacacttcatggcgctgtacacatgatgtgggaacttttctgtatgtttgttagacttcaatcacatttacattttgaaaattaacagtggctctctttggatgacatatatttttttccatttgtcattatttagcaaatcaccagtaataatcacatatcacatacatatgtatgtgtgtatgtatatatttttcaagtccctrttgacctaatatggaagcaatctctgtcctcagttttttttcgaagtaactgaatgggtaacaaagaaacgtgagctttccttttgaaatattctaaggcgagtatgaattcttttctgaaaatcactaaactcaaagaggactttgaaaccagccaacctgagggtgtccagagctggcctggatgggtgtgagcagggcctgggggctggagaggacacagggtgggcagaaagaagaaacagatgagctctctgctgccttcttttgcaccttgacctccaccttttatctatttta

SEQ ID NO: 117202 - DNA, 601 bp, Human
ctcctcctttggtgaccctctgattaaacctctttctctgctgcaacctggtgtcttggcatcttgacttgccacgtgcatctcattataatgacatgggtgtgtacacttcatggcgctgtacacatgatgtgggaacttttctgtatgtttgttagacttcaatcacatttacattttgaaaattaacagtggctctctttggatgacatatatttttttccatttgtcattatttagcaaatcaccagtaataatcacatatcacatacatatgtatgtgtgtatgtatatatttttyaagtccctgttgacctaatatggaagcaatctctgtcctcagttttttttcgaagtaactgaatgggtaacaaagaaacgtgagctttccttttgaaatattctaaggcgagtatgaattcttttctgaaaatcactaaactcaaagaggactttgaaaccagccaacctgagggtgtccagagctggcctggatgggtgtgagcagggcctgggggctggagaggacacagggtgggcagaaagaagaaacagatgagctctctgctgccttcttttgcaccttgacctccacctttta

SEQ ID NO: 117203 - DNA, 601 bp, Human
tcatgctcctcccgcactcctggttcctcttcgaagctcatagtagatagcagtagaagaaatagtgaaagtcttaaaagtctttgatctttcttataagtgcagagaagaaaaccctgacatatgctgcctgctctctgcttcagctacctaaaagggaagggcccccgatcctgtaatcacatgacttgcttcaccttgtcaatcacttagaagatttaccttccttaccctgcctccttgtcttgtatgcaaaaaatatcagcgagcccagacgttcggggccactaccagtctctgyatcttgatagtagtggtcccgcaggcccaggtgctttctctttatctctttgtcttgtgtctttatttattacaatctctcgtctccacacacggggagaacacccgctaagctccgtacggctggaccctacagaggtttcctcccatctcctcctttggtgaccctctgattaaacctctttctctgctgcaacctggtgtcttggcatcttgacttgccacgtgcatctcattataatgacatgggtgtgtacacttcatggcgctgtacacatgatgtgggaacttttctgtatgt

SEQ ID NO: 117204 - DNA, 601 bp, Human
gtccactttcatgctcctcccgcactcctggttcctcttcgaagctcatagtagatagcagtagaagaaatagtgaaagtcttaaaagtctttgatctttcttataagtgcagagaagaaaaccctgacatatgctgcctgctctctgcttcagctacctaaaagggaagggcccccgatcctgtaatcacatgacttgcttcaccttgtcaatcacttagaagatttaccttccttaccctgcctccttgtcttgtatgcaaaaaatatcagcgagcccagacgttcggggccactaccrgtctctgtatcttgatagtagtggtcccgcaggcccaggtgctttctctttatctctttgtcttgtgtctttatttattacaatctctcgtctccacacacggggagaacacccgctaagctccgtacggctggaccctacagaggtttcctcccatctcctcctttggtgaccctctgattaaacctctttctctgctgcaacctggtgtcttggcatcttgacttgccacgtgcatctcattataatgacatgggtgtgtacacttcatggcgctgtacacatgatgtgggaactttt

SEQ ID NO: 117205 - DNA, 601 bp, Human
agaggcctaaacccctccctgtggtgctgtgcttcaagggtcatgctccttgtccactttcatgctcctcccgcactcctggttcctcttcgaagctcatagtagatagcagtagaagaaatagtgaaagtcttaaaagtctttgatctttcttataagtgcagagaagaaaaccctgacatatgctgcctgctctctgcttcagctacctaaaagggaagggcccccgatcctgtaatcacatgacttgcttcaccttgtcaatcacttagaagatttaccttccttaccctgcctcctygtcttgtatgcaaaaaatatcagcgagcccagacgttcggggccactaccagtctctgtatcttgatagtagtggtcccgcaggcccaggtgctttctctttatctctttgtcttgtgtctttatttattacaatctctcgtctccacacacggggagaacacccgctaagctccgtacggctggaccctacagaggtttcctcccatctcctcctttggtgaccctctgattaaacctctttctctgctgcaacctggtgtcttggcatcttgacttgccacgtgcatctcattataat

SEQ ID NO: 117206 - DNA, 601 bp, Human
tcaaagaaagatgaaatggtgacatggatcttcaaaaacacagtcacgtccccttcctaaaggggcccttcaactgtgccagggtggccagtgccccaagcctcagcccctccctcttgcttcccactttgtgactgacatgcctcctaaccccaaagtgggaacaaggtggcctccctcaattccatggaagatcagttactccaggaagggctgggaaagaggaggggaaaccaatgtcaaaaacaagatttggggattttccttgggtttctttttatatcgacaggttattcctgtgcttgttatgataaataattaatagttggctccaaatctgccactggcttttagcttggtatccaaatgaaataaacaatctgcagaatattatttagggcttcaccatgtggacaccacacaggaagagagcccagcagggctgctgactggagctatgctgagtcattgaatggagttctcctgtaagaaaggactgaggagagaatcattacactctggatttcaaagaattcagactctctgacccaggaattctacttctgggaaaagaaagaacatagctataaaaaaaaaaaac

SEQ ID NO: 117207 - DNA, 601 bp, Human; identical to SEQ ID NO: 19570

SEQ ID NO: 117208 - DNA, 601 bp, Human; identical to SEQ ID NO: 26387

SEQ ID NO: 117209 - DNA, 601 bp, Human; identical to SEQ ID NO: 26388

SEQ ID NO: 117210 - DNA, 601 bp, Human; identical to SEQ ID NO: 26389

SEQ ID NO: 117211 - DNA, 601 bp, Human; identical to SEQ ID NO: 26390

SEQ ID NO: 117212 - DNA, 601 bp, Human
tattccattgcagtcccaagcgatccccttccttacacaagccagacaaccacgccccttgtctttttcacgagttaataagcaatattcaactctctcagcgctactctcctgttagggacgccaggaaacttccagctccgcttttgctacgttctcccactggattcgacaagattactgtgaaacagtctctacaaggcaagttaagtttgcccgataaagttcagagaatgatccagaaagcctcatgggtgagggtggtcagtaccctaaccacgcccacccctctctcctctcwactgagaggcgactccaaattcgcaaccactttgttttacgagcgcctcccacctccgcgcatgcgccttacgccttccacaatatcacaccattgcccgttcgcacctcgtacgcatgcgccaattctatcgcctcagttcctgttactaattccttgtgccctcagcggccaaagctcacgaccctcgctattgctcccgcgccagcactaaccgatactcaaactcctcgtcgtcgtatttgtccgaatagtaaatttgtttgtgcgacatgatcgctcggtttgctagccttcagc

SEQ ID NO: 117213 - DNA, 601 bp, Human
gattccatcatcaccatccttggcagatggctatccagtgtcttctaaacaatttcagtcaagaggtgcttcctcccacatacctttttcttagagtctcatctcaggctctgccctctaggaagctttccccaacattccctcttccgtttttcctctcagtattttaagtttcatgttcaagggtacatgtgcaggtttgttatataggtaaaatcctgactcgggggttcggtgtacaggttatttcatcacccaggtactaagcatagtacccgacagtttttttttttcctgaacytctacctcctcccaccctcctccctcaagcaggccccaatgtctgttgttcccctctttctgtccctgtgtttttatctccgacatataaatgaaaacacgcgtagtttactactggtttcgttttcaatggtggtgaaagagacatcacgctgaattggcccttaggacactcccccgcccccaaaccaagcccagggaagaagaccgaccgaaagtaagaggtcagcctccaaggcggtggcggggcggggggcgttctcgaagcgtgggatgggggagcgtcctggagttagcaaaa

SEQ ID NO: 117214 - DNA, 601 bp, Human; identical to SEQ ID NO: 26390

SEQ ID NO: 117215 - DNA, 601 bp, Human
ggaacagcctcacatttcggctttagaacaaatcccacaattgttcagctttccggtccccttcagatcaagcagaagatatgttttgattttcatgcttgtattttaaacaataattttctaccccagcgtggtagtcaatgaggagagaggggaagaatgcgcacatgatgctacacgtttctgttgttgctgttattattggtggctttgaggagagctgctcccatttgggggtttataccaactgtggattatggctttgtcattaagatttgatctttgttaaatgaaaaactgyttattgtataaaactcaggtttgtggacgaaaagttgttttttttcttcagttaattaaattgttcctcaagtttgtttaaggacttaaaatcaaacacaaccatgtgtaaactgctaaatgaggctcctaaaatgagaggcctcaactctttaagtgtggagctagaaatgtaaataagtccacagggcagactggtgattatgataaaagctaccatttactgagcatctgtctactaggctcagctctatgctaagtctacatgttatctgtcaaagtggtatcatccccatttaat

SEQ ID NO: 117216 - DNA, 601 bp, Human
ttgagggagaaggccggacctctgactcgggtcacactggggacccccacaaaccatcccttttagacaagtgaccccgggggtcaccttgacccctgcagtgagccagaccaaacttccacgccaggccagcccccgccaggtgagcaggtacacaaaaagaagcctcagtgaccaccgtacgctggtgtggagaggccccgggaggtgcaaggagaacagagacgaactcgaccgcgggcagaagcctcccctggctccaacgccgcgactgcctgtcgccgaggctagggccgccacytctcatgtccgagctggccaggcgccactcgtacctgcgggctataggcctccgaagcccatgctcctgccaacttctgcgtgaagccactaaacttgtagtacatgacgcccagagtccggcttcccgcatccgctgccaacgcgaccgccccagagaaggaccccgcctccccggctgtggtcccgagactcagcgcaaggacccggtgctgggactagggctgcccgaagatcgcctaacttaaaacctgcacacttaagccgcattggggaaccaaaagccagggttctcaggacc

SEQ ID NO: 117217 - DNA, 601 bp, Human
atgttatttagtgcatggcaaattattcactttacttactactacaaattacaaacatcttcatcgtatgtttccaggaaaggaaaaagctgaagtactcctaattaccaaagtcagagcacctagttgggagggcacctgtcacaatcactcagaaatttacaattcatataaagcctacacagtatcacttcttttcaacatagtttaagaaatctttaagtaactaagaagttcaaattctcaagagaaacacgattcacgaggagaggtactagaaatctgaaagccctatctatawcaaactcatcgcaaggtaatctctgctgagcgcccattttattacaatatgccagtttttagtcgaaaaatttacttttttcttactaagcaacaaaacctagattatgctgaagatatattaaaagaacataaaccaagtgtggtggtacacatctgtaaccccagccactcagggggctgaggtgacaggactgcctgagccggggagttcgagatcaggctgtgcaacacagcaagaacctgtctcaaaaaatattttaaaaaaataaataaaagaacatctactaccaccaacaga

SEQ ID NO: 117218 - DNA, 601 bp, Human
ggaattcctagatcacacagtaaaattacgtttccttttttaacaaactgccaaactgttttccaaagtggctgcgtcattttaccatttccaccacaaatgtaacatgtttcgtttctctacatcctcaccaatacttgttatcatctgtctttttgattctaggcattctggtggatactaaatggtacctcattgtggttgtgatttgctctaataactgaaaatgttaaacatcttcatgtgcttattggcctcaatttatttttgacgcaattcagagaaaggtaaggaagatgcytttcaaccaatggaaaatgccatcccaccaactgcttgctgtcaagctgacttacaaatctctacctgtgcaattgttacagaaccaccttttccatattatgttatttagtgcatggcaaattattcactttacttactactacaaattacaaacatcttcatcgtatgtttccaggaaaggaaaaagctgaagtactcctaattaccaaagtcagagcacctagttgggagggcacctgtcacaatcactcagaaatttacaattcatataaagcctacacagtatcacttcttttca

SEQ ID NO: 117219 - DNA, 601 bp, Human
ccaattcaccaatcatgctgaagccctccctcctcatccccaacatctgtctcatctgaaaggacaaactaccacaactctgcatcaagttgctctgcaacttcctactagtgcctcacaaaattaagtccttacatactaggcccttcatgatttacctccatcctccacagtcaaacttacctacccaatgcttctcctccagaccccctcccttccttcactctcacagttccctttacctagaataccattctgccatcttaattgggagaggaattcctagatcacacagtaaaaytacgtttccttttttaacaaactgccaaactgttttccaaagtggctgcgtcattttaccatttccaccacaaatgtaacatgtttcgtttctctacatcctcaccaatacttgttatcatctgtctttttgattctaggcattctggtggatactaaatggtacctcattgtggttgtgatttgctctaataactgaaaatgttaaacatcttcatgtgcttattggcctcaatttatttttgacgcaattcagagaaaggtaaggaagatgcctttcaaccaatggaaaatgccatcc

SEQ ID NO: 117220 - DNA, 601 bp, Human
agaaaagaggatccccataattttaatttttaaatgatagaaatgtatgaacttttccactgtgatttaggactggagaccagtttcaatctgcagtgactcaattcatttggctttttgttttgttttgtttatagatagatcttacactgtcacccacgctggagtgcaacgcattgatcacagctcactgcagcctcaatctcctaggctcaagtgatccttccgcgtcagcctcctgagtagctaggactacaagtacgcgtcaccatacccagctaatttttcttattttttttttagagacggggtctcactttgctgcccaggctggtctcaaactcctggcctcaagcaattctcctgccctggcctccggaaacactgggattaccagtgtgagccaccgcacctgacctctatttatttctaacggtaagctagacatcaccacctacctccatgtccttctgacacctcacactcatcatgtccaaaattcactcctaagcccattcaggaacaccctgtcactgtgaaaagcaccaattcaccaatcatgctgaagccctccctcctcatccccaacatctgtctcatc

SEQ ID NO: 117221 - DNA, 601 bp, Human
ttcttctacctcttaggtttggggaagagggtggagagaaaagaggatccccataattttaatttttaaatgatagaaatgtatgaacttttccactgtgatttaggactggagaccagtttcaatctgcagtgactcaattcatttggctttttgttttgttttgtttatagatagatcttacactgtcacccacgctggagtgcaacgcattgatcacagctcactgcagcctcaatctcctaggctcaagtgatccttccgcgtcagcctcctgagtagctaggactacaagtacgcktcaccatacccagctaatttttcttattttttttttagagacggggtctcactttgctgcccaggctggtctcaaactcctggcctcaagcaattctcctgccctggcctccggaaacactgggattaccagtgtgagccaccgcacctgacctctatttatttctaacggtaagctagacatcaccacctacctccatgtccttctgacacctcacactcatcatgtccaaaattcactcctaagcccattcaggaacaccctgtcactgtgaaaagcaccaattcaccaatcatgctg

SEQ ID NO: 117222 - DNA, 601 bp, Human
cttttcagagagatctttctgaccacccttttaaaaactgcatgtcctcccccttgccctactaacaacttaccctctttatttttctccacagcacttatcaccacctaacatactatgttttactttgcttactgtgtctccccccactataatggaagctccacaagcacaggattttggcacatcttgttcactgctcctatattccaagacttagaaaagcaaccggcagagtaagcgcattcagtaaatataggcagaatgttcaaataaactaaagaaggctatagcttcacartgtaggtttgagtatctcagaaacaaagtctgatcaactggcatttgatggcagggcatccacaattcccatagcaataagaaaacaactgaaagctgttcttataaaaagtggacaggctgggcgtaatggctcatgcctgtggtcccaccactttgggaggctgaggtgggagaatcacttgactcaggagtttgagatcatcctgggcaacgtagtgagaccttgtttctacaaaatatcaaaaaattagccaggtacagtggtgcacacctgtggtcccagctacttaggaggctg

SEQ ID NO: 117223 - DNA, 601 bp, Human
ctttataatattgtaaaagtttatagaattgaagttacctataatctcattatctcatcccattaattgttataaattgtaacttttcctccaatgtttattcaggtttaataatttaacagtcacagtgtaaaatcctacgttcttttttttttttttttttttttttttgagacggaatctcgctctgttgccctggctggagtgcagtggtgcaatctcggctcactgcaacctctgcctctcaggttcaagccattctcctgtctcagcctcctgagtagttgggactacaggtgcrcgccaccacgcccagctaatttttgtatttttcatagagactgggttttgccatgttggccaggctggtctcgaactcctgacctcaggtgatccaccaaccttggcctcccaaagtgctgggattacaggcgtgagccaccacacccggcccattctgttttttttcctttttgagctaggctcttgctttgtcactcaggctggagtgcagtggcgtgatcctggctcaggagctatcctgaaacctcccaggcacagccatgttccctctgcctagaatgatcttctccaggtatcc

SEQ ID NO: 117224 - DNA, 601 bp, Human
atagcagtagcaagcactgccactcccatggcacctaagatttggtcaggtcactaatttctcaataatttgcaggtagattcactttaaaaacattttcaattctgattctggattctctactcatgtgcaaacccgtaagcacctcctctactttcagcaatagctcagtgaattttaatatcaagcaagcaaaaaacaatgagaaaaaaacccactgccaagtcattacatgtgtcacgaagtcaaatatatatattgggtcattcagttatacaggctactcagttattgaggctaytgcttcttccatgcaataaatgatcaagagctattcatgccatttcaaaaccctcacacccttaaatactaatgaggaaattaaccaccctcccctcttttatcagtatctacctatataaagttctattcgtttatggctcaaactaaaatcaagagaatactacttaaagaaaaagaaggagggtgggtagtaaactagattaagatttagtttcataagggattttttaagcctatttatttcacaggcttttctgttgtagagtatcttccctcacctggaaaaacttttgtagct

SEQ ID NO: 117225 - DNA, 601 bp, Human; identical to SEQ ID NO: 26558

SEQ ID NO: 117226 - DNA, 601 bp, Human; identical to SEQ ID NO: 59926

SEQ ID NO: 117227 - DNA, 601 bp, Human; identical to SEQ ID NO: 59927

SEQ ID NO: 117228 - DNA, 601 bp, Human; identical to SEQ ID NO: 59928

SEQ ID NO: 117229 - DNA, 601 bp, Human; identical to SEQ ID NO: 59929

SEQ ID NO: 117230 - DNA, 601 bp, Human; identical to SEQ ID NO: 59930

SEQ ID NO: 117231 - DNA, 601 bp, Human; identical to SEQ ID NO: 59931

SEQ ID NO: 117232 - DNA, 601 bp, Human; identical to SEQ ID NO: 59932

SEQ ID NO: 117233 - DNA, 601 bp, Human; identical to SEQ ID NO: 59933

SEQ ID NO: 117234 - DNA, 601 bp, Human; identical to SEQ ID NO: 59934

SEQ ID NO: 117235 - DNA, 601 bp, Human; identical to SEQ ID NO: 59935

SEQ ID NO: 117236 - DNA, 601 bp, Human; identical to SEQ ID NO: 59936

SEQ ID NO: 117237 - DNA, 601 bp, Human; identical to SEQ ID NO: 59937

SEQ ID NO: 117238 - DNA, 601 bp, Human; identical to SEQ ID NO: 59938

SEQ ID NO: 117239 - DNA, 601 bp, Human; identical to SEQ ID NO: 59939

SEQ ID NO: 117240 - DNA, 601 bp, Human; identical to SEQ ID NO: 59940

SEQ ID NO: 117241 - DNA, 601 bp, Human; identical to SEQ ID NO: 59941

SEQ ID NO: 117242 - DNA, 601 bp, Human; identical to SEQ ID NO: 59942

SEQ ID NO: 117243 - DNA, 601 bp, Human; identical to SEQ ID NO: 59943

SEQ ID NO: 117244 - DNA, 601 bp, Human; identical to SEQ ID NO: 59944

SEQ ID NO: 117245 - DNA, 601 bp, Human; identical to SEQ ID NO: 59945

SEQ ID NO: 117246 - DNA, 601 bp, Human; identical to SEQ ID NO: 59946

SEQ ID NO: 117247 - DNA, 601 bp, Human; identical to SEQ ID NO: 59947

SEQ ID NO: 117248 - DNA, 601 bp, Human; identical to SEQ ID NO: 59948

SEQ ID NO: 117249 - DNA, 601 bp, Human; identical to SEQ ID NO: 59949

SEQ ID NO: 117250 - DNA, 601 bp, Human; identical to SEQ ID NO: 59950

SEQ ID NO: 117251 - DNA, 601 bp, Human; identical to SEQ ID NO: 59951

SEQ ID NO: 117252 - DNA, 601 bp, Human; identical to SEQ ID NO: 59952

SEQ ID NO: 117253 - DNA, 601 bp, Human; identical to SEQ ID NO: 59953

SEQ ID NO: 117254 - DNA, 601 bp, Human; identical to SEQ ID NO: 59954

SEQ ID NO: 117255 - DNA, 601 bp, Human; identical to SEQ ID NO: 59955

SEQ ID NO: 117256 - DNA, 601 bp, Human; identical to SEQ ID NO: 59956

SEQ ID NO: 117257 - DNA, 601 bp, Human; identical to SEQ ID NO: 59957

SEQ ID NO: 117258 - DNA, 601 bp, Human; identical to SEQ ID NO: 59958

SEQ ID NO: 117259 - DNA, 601 bp, Human; identical to SEQ ID NO: 59959

SEQ ID NO: 117260 - DNA, 601 bp, Human; identical to SEQ ID NO: 59960

SEQ ID NO: 117261 - DNA, 601 bp, Human; identical to SEQ ID NO: 59961

SEQ ID NO: 117262 - DNA, 601 bp, Human; identical to SEQ ID NO: 59962

SEQ ID NO: 117263 - DNA, 601 bp, Human; identical to SEQ ID NO: 59963

SEQ ID NO: 117264 - DNA, 601 bp, Human; identical to SEQ ID NO: 59964

SEQ ID NO: 117265 - DNA, 601 bp, Human; identical to SEQ ID NO: 59965

SEQ ID NO: 117266 - DNA, 601 bp, Human; identical to SEQ ID NO: 59966

SEQ ID NO: 117267 - DNA, 601 bp, Human; identical to SEQ ID NO: 59967

SEQ ID NO: 117268 - DNA, 601 bp, Human; identical to SEQ ID NO: 59968

SEQ ID NO: 117269 - DNA, 601 bp, Human; identical to SEQ ID NO: 59969

SEQ ID NO: 117270 - DNA, 601 bp, Human; identical to SEQ ID NO: 59970

SEQ ID NO: 117271 - DNA, 601 bp, Human; identical to SEQ ID NO: 59971

SEQ ID NO: 117272 - DNA, 601 bp, Human; identical to SEQ ID NO: 59972

SEQ ID NO: 117273 - DNA, 601 bp, Human; identical to SEQ ID NO: 59973

SEQ ID NO: 117274 - DNA, 601 bp, Human; identical to SEQ ID NO: 59974

SEQ ID NO: 117275 - DNA, 601 bp, Human; identical to SEQ ID NO: 59975

SEQ ID NO: 117276 - DNA, 601 bp, Human; identical to SEQ ID NO: 59976

SEQ ID NO: 117277 - DNA, 601 bp, Human; identical to SEQ ID NO: 59977

SEQ ID NO: 117278 - DNA, 601 bp, Human; identical to SEQ ID NO: 59978

SEQ ID NO: 117279 - DNA, 601 bp, Human; identical to SEQ ID NO: 59979

SEQ ID NO: 117280 - DNA, 601 bp, Human; identical to SEQ ID NO: 59980

SEQ ID NO: 117281 - DNA, 601 bp, Human; identical to SEQ ID NO: 59981

SEQ ID NO: 117282 - DNA, 601 bp, Human; identical to SEQ ID NO: 59982

SEQ ID NO: 117283 - DNA, 601 bp, Human; identical to SEQ ID NO: 59983

SEQ ID NO: 117284 - DNA, 601 bp, Human
ctgttcccacaaccatcagtgataatatgtatgtgaaaggatgtgctcatacagtggcaagggattagtgaaaagaaaaagatggcgataagaaaaagagatttgtgtgcacatgattttagaaatgatagtcttgcttctctttgaaactcagattagaaaaggtgtatcccatggtcaagttgaatgccaaatagttctcagtttcggagcttaaaaggaagaatgcattctgatttgaagacaaggcatgtagaacagaagcagctttaatgaagctcagtctgggttgtatgaaagycattgtcacattctgacacaatgatatgctggaagcactctttccttagtcaggaagtaggttccattgtacctgatcccaaatcccacaaagaattagaaacttaatttctccatgcaaacttccaagctacaaaatcaaagtttagaatctaaattagtccataaaatattgtgataatatagcaccttgaagggatcataataagccacacatcattactgttttagtccctttatgttgctgtaaaggaatgccagaggctgggtaactgataaagaaaagaggttgaggctgggc

SEQ ID NO: 117285 - DNA, 601 bp, Human
agcactttgggaggccgaggggggcagatcacttgaggtcgggagttcgagaccagccaacatggtgaaaccccatctctactaaaaattcaaaaattagccaggtgtggtggcgcatgcctgtaatcccaactactcgggaggctgaggcaggagaatcacttgaaccttgaaggcagaggttgcagtgagccaagatctcaccactgcactccagcctgtgcaacagagcgagactctgtctcaaaaaaaaaaaaaaaaaaaaaggtcaattttgttgggtacagttgaactttttaastacagcaatactttatataacagatgcctttctgaagagctgagtgaaaatgtcattcatctgacaaacatgcatgtctactctttgctagtcattttctttacaaatcaaatttaatattaaatttatcagatacctcactattcaaggaatcttttaatatacactattataaagcaagaattccaactataatgtgcatagttctaatgtgttatgtataaatttatattttttagtacttcatggcctgaaagaatggtgctttatagtagagccctaaaacttgtagtacaaagt

SEQ ID NO: 117286 - DNA, 601 bp, Human
ccttttcttttttgaaatgactaagctgaagactcgattttctgaaggatatttaatctttgcttgcaaccaatttcaatgtatttactctacagatgaataccttggccttagtggttgaaaaatgtaaatctgttttctaaaactttatttaacctaaatggaagtctttatttttaaagttagtgaaatcgaattgtggatttcattgcctggatttcacttgtgtttttcatagcacatcacttactacccttcctttacctgcttggttttctaaatgccttttctaccaaaaacwcactcctacctcctctacttatttctgtccacctctcttaacaacacgctttctttccccctgccctgtttcaggatacagtacagcctgaatgtggcagacaggctagctgatgaacatgttctcatcgggttgtatgtcaacatgctccggaacaacccctcatggttagtgcaggtttggctgcttgactgtccttagagagggatacagtctgagctggtgacaagcagtctcagcaaggagcaaggtcactggatgccagtggtgacactgaagcactgttaactggttcagtta

SEQ ID NO: 117287 - DNA, 601 bp, Human
tcactggatgccagtggtgacactgaagcactgttaactggttcagttaagaagtctctcgtgatgttagtttggatacttcccatgaaggaaccataggattcatatccttgtttatatattagctaaaacgaaaacttgcataaagggatgccttgctaaatattagccttcaggtagattcaggactccgggtcccaccaatcagttctgtgctacgtgtcatgtcaaattaccacaggatggtgataaaagaatttgtcttattccaaggacatggatgtctctgctgatttggaawacaatgcctcattttacttaagagtgaaaaagagaaaatgcgatgtgattgaatcacaaaatggaaatcatttctttaacaatgataacagtgggaacaatcgtctttcagcaattctattacacatttttctgatgaccatcctgctaaagcctgctttcacatcttggaatacacaaaacttagtttcagatatgttaaattcaggaattaagatagccctgtgtacttggataaagccattcaaaaggcttttctccattttcattgtgacataggagactccttccattggttaaa

SEQ ID NO: 117288 - DNA, 601 bp, Human
tgccagtggtgacactgaagcactgttaactggttcagttaagaagtctctcgtgatgttagtttggatacttcccatgaaggaaccataggattcatatccttgtttatatattagctaaaacgaaaacttgcataaagggatgccttgctaaatattagccttcaggtagattcaggactccgggtcccaccaatcagttctgtgctacgtgtcatgtcaaattaccacaggatggtgataaaagaatttgtcttattccaaggacatggatgtctctgctgatttggaaaacaatgcytcattttacttaagagtgaaaaagagaaaatgcgatgtgattgaatcacaaaatggaaatcatttctttaacaatgataacagtgggaacaatcgtctttcagcaattctattacacatttttctgatgaccatcctgctaaagcctgctttcacatcttggaatacacaaaacttagtttcagatatgttaaattcaggaattaagatagccctgtgtacttggataaagccattcaaaaggcttttctccattttcattgtgacataggagactccttccattggttaaagttacttg

SEQ ID NO: 117289 - DNA, 601 bp, Human
atattttgagcacatactagtaacaggaatggtgattcttaacaagttaccttttatgtatgtagttccttgagttgtgacttctcatgttaattgtaagcttcaaaaagggcaagagttttgtcttcagtctcttttatcttattacaacagctggagtaagaataataaattttgtatttatgaaatgctccaaaaattacaaagcctttttccacacattatttaatttacttctcatagtcctagaaggttggatatgattatttccatttcactgtttaaaaaatatgagctttgrgacattaagtgacttatccaaagtcacatgctagtaagggcttgcaaacaggtcttatgacactggttcccatctattttccaccccattccttggcctctagctgttctccatcaaaagctttgtttttgccattattcagacctaatcctgattaactctgtgtgggggtcttctaccctatattaactacttaacacactgggaaactgacttatttgtaatagtttgctgctaaagaaacacttatgtcattgctggttctgtcagataagtcaaataaataaactgcagctcaag

SEQ ID NO: 117290 - DNA, 601 bp, Human
ctgtttaaaaaatatgagctttgagacattaagtgacttatccaaagtcacatgctagtaagggcttgcaaacaggtcttatgacactggttcccatctattttccaccccattccttggcctctagctgttctccatcaaaagctttgtttttgccattattcagacctaatcctgattaactctgtgtgggggtcttctaccctatattaactacttaacacactgggaaactgacttatttgtaatagtttgctgctaaagaaacacttatgtcattgctggttctgtcagataagtmaaataaataaactgcagctcaagggagaatttctgcttccttcctaattcaatgaagttttaaaagccttaataatttgtatgcaccttcctcattgcaggagaaggagtctgaaatgtgatacagtgtgggcttttactaccctcccccaaagcttgtcaaattcctgggcttgctagtttataccaaggtctgtagtagaccaaccaaatgatttgaaaccagcccagaacttctacctctaacattgtcacttgattagactcctgatgtcatatgactaggttaaaattgttctgc

SEQ ID NO: 117291 - DNA, 601 bp, Human
cttcataaatgtgacaccatgactccatcgcctttgaaactactgctctactctgacccccagggagatgtgctcacatcagagctggaataaaaaaatttaaaaataaaattaaaaaaaagtttgtcacatgtgatccctgtcaatgtagcaaataataggaggaaagaattaagaagggaaagagcagatgcatagtgacgaattataaaaaaaaatagccatacaaattggaatttgttcaggatactcacaagtctgtaaaattacctattctattttatgtatcatttattatatstactacgtgcaagtaattgtgccaagtcagaaaaaagcattgagagtgggagccaagtcttcaaatgagcaaaggcactttaaaaaggtaggagaaacaacccaaaaaaaggaaaagggtagttgggggatgcaagtaaaagtggggacaggcaggcattggagaaagtgtatgagctgagctagcaggcagagggctcgaagcaaacaatgtaaaagaaccattggactttgtggttcgtggaatgcttgtgtgagtattgatgacactgatgacaatggggagtaggagaatggaggg

SEQ ID NO: 117292 - DNA, 601 bp, Human
taggaaactgacacccccagctcccaagaatacatgacttataaccctgcttaatggcttctgactcacttagggataatttgccttgccaggtcacatatcctttatggctagcctaatgctcaccaaatgcagggaagcccaggctctgacatcaatagttgactgacacatctcacccccgacagaggtcacaccaatagcactgtatgtcacagactcaattactgtgaatctttttaaaagcactttccttctaaggtggacttccctgagatccattgttaaggctgagagattkaagaaaaaaaaaagagaaagaattttgtctaactggggttttctcagataaattcaatgagaagtcccttcttggtgagagaatgaggttacttagttttgtgaaatgagccccatttatccttattttcccttcaggctcctcttacttggtagctgcaggtactttacggtgtcagagtgtgatcgtaaataacaggaagatgcatttttgtctcttaagcagcatgctcttcaaagttggacacattaccttacttgctagtagtaatgcattacattacttgctagagagatgact

SEQ ID NO: 117293 - DNA, 601 bp, Human
aatgaatatgaatgataggcatttctatgtgctaatctgacgctttgctgcatactaactctacatacactgtcccgtaaaattactgtaacaaacctaggagataggcagtattattctactcgtttaatggataaggaaactgagattcacagaagtcacacagaagttgcagatatcatacctttcacttagtgtatatatttatgtacttatatatgatttataaggagaaattttttcttagaaaaaaatttgtataattgtgtgtaatttatgtatatatttcctaagaaaaaaattatcttgtataaccatgataccatcttcaattcgggaaagttaatgttgatatatggtatttaatataaacccatattaaaattttgacaattgttctaacactgttctaaaagaaagtagcttttaacggccgggcgcggtggctcacacctgtcatctcagcactttaggagtgcgaggcgggcggatcacgaggtcaggagatcgagaccatcctggctaacacagtgaaaccccgtctctactaaaaatacaaaaatattagccgagcgtggtggcaggcacctgtactcccagc

SEQ ID NO: 117294 - DNA, 601 bp, Human
cacttctttagagatgaatacatgtagtgctaggaaaggaaaatcactatttagtcttgttttctcattctccttggaaggtggaggttacaccacagatttgttattatacctacatttggaaaacgctggtggaaacttagagaagattgaatgaagacactcttaaattaatttttaattgaattcgatgtcatatttttaagagattactactgtaagataaatgtacaattagatttttttagtgttgactaattctaaattaatttgccattactcttaatggcaaaaaccgcarttacttttgcaccaacctaataataccagttaacgttctctgatagtttttaaatgcttctcttagtgtttctcacctacagttttagaaggttgctttaaccctcttcccaaagtgtttctgtggccaaagggccaaaattacagaacagtatcaagaagagaactggaaagaaatcagaaacattatctattcttgtaccaaagactactgtggatgtacctggaacaccatacacagacaaggtcaaaaaaaaaaaaaaaaaaagagaaagagaaagaacacctcctgaatttgtca

SEQ ID NO: 117295 - DNA, 601 bp, Human; identical to SEQ ID NO: 59926

SEQ ID NO: 117296 - DNA, 601 bp, Human; identical to SEQ ID NO: 59927

SEQ ID NO: 117297 - DNA, 601 bp, Human; identical to SEQ ID NO: 59928

SEQ ID NO: 117298 - DNA, 601 bp, Human; identical to SEQ ID NO: 59929

SEQ ID NO: 117299 - DNA, 601 bp, Human; identical to SEQ ID NO: 59930

SEQ ID NO: 117300 - DNA, 601 bp, Human; identical to SEQ ID NO: 59931

SEQ ID NO: 117301 - DNA, 601 bp, Human; identical to SEQ ID NO: 59932

SEQ ID NO: 117302 - DNA, 601 bp, Human; identical to SEQ ID NO: 59933

SEQ ID NO: 117303 - DNA, 601 bp, Human; identical to SEQ ID NO: 59934

SEQ ID NO: 117304 - DNA, 601 bp, Human; identical to SEQ ID NO: 59935

SEQ ID NO: 117305 - DNA, 601 bp, Human; identical to SEQ ID NO: 59936

SEQ ID NO: 117306 - DNA, 601 bp, Human; identical to SEQ ID NO: 59937

SEQ ID NO: 117307 - DNA, 601 bp, Human; identical to SEQ ID NO: 59938

SEQ ID NO: 117308 - DNA, 601 bp, Human; identical to SEQ ID NO: 59939

SEQ ID NO: 117309 - DNA, 601 bp, Human; identical to SEQ ID NO: 59940

SEQ ID NO: 117310 - DNA, 601 bp, Human; identical to SEQ ID NO: 59941

SEQ ID NO: 117311 - DNA, 601 bp, Human; identical to SEQ ID NO: 59942

SEQ ID NO: 117312 - DNA, 601 bp, Human; identical to SEQ ID NO: 59943

SEQ ID NO: 117313 - DNA, 601 bp, Human; identical to SEQ ID NO: 59944

SEQ ID NO: 117314 - DNA, 601 bp, Human; identical to SEQ ID NO: 59945

SEQ ID NO: 117315 - DNA, 601 bp, Human; identical to SEQ ID NO: 59946

SEQ ID NO: 117316 - DNA, 601 bp, Human; identical to SEQ ID NO: 59947

SEQ ID NO: 117317 - DNA, 601 bp, Human; identical to SEQ ID NO: 59948

SEQ ID NO: 117318 - DNA, 601 bp, Human; identical to SEQ ID NO: 59949

SEQ ID NO: 117319 - DNA, 601 bp, Human; identical to SEQ ID NO: 59950

SEQ ID NO: 117320 - DNA, 601 bp, Human; identical to SEQ ID NO: 59951

SEQ ID NO: 117321 - DNA, 601 bp, Human; identical to SEQ ID NO: 59952

SEQ ID NO: 117322 - DNA, 601 bp, Human; identical to SEQ ID NO: 59953

SEQ ID NO: 117323 - DNA, 601 bp, Human; identical to SEQ ID NO: 59954

SEQ ID NO: 117324 - DNA, 601 bp, Human; identical to SEQ ID NO: 59955

SEQ ID NO: 117325 - DNA, 601 bp, Human; identical to SEQ ID NO: 59956

SEQ ID NO: 117326 - DNA, 601 bp, Human; identical to SEQ ID NO: 59957

SEQ ID NO: 117327 - DNA, 601 bp, Human; identical to SEQ ID NO: 59958

SEQ ID NO: 117328 - DNA, 601 bp, Human; identical to SEQ ID NO: 59959

SEQ ID NO: 117329 - DNA, 601 bp, Human; identical to SEQ ID NO: 59960

SEQ ID NO: 117330 - DNA, 601 bp, Human; identical to SEQ ID NO: 59961

SEQ ID NO: 117331 - DNA, 601 bp, Human; identical to SEQ ID NO: 59962

SEQ ID NO: 117332 - DNA, 601 bp, Human; identical to SEQ ID NO: 59963

SEQ ID NO: 117333 - DNA, 601 bp, Human; identical to SEQ ID NO: 59964

SEQ ID NO: 117334 - DNA, 601 bp, Human; identical to SEQ ID NO: 59965

SEQ ID NO: 117335 - DNA, 601 bp, Human; identical to SEQ ID NO: 59966

SEQ ID NO: 117336 - DNA, 601 bp, Human; identical to SEQ ID NO: 59967

SEQ ID NO: 117337 - DNA, 601 bp, Human; identical to SEQ ID NO: 59968

SEQ ID NO: 117338 - DNA, 601 bp, Human; identical to SEQ ID NO: 59969

SEQ ID NO: 117339 - DNA, 601 bp, Human; identical to SEQ ID NO: 59970

SEQ ID NO: 117340 - DNA, 601 bp, Human; identical to SEQ ID NO: 59971

SEQ ID NO: 117341 - DNA, 601 bp, Human; identical to SEQ ID NO: 59972

SEQ ID NO: 117342 - DNA, 601 bp, Human; identical to SEQ ID NO: 59973

SEQ ID NO: 117343 - DNA, 601 bp, Human; identical to SEQ ID NO: 59974

SEQ ID NO: 117344 - DNA, 601 bp, Human; identical to SEQ ID NO: 59975

SEQ ID NO: 117345 - DNA, 601 bp, Human; identical to SEQ ID NO: 59976

SEQ ID NO: 117346 - DNA, 601 bp, Human; identical to SEQ ID NO: 59977

SEQ ID NO: 117347 - DNA, 601 bp, Human; identical to SEQ ID NO: 59978

SEQ ID NO: 117348 - DNA, 601 bp, Human; identical to SEQ ID NO: 59979

SEQ ID NO: 117349 - DNA, 601 bp, Human; identical to SEQ ID NO: 59980

SEQ ID NO: 117350 - DNA, 601 bp, Human; identical to SEQ ID NO: 59981

SEQ ID NO: 117351 - DNA, 601 bp, Human; identical to SEQ ID NO: 59982

SEQ ID NO: 117352 - DNA, 601 bp, Human; identical to SEQ ID NO: 59983

SEQ ID NO: 117353 - DNA, 601 bp, Human; identical to SEQ ID NO: 117284

SEQ ID NO: 117354 - DNA, 601 bp, Human; identical to SEQ ID NO: 117285

SEQ ID NO: 117355 - DNA, 601 bp, Human; identical to SEQ ID NO: 117286

SEQ ID NO: 117356 - DNA, 601 bp, Human; identical to SEQ ID NO: 117287

SEQ ID NO: 117357 - DNA, 601 bp, Human; identical to SEQ ID NO: 117288

SEQ ID NO: 117358 - DNA, 601 bp, Human; identical to SEQ ID NO: 117289

SEQ ID NO: 117359 - DNA, 601 bp, Human; identical to SEQ ID NO: 117290

SEQ ID NO: 117360 - DNA, 601 bp, Human; identical to SEQ ID NO: 117291

SEQ ID NO: 117361 - DNA, 601 bp, Human; identical to SEQ ID NO: 117292

SEQ ID NO: 117362 - DNA, 601 bp, Human; identical to SEQ ID NO: 117293

SEQ ID NO: 117363 - DNA, 601 bp, Human; identical to SEQ ID NO: 117294

SEQ ID NO: 117364 - DNA, 601 bp, Human
ctcccagactctctctttttaaaattaagtattgattattataattaattctaagtaagtaaatattatttctctgcttaaaaacctaggaagatgactctctggttcacaataaagtctaccctggaggtcccgagacctgcccatctccctcttctagcctcatttctctctacacccagcagccagcctgacaccagagccacaatggccttcccaccctctccacaatacgtgtcacatttcccatgccttgctcctgctgttcccaggttgctctgctcttctcttctccccacastttctcatttctgcctgcaaatcttcactgttaaaacccaagtcaaatgatgcctcctgcctgaacagtcggaattaatcacctctcatgtacccccacaacactctatacacaatgagcactttaaaaggcctgattataaaaattatcatcagtgtgatgatagccagtgaatttatattggaagaaaggataaaaacagggctgaatgctgctaagcactgctttgctgcaccttcccaagctgctaggtgcggccaggcatgaccagactgcattctcagccaaactgagaggcag

SEQ ID NO: 117365 - DNA, 601 bp, Human
cctcatttctctctacacccagcagccagcctgacaccagagccacaatggccttcccaccctctccacaatacgtgtcacatttcccatgccttgctcctgctgttcccaggttgctctgctcttctcttctccccacactttctcatttctgcctgcaaatcttcactgttaaaacccaagtcaaatgatgcctcctgcctgaacagtcggaattaatcacctctcatgtacccccacaacactctatacacaatgagcactttaaaaggcctgattataaaaattatcatcagtgtgwtgatagccagtgaatttatattggaagaaaggataaaaacagggctgaatgctgctaagcactgctttgctgcaccttcccaagctgctaggtgcggccaggcatgaccagactgcattctcagccaaactgagaggcagactcttcaggtctagcggggagggggatatataattctctgctgtttcaccagggtgtcctgattcaacaattagacatttgctcctttccttgaagcatccctcatttctggtggtgaatagaaatcaaaacacttcctggaaaatatcagaaaatgta

SEQ ID NO: 117366 - DNA, 601 bp, Human
cctgacatggagaggtggggccgtgatcacccagggtgtcagtgtcctacccccaaaagtctgggtaaaggctggatgtgacatgggagttgccagttgtgggaaagatgcaactgattattctcttcagcacaggatcttccacctaaattcttcacataatcaaactgcatgaaattgcaccaattagagattcctttgggaaatggtggctattcatcattcacacattggtgtaatttagattcagtcaactgtttttcccttaacacacaacgagagtcaatgattttcttcttawtgcagaaccactaatgggagttttgaaaaagaatgcccacagaaaggagtagcaaaagttgcctttgagaccaggaactgagcagggagaggttgggtgaggcatgcctcagacccacaggaattagcagaacagcccagtgcactaggagatggggagaggcttacagaaaaggaggtggaagggccagacatatgagtcttcttacaaatgctgcctagagggaggagcccccagcaccctggagaacctggtataagaggtataagcaaggctggtgtgcactacagccccagaaca

SEQ ID NO: 117367 - DNA, 601 bp, Human
tcatggagagaaatcagtgagagtgtatgtgaaaaccctttgaacatcataaggcacaacgcaaatgtgaaattatttattattggcatgggaaggtcaaggatgcagtggtagctcagaagcagaaggtttcaaggtaatggggctgagctgccagagtttgctggggaaaactagacccctccttgagcaggccgagggaagcaggctgcaaaaacatcacaaccgggcaaagttctcttccttgggcctggacagaccattacaaggtactgttgagagtgaaagaatgggaccctcrgcccattgggcaccccatgggttattttctgtgctctgttctgttttgcttcatttttaattctgggtttttctcagtttatggctttaacaattatgcgtgatgctgagcctggagagctaacagcatggcatttttcaggattgatgtggtgtgttttaaccacaagccactgagcccaaagcaaatatctaaatggaatattccagagcattgctctggtggtatacatctaggagtttgaatgggttaatgatgactctctgggccttgctggagaagaattctcactctagcaac

SEQ ID NO: 117368 - DNA, 601 bp, Human
tgggtttcccattcccaagtggtacttacactggcaggaagagctccaagagccctgataggagacagcgcatgtcctagtagagaccagaatctaaagggctcagccaccaggtaagggcaagaaaaataatagcagctaggaaggcgcagctctcctggaaaacctgatttttcatctgtgtggattattcttaagaagggtgaccacacgcactggtttacctggaaccatcccagttttgccaggtcagccagccttattcatactgctctctttcaccttcaaaattgtccccatwtggacaaataatatatgaaactccatcattagccatgtcttcttactgcaggacccactgccctaagcagtgttttgttgttgttgttgttcttgtttcaggaaatgaactaaagcacttctgaaaaggagaagtcttagaagttttcttgctttaggttattaatgggaaggataaataaacaacataaaaatttaggatagaaggaagctttggttttttaaattatttcttcttccctgaaggttcaagaagaaacttaaggaatgacttgctagtggctgcagattccatcactaa

SEQ ID NO: 117369 - DNA, 601 bp, Human
tgatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggagattgagttcaaggagacccaagcactagtattggcccccaccagagaactggctcaacaggtattgatagtgtagttcaaaaaaactgcttgcgtgttgcataggtttcaggtttcacaactgtgaagaatttaaaacttagtataaattgg

SEQ ID NO: 117370 - DNA, 601 bp, Human; identical to SEQ ID NO: 117369

SEQ ID NO: 117371 - DNA, 601 bp, Human
aaagacttcctcaagcctcagggtgctaaatgccacccaggactatgtgatactgagatggaaaaatatagtggaaagaaacacaaacaactaatacttgaggaaagacatgcaagcaccaaaggtacaaaccttcctgaaacaagcaaggagagtttatcaatggaagttttcccctgcatggcataacagtgttccttttccaaagtaaccacttcagagctcaaagcaatcgttctgaagacaggcaaagagatccccaggggctggaaaagggagctgtacaacacttggaattctygggcaaaggttatgctgcgaacttgatatgcaatatgaacaaattgcatgaagcagatgacaaacagtacaaaattccaggaaaatatgtcagctgcacagacatctacccaagcccagacagcagaacagagaaaacccaaccccagcaaactgaagacataaaggagcccgaagaatccactgccacccatgaaacctactacaaataaaatactggcaagatgataaatggctccttcggcctcttgcttccaggttgtgcagactgggtgttcatctattaggttcttccataaac

SEQ ID NO: 117372 - DNA, 601 bp, Human
tccccagcctgcttctcatgggcaattgctagaatttactgaagaaaaaaagataataataaaatttaaatgttttctgttacttaaaagaaagccctatcaaagagtctttaaaatattttgcacgccaatataagtattctattaattcaagctgacatcatcctcttctcgactttcagtaattaggaaacaaatatcatatcacataaacaaattcatactttatgtaatttgatttctaagatgaaatattaaggctcttgattattttctgcttcaagtaaataatgccatataytctaaatggctatgtctgtgactcaagtatcaaagacttcctcaagcctcagggtgctaaatgccacccaggactatgtgatactgagatggaaaaatatagtggaaagaaacacaaacaactaatacttgaggaaagacatgcaagcaccaaaggtacaaaccttcctgaaacaagcaaggagagtttatcaatggaagttttcccctgcatggcataacagtgttccttttccaaagtaaccacttcagagctcaaagcaatcgttctgaagacaggcaaagagatccccaggggctg

SEQ ID NO: 117373 - DNA, 601 bp, Human
ttagtagagacagggtttcaacatgttggccaggctggtctcgaactcctgacctcaagtgaccgacccactagcctcggcctcccaaagtgctgggattacaggcgtgagccaccgcgcctggcctgtaagccacatttttaactttttgaaaaccatgagtaatcccattattgtttcctctcccaaactttgttttcaaagtttattttattttatttttgagatagagtctcgttctgttgcttaggctgaagtgtagtggcgcgatctcagctcactgcaacctccgcctcccacactcaagcagttctcctgcctcagcctcccgagtagctgggactactggcatgtgccaccatgcctggataattttgtttttctattttttcagtacagatgggagtttcacagtgttggccaggctggtcttgaactgctgacctcaggtgattatcctgcctcagcctccaaaagtgctgggattacaggtgtttttgggattacaggtgttagccaccgcacctggcctgttttcaaagtttagatttctatatatgttcctgaagtgtctccccagcctgcttctcatgggcaattg

SEQ ID NO: 117374 - DNA, 601 bp, Human
tttgtatttttagtagagacagggtttcaacatgttggccaggctggtctcgaactcctgacctcaagtgaccgacccactagcctcggcctcccaaagtgctgggattacaggcgtgagccaccgcgcctggcctgtaagccacatttttaactttttgaaaaccatgagtaatcccattattgtttcctctcccaaactttgttttcaaagtttattttattttatttttgagatagagtctcgttctgttgcttaggctgaagtgtagtggcgcgatctcagctcactgcaacctccacctcccacgctcaagcagttctcctgcctcagcctcccgagtagctgggactactggcatgtgccaccatgcctggataattttgtttttctattttttcagtacagatgggagtttcacagtgttggccaggctggtcttgaactgctgacctcaggtgattatcctgcctcagcctccaaaagtgctgggattacaggtgtttttgggattacaggtgttagccaccgcacctggcctgttttcaaagtttagatttctatatatgttcctgaagtgtctccccagcctgcttctcat

SEQ ID NO: 117375 - DNA, 601 bp, Human
gtctgtttttctaagttccagtatctacatttcttttattgaagggagaactacttgatcttaaaaaaaaaaaaagttggctgatgttacagaaatatttccaagtcacttctgaagactgtggacatttaaccctaatgcagtttctgcagtagaaaacagaatttatatacctaatttgcatacatatttgagtttgttgcatacacacatatatttgttagaaaactgtgtaacaaaataaatgaaacctgctgaaatgattatctttcaaaactgccagacgtggcagcagagtaakgacagtaagtttagcattctgttgctgtaaaacaactgaaatccactggcattttaaattttaaaaatcatttattttttagtaagtgcagttttttgttcttgatgttttctagacgtcgcattagcagtgtttagtcaaatctcaattatattttaattcctaaatacgcagttatgcaaagtaaagcttaaagtattgatcacagcctccttcctgtcatatgtagcacctgttcttctcatcgctggacctataaagtggcattaatcatcaagagtccagcagaattgggaaagt

SEQ ID NO: 117376 - DNA, 601 bp, Human
gcaatgtcactgccaattagcactgaaaaaaggcgggagatgtagcgatgctgagcaaagagcagatataatttctttctcctccaagacacatatcgacaatcagtttctgcagtgagggttacctaaaaaacacaagaccacacataaacagatgtggaagcaagaaaacttctgccacatttttagtaccccaattgttaaattaatttcacgtgctgccttttttttaggttgaaaaagcccactgacctacaatatattgcaaaaatagaaactacaaaattcgttactacatacrtaatttataatatgaataatcacaatgttctagccatcttcaatctgtctgtttttctaagttccagtatctacatttcttttattgaagggagaactacttgatcttaaaaaaaaaaaaagttggctgatgttacagaaatatttccaagtcacttctgaagactgtggacatttaaccctaatgcagtttctgcagtagaaaacagaatttatatacctaatttgcatacatatttgagtttgttgcatacacacatatatttgttagaaaactgtgtaacaaaataaatgaaacctg

SEQ ID NO: 117377 - DNA, 601 bp, Human
agactatggaacgtcaggtgagggctcggcccgcggtccccgtggtccctgcagcccgggccgggcctgaccctggtgtgtcccctgcgcaggtgctgctgagcgagcccgaggaggcggcggctctgtatcggggccttagccgccagcccgcgctgagcgccgcctgcctgggcccggaggtcaccacgcagtacggcggccaataccggacggtgcacactggtgtgtgtgcgaaggggaactggctggcgacggggtcgcgcactggggtgggaaggaagggggtgtggagggctcsctgcttgacagtgcgtaagggtatatagggagccggcctggacttggaggttacactcccacaggtccctgcacacaggtgtgtggagggggggagggggcgtgcggggcgttatcgaatggcggccatgagtgcacgagatgacggcgtaggggtagaagtcaaatctgggctcagggcgtggaccttgtagggctctccaccaacacgccatcccatacacatgccaggctgccctcaagattccagggtggatgctggggttactagggggttctctcaaagaggctgtcagctcag

SEQ ID NO: 117378 - DNA, 601 bp, Human
ccctgcacccagactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggtgctcgtggtcaatccacgaaggcccggcagggcagccctggggctcagtgtgctcccttcccatactgtgcctgtcagacctggggaggcactagcttctaggaagcagagcaggtcctatacacaggctgggcattgagtatcttgtgttctcagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggtcagcagcaacagcctgtgtcccccctggagtctgggacccttcttgagctaccaccccttgctcactcctgccctttgatcctgtttacaggcattttgggcccctggagatgctggtgtggtgttt

SEQ ID NO: 117379 - DNA, 601 bp, Human
tgtcctcaatgcagcagcggtgtgagttctgcctgtcctctcaaggagggcctagaggttgagagtgctgccatggagagctttgcactgttggggcattccaccttgagagaatgctcgtctgcaagaatgctcctccccttggctctcaactgcatgtagccaggctctgcaaggggctgggatatagtggggagttacacaatcccagaccctccccaggaagagctctgggcccctggtaaaagtcagagggacatgcctatctgaggccccttgggcatctggtccaggtcaccaraaaagagatacatcaggcttattccagttcccccatctcctggggctacctgaggcaaaaggggataggcacagggcactgtgccctaagggaactgcctgtcccctactggacctgaccattgtgttctcttgcagtatgactggtataccaaggttacctcagtggtggtagatgttgtgcctcggcagctgggaggtaaggcatacctggctgggtgggtgcagtggggcctgtagctctgctttcctgccgtctgttgcatccctgccccgttcttctttcctaggttccttctga

SEQ ID NO: 117380 - DNA, 601 bp, Human
cttctttcctaggttccttctgagggccctacctccctgctgggccagccttatgcccagcatcctcagggagcggggctgtcaccatagggagcggggctgtcaccgtagggaacagttcaatagcaaggagtggtaggaccaagctgagatcagagtggcccaagttgatgatgtattatttcctgtgctgcaggtcataattagatttttcttatttttccaatggctggttcaaaccaaaaccatgactccttcaagtgggtctcaggaagtgcactaggttggaatgtcacactcragaggctctggacccgagggcatgatattatcccatccaccatcctaaccccagcaacctttgtccagtctaagccctgaagtcagctgggtcttcaggagggtggctcttggctgagaggctcccgtctcgagtgttgatagctctgcttggatcctcctggaccatctcaaggatgagtctcttgttttctcaggccacccggtcagttccaggagttcagtggacaagggatagcctctttgtcttctctttgggttgcagggatgcagtggtgggaacctagtatgaatcccagct

SEQ ID NO: 117381 - DNA, 601 bp, Human
taggactacagtggagtgacgggggtggacctggtttgtataagtaccatgggtgccactctagtctccaggactttctctagcctagacctagtaaccactaccaggaactgctggggcccagcctctggttctgtggcatagtgataacaaggactaactcgggacttccaaggaaagggcgctgtggtcactgggtggcagcctcaaatctctgagtcccttccccttgaccccttgacagtctgtggtatagctggccccagggcctacttcacagatgtgtgaaaagagcgtcgarggggctgggaatgttgcctgactacactgtctggtccctccctgccctcagtgaactatcgtggctccacgggctttggccaggacagcatcctctccctcccaggcaatgtgggccaccaggatgtgaaggatgtccaggtagcaggggctggggcttctggacaggctgaaacatgggctgccagggggatgcctccattcagctgagcgggcagctggctgcagcatgctttgtcccaccctgcagtttgcagtggaacaggtgctccaggaggaacactttgatgcaagccatgtg

SEQ ID NO: 117382 - DNA, 601 bp, Human; identical to SEQ ID NO: 117377

SEQ ID NO: 117383 - DNA, 601 bp, Human; identical to SEQ ID NO: 117378

SEQ ID NO: 117384 - DNA, 601 bp, Human; identical to SEQ ID NO: 117379

SEQ ID NO: 117385 - DNA, 601 bp, Human; identical to SEQ ID NO: 117380

SEQ ID NO: 117386 - DNA, 601 bp, Human; identical to SEQ ID NO: 117381

SEQ ID NO: 117387 - DNA, 601 bp, Human; identical to SEQ ID NO: 48333

SEQ ID NO: 117388 - DNA, 601 bp, Human; identical to SEQ ID NO: 48334

SEQ ID NO: 117389 - DNA, 601 bp, Human
cagttgtcacataatgtaaggaagagaagggaatgttgacctttcagcctcagggcaatggcaccagggagtattatggaaactcttaaattcaacttccaggtattccttgggtggtaactagacaatgaatacatacaaggctgacatgatgggattctgtcctcaggggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtaaaaaaaaaaaatccctcactaattttccgtttgacccttatttggtcctatatgtttttatttttttcactgtaatgacgcagtccccaccccagctctggctgaggtatttggaaatttggaatggcaagtgggatacaagcagtttcctacctaatccaaactgatgaaacttaagcaagaccctgaaaaaatccttctacatttctgaagggcactagggctcccgggagacagcaaggcagtaggctgatgattctttctttacaggtattgcttttcccaccagcatttcggtaa

SEQ ID NO: 117390 - DNA, 601 bp, Human; identical to SEQ ID NO: 117389

SEQ ID NO: 117391 - DNA, 601 bp, Human
gcctcagcctcctgagtagctgggattacaggcgcccaccaccacacccggctaatttttgtatttttaatagagatggggtttcgccatgttggccaggctggtctcaaactcctgacctcaggtgatccacccacctcggcctcccaaaatgctgggattacaggcgtgagccatcgtgcctggtcatgaatagcacttttaaaagccaaatgctacacaagttggtaggcagtgtggtggaaagagcatgggcttggagtcacataggcctggatttgaatatcaactgtgtcccttsggtaagttctttaacttctctgaaactcagtttcctcacatgaaatgaagctggcaaaacccaccactcagcatggttgtaaggatgagatgagagaattaatgaagagcacccatcaagctctggaatgtaggagatgcttcacaaacactgtttatggctattattggttgtttttttttttttttttttgagacggagtcttgctcgtcacccaggctggagggcagtgacgcaatctcggctcactgcaagctccatctcccaggttcacgccattttcctgcctcagcctcctga

SEQ ID NO: 117392 - DNA, 601 bp, Human
caggaggctgaggcaggagaattgcttgagcctgggaggcagaggttgcagtgagctgagatcgtgccactgcactccagcctgggcaacagggcgagactctgtctcaaaaaaaaaacaaaaattaaccaggcatgggtggcgctcgcctgtaatcccagctactcagtaggctgaggcaggagaattgcttgagcctgggaggcagaggttgcagtgagctgaaattgcaccactgcactccagcccgggcaatgagagtgagactgtctcaaaaaaaaaaaaaaaaaaaaaaaaaaawttctatccccagccaagtgccatggctcattcctacaatcccggcaatttgggaggccaaggcaggagactgcttgaggccaggagttcaagaccagcctgggcaacacagtgataccccatccctacaaaaaatttaaaaaattagctgagtgtgattgagtgtgatggcgtgtgcctgtagtctcagctacttgggaggctgaggcaggagcattgcttcaacccctaggtcaaggctgcagtgagtcatgattataccactgcactccagcctggataacagagaccctgtctcaaa

SEQ ID NO: 117393 - DNA, 601 bp, Human
ctccccagctgcacctgatggtcctgggcagaatgagctgtccttccccagaaggacattcctggggggccacagagagaattctgggtccctgaatactctgcgggctgggggaagctgtgggacggggacatggactgctcacgtgtgccttttgaccacccctcctgtcctcacagcagtggaagtggaccacacagctgtccctgtcccgtgtaggccagctgggctgctcccactgccatgtggtcacaccttgctattccactcactgctcccctctgtgagcctgggttggccstggccacacagtcctatctgcgtggggagggcccggcacctctgtgcagaagctgagcaaggaggccctggagggagggtagggaagggtgctgcgggcgggggtgcgggggatgccctgagcaggggcaacaggcagcggtgagaggcaagtgccagggaggactgctccacacgcccctggctgtgaccccaaggagtcgagtttggactggaaggcagaggaggggggtgctgcccgagctgagggccccttagctgtggaccctggacgtgatgcatgcctggtgggcagtgggct

SEQ ID NO: 117394 - DNA, 601 bp, Human
caccctatcccctccccaacccccagcggagaaacagagggctgcagcaggaccccaggcccctgcaccaattccggaggcagcagctggaagctgggttcctcctgccctcctcccccaccccaagggccagcccagatgttgagcggcttttgctcagacagcaccggtgcccccgccctgcaagcacacactcagcccttaagccagctgagccgccaaccctgggctgggtgacgtcaccggcagccaatgggatcgcactctgccgggagtccttgctgggggtcattaatcaccrgattccccttgttggaaaccaaagggagccgattctggccttggggcgggcggactcctggccagtggccatcccacttgagtcctcccatgtcccagctctgaacagggcctatcagtgacccagacccctctcaaagcctccagggccaagagcttgtcacccttgtcccctgcgaggcagtagaaggaggaggtgccgccaccttcacaggtcaacagccccgctggtccctccccagctgcacctgatggtcctgggcagaatgagctgtccttccccagaaggacattcctgggg

SEQ ID NO: 117395 - DNA, 601 bp, Human
gatccccccgtgcccagcggacacctccctgatgccccagccccagccccagccccactgctggcggagcaagtgcctcggggaggcgtgggtcatggactcaccagtgaggatggccacgctgtcgaagcagccgtccagcttgctcagcaggatggagaggaagctgtctgcggccagcacgctggcgtcccgcgtgctctggtcatagaccaccacgtcctgtggctccgtagcctccacctgggggccatggggcagagatcagcatgccgcctccacctatcgatgccctggcccygtcccagatatgctggctcaagggaatagtaagggcatcagatgatgggaggcaggcagctgtcaccttgctgcctggaggggagggcaggtgcagtcacacactctcctccatctgccagaggcccagatgcacacacccacaccacacagcaagccatgggggcagggaggggtggactcctgccctgcgcagctgtgcccccatgccatgcacatgggtgaaggggacggacgctctgggccaggcctgtgtggaggagacacaggtgagtgcgatgggagcccaggataggacctg

SEQ ID NO: 117396 - DNA, 601 bp, Human
acatgcacacacacacatacatgcacacacatgctcacgtacacactcgcagaggcagatgctggtcaccagacgcccagagccatgcacagacgcacagacaccctctgaccatggccacccagcagtgcagggtgctggtctcacccacagagaggtggggagggagcctggcctcaatgctcttgcccaggacactggaccaccctcaagcctcccaggtgccctttaggtcccaggacatgccatgtcgggaggtcggcctggccaaagcggctgccaccccttcatcccccacagycgccctcaggctgggtgaaggtccctgcttccactggatgcagggccaagggcctggcttggctgcctactcctcaccccaccgtgcctgcaccccacagtcccccatatcctctgcttgcctggaacagcccctggtagcagaggccaggcagaaggagcctggacaaagaccccagacctggatgggggagggtgcacatccctgggacaggccagctccgtccggctctgggacctgggccgaccccaggaggtggattctacagacacgccctcagccacagcccaaggaaagaaa

SEQ ID NO: 117397 - DNA, 601 bp, Human
tatgcgcacacacaggcatgcatatgcccatacatgcacacatgtacatgcacacacatacatgcatgcacatgcacacacacacatacatgcacacacatgctcacgtacacactcgcagaggcagatgctggtcaccagacgcccagagccatgcacagacgcacagacaccctctgaccatggccacccagcagtgcagggtgctggtctcacccacagagaggtggggagggagcctggcctcaatgctcttgcccaggacactggaccaccctcaagcctcccaggtgccctttaggtcccaggacatgccatgtcgggaggtcggcctggccaaagcggctgccaccccttcatcccccacagccgccctcaggctgggtgaaggtccctgcttccactggatgcagggccaagggcctggcttggctgcctactcctcaccccaccgtgcctgcaccccacagtcccccatatcctctgcttgcctggaacagcccctggtagcagaggccaggcagaaggagcctggacaaagaccccagacctggatgggggagggtgcacatccctgggacaggccagctccgtccggctc

SEQ ID NO: 117398 - DNA, 601 bp, Human
aagccccaaactactctctccccgccccccaccagttcagtcctcaaactggacctaggggaacagggttggatcagagtgcgtcattctgtggcttctggttctgagagttcacacatatgcacacaaatcccaaatctcacccagacaagcacaggcgggtacatacacaaatatacctccatgtatatacatgcatatacacgtgcacacacgtacatgcacatatgcgcacacacaggcatgcatatgcccatacatgcacacatgtacatgcacacacatacatgcatgcacatgaacacacacacatacatgcacacacatgctcacgtacacactcgcagaggcagatgctggtcaccagacgcccagagccatgcacagacgcacagacaccctctgaccatggccacccagcagtgcagggtgctggtctcacccacagagaggtggggagggagcctggcctcaatgctcttgcccaggacactggaccaccctcaagcctcccaggtgccctttaggtcccaggacatgccatgtcgggaggtcggcctggccaaagcggctgccaccccttcatcccccacagccgccc

SEQ ID NO: 117399 - DNA, 601 bp, Human
gctgtaaaaagccccaaactactctctccccgccccccaccagttcagtcctcaaactggacctaggggaacagggttggatcagagtgcgtcattctgtggcttctggttctgagagttcacacatatgcacacaaatcccaaatctcacccagacaagcacaggcgggtacatacacaaatatacctccatgtatatacatgcatatacacgtgcacacacgtacatgcacatatgcgcacacacaggcatgcatatgcccatacatgcacacatgtacatgcacacacatacatgcaygcacatgcacacacacacatacatgcacacacatgctcacgtacacactcgcagaggcagatgctggtcaccagacgcccagagccatgcacagacgcacagacaccctctgaccatggccacccagcagtgcagggtgctggtctcacccacagagaggtggggagggagcctggcctcaatgctcttgcccaggacactggaccaccctcaagcctcccaggtgccctttaggtcccaggacatgccatgtcgggaggtcggcctggccaaagcggctgccaccccttcatcccccac

SEQ ID NO: 117400 - DNA, 601 bp, Human
cctcaaccttgcagggcagatgtcagcacagaaaggcagttctgagggtggcatgaccaggccctgggagtgccctcctggcaaatcctagcacaggcccggcccctcccatgcccatactcatccacgcccacctgcacacccatgctgtcccacccaccagtgctgggtgagggccccagccccccaaaccgtcccactctggcctcgagggagacaggcccttccaggcttgggactttcctgggatctgcctgcaggtagggaggtgccactctgggacctttctcagcctccaagwagagtctcctgactcccattcctggctagggcagcaaactggcctttgggaggggtcctgttacacctggtgagctgtaaaaagccccaaactactctctccccgccccccaccagttcagtcctcaaactggacctaggggaacagggttggatcagagtgcgtcattctgtggcttctggttctgagagttcacacatatgcacacaaatcccaaatctcacccagacaagcacaggcgggtacatacacaaatatacctccatgtatatacatgcatatacacgtgcacacacgtac

SEQ ID NO: 117401 - DNA, 601 bp, Human
tgccccccccaatatattctttcccactctccctggttcttcgcagagccagcccagagcaggggctgtgcccaccacagggtgggagggagcctgagggcagagcccgtgggcctgcctgggtgtcgccatgagcccactgtataccacggggcctgggactccttggcagctgcacttctggagaaaaggggacacagcctcaaccttgcagggcagatgtcagcacagaaaggcagttctgagggtggcatgaccaggccctgggagtgccctcctggcaaatcctagcacaggccckgcccctcccatgcccatactcatccacgcccacctgcacacccatgctgtcccacccaccagtgctgggtgagggccccagccccccaaaccgtcccactctggcctcgagggagacaggcccttccaggcttgggactttcctgggatctgcctgcaggtagggaggtgccactctgggacctttctcagcctccaagaagagtctcctgactcccattcctggctagggcagcaaactggcctttgggaggggtcctgttacacctggtgagctgtaaaaagccccaaactactctct

SEQ ID NO: 117402 - DNA, 601 bp, Human
gactccccgccagggcgggggccgccaccccacccacttgcagtgcagtcgcccggccaagggtccaaggccgactgcgggccgctgcttaaagggccaggcccctctctcatcccttgccgcttgccccccaacatcgtgagcagcgcagctggagtgggggaagaggagcggcagggggaggtgggcttcacagcagtcctgggaccccagcacagcctgtcctgccactgtttctctcccgcttcccgcaaacctgccctgctgtggggaggacagaggcttggtcctcacattccgrcctctactgtccctgcaaatggaccaaggagctgtgttgcctgtgccgcgggatcctggaacatcccttctcctgggtgaggggcagcacccctgccccccccaatatattctttcccactctccctggttcttcgcagagccagcccagagcaggggctgtgcccaccacagggtgggagggagcctgagggcagagcccgtgggcctgcctgggtgtcgccatgagcccactgtataccacggggcctgggactccttggcagctgcacttctggagaaaaggggacacagcctcaac

SEQ ID NO: 117403 - DNA, 601 bp, Human
caggctgggccttcctcctcccctgcactgatgcaatgcctccctgcctccagctggctgggagccccaggcctgggcttgggtgccaggaccaggaggccagggcttccgagaggccctccccgtccccaggcatgacatcaccctggcacagccctcggggcatttgctgtctggttatggctgtactccacccagcaggggaggacggagagtggagaagcccggggcactgggggcacgcagagcaggcagtgggcacccgctgcacacgtgaccagcgtgtgctgctgccttccayacacgtccaagtccgaggccacaggctggtgggaggaagtcccctgccctgcaccagctggaaggacccgaacgtgaatccctggatgtctgactcagtgaccatgggtagtgcacaccatggctctggtctcagcttcctcctcctgcctgccacacagcatcatgtggttccaagaagataatgagcacgaagacacatggtgagaatggacctggccgtccctgacctggctggggcgaccaccgatgtggaccagaaactgggcagcacccacctggtggctgccagctcttggga

SEQ ID NO: 117404 - DNA, 601 bp, Human
tgaaactgaggacgagaagcaaggggaaagagaaggtcccaagaacactgtggtaagcagggattgacagagaaatatctccctaaggagggcaatggcccctgacctattagaataataatacctgccccctaattttaaattgtttcatgtgtcataatgtccttttgttattgcagatccttgtgcatacaactgacttgtgtgggtgaggcttgcagaaaaaatcagctagaacagccttgggggtagtggcaaggtggccagagcaattgactgggagctgggaacaggaatgaaraggaagagctgataagaaacatgcccagagcaggtaagcacctctatccctccaatcttcaaaagcatgccgggcgggcggatcacacattaagttggaatgtaaacagaagtaaaggagtatgaagaacactatagcaaggaggaaaaaaagccacacattttgtgccagacagacttagtttgaaatcctatttatagattttgtttcattaggcaatttatttcattctctgagcttcaggggaatcttagtcattgcagttctattacttaacaaagtctttaacagttttccact

SEQ ID NO: 117405 - DNA, 601 bp, Human
caatttgatctgaagactcttccagctttgcatgatagatgcattgtcatgtcttatgttttgtaaacagccacacttcaccactatttagataaaatgtgactaagtcaaccttagtttccagacaaccctggatagtttttactttatcttgtatttggactggcgttgggacctctttagctgagaattcccctcccctctgtgagccattagctgagaagcaccattgtcagaaattctgaggatgacctgtcacccccacagccttgccctttctgacttttcagccacccgcccaccatccccatctggttgaggccttggtcagtgtgggagaacaggaggaatctacttagctgagtcatgacccaggtctagcttatggtataaaaccaattaaagcccctttatctgtggcctgatccatcacatgggggtattgagggaggtgaaattccagcctcatttctcttggcagcttctgtgaaggggtagggttcccggtggtcatggaaaaataaagcacacagaaaagggggctgattgctttcacttcattcctgctgcctcccccagaaatgttctctggccaaaccaa

SEQ ID NO: 117406 - DNA, 601 bp, Human
aacaatttccacagaggaggtagaagaggagagatagagctgagactcaactctgattgcctgtatccagttttttctttccacaaatgaccaaaaagtaccaaaaaacaaagaaactatgagaaaaatgctttctaatagttgtttactattatgattataactactagaaaatataaagcccacataagattttatgtctccaaattcaagaaaatcaccaaagggcaaggcatagagtagcagacaataggctgcatcctcacctggatcccggaagggcttggccatcctcattgaygctatggcagcactgatacctgccaactactctcaagggacaggacagcatggtggttcagagatcaggctctggagccagattgtccaggcttcaatctcagcaccccacctatttctatggggtctggtacatgttaatctctctataccacagtttctccatctttaaactggtggtagtaattagacctgactcacagaattttgtaagttaatagtatgtaaaagattaaatggcccagatacagtggctcatgcctgtaacctcaacactttgggaggctaaggcaggaggact

SEQ ID NO: 117407 - DNA, 601 bp, Human
cttgagtgacagagaacctgtctcaaaaaaaaaaaaaaaaaattaaaagatcaatcagtgttatctactatgtgccagttatttaccatgacaccatcagattctttatctttcattctcataagaactaatttaggtattattatctctattttatctatgaaatacctggggctacaaggttagatatttttcccagtgggagttctgggttttggatcacaattattgtgaatttaaaattctatatacgtcatctcttacaataacaaaatactcaattaattttcttttcatggakcctggaaacagccctcctttgggaccttactgaaggcttagatacatggcttagacaatctgtggaggtccaagcggcaagcttgataaactgggatttcctgagctcttgtcagcttctcaagtcagagttaatgctgaaagttctacatggggcatgggtgtagcttagataaatacccagaggcttgggaggtagagtgaaaatattttgagctggcaagtctgttcaattaatatgtacttgggagacattttcaaagctgacagatcttttgtaagtgccaagtgatattaatta

SEQ ID NO: 117408 - DNA, 601 bp, Human
tctgtggaggtccaagcggcaagcttgataaactgggatttcctgagctcttgtcagcttctcaagtcagagttaatgctgaaagttctacatggggcatgggtgtagcttagataaatacccagaggcttgggaggtagagtgaaaatattttgagctggcaagtctgttcaattaatatgtacttgggagacattttcaaagctgacagatcttttgtaagtgccaagtgatattaattattagtataaaagcagatcccaccagtggagtcagagacacccaaatttatgtgtgttcrggtgtatcatcgggttgtgaggttgaggatgccaacgcttctagctgtgagggcaaaatttagcaaatgagtgtaccctaggaatgaggcaagaagagtctgaacctcttctttgtgtagtgcagaaatctggtcttgtaggaaagagttgctctcagtcttgccagagtcctgctcagaaggtaaaagtctagtgggctgcccaaagggaaggtgtgcaatatatagccttatagcctgggttgaatcaggcaaaacaagagaaatatggctaatgttttaccagaggataaagcaggg

SEQ ID NO: 117409 - DNA, 601 bp, Human
ctctatcatcctcaatactaggtattttcatttttttaaaaaaggcttggccaggaggctcatgcctataattctagcactttgggaggccaaggcaggcaggtcacttgaggtcaggagtttgagaccagcctggccaacatggtgaaaccctgtctctactaaaaatacaaaaattagctggaaattgcttgaacctgggaagtggaggttgcagtgagtggagatcgtgccattgcactccagcctgggcgacagagtgagactccgtctcaaaaaaaaaaaaaaacaaaaaaaaaamaaaaaaaaaaacaggaaagcatctgtactttaattttgcatatggaaaatggaaaacattaaccaaagtgttaattttctttttctcactgaagtccacaaagcaagaaattgacaaatttggggttactacatggaacttgtaaaatcaaatcatattaatatatttggtgtggagagtctctgcaacaggaggatggtgtgtgtgggggagagtacctacagtggagggagaggttggagagtgtgtcacaaggattgtggtggaaaagatcgtttggctgcttcatgattgaatggg

SEQ ID NO: 117410 - DNA, 601 bp, Human
aaaaaaaaaaaaaaacaaaaaaaaaacaaaaaaaaaaacaggaaagcatctgtactttaattttgcatatggaaaatggaaaacattaaccaaagtgttaattttctttttctcactgaagtccacaaagcaagaaattgacaaatttggggttactacatggaacttgtaaaatcaaatcatattaatatatttggtgtggagagtctctgcaacaggaggatggtgtgtgtgggggagagtacctacagtggagggagaggttggagagtgtgtcacaaggattgtggtggaaaagatygtttggctgcttcatgattgaatgggcatgcggctgatcaaggtaatcccagcagatgagctgcttgggatccttcattaccaatggcccacctaaggtgaatcttctaggatgttatatgacctatgtaggataacccttgcaagagaaatatgttggcttaaatttatgtgtcccttccctctactgtatatcttcccaataggacccaggcatcagaaaaaagaaaactcattggagattttaggctgaactctttggactcttcaaggatgggagaactgttgactcacttgtcaa

SEQ ID NO: 117411 - DNA, 601 bp, Human
cttcattaccaatggcccacctaaggtgaatcttctaggatgttatatgacctatgtaggataacccttgcaagagaaatatgttggcttaaatttatgtgtcccttccctctactgtatatcttcccaataggacccaggcatcagaaaaaagaaaactcattggagattttaggctgaactctttggactcttcaaggatgggagaactgttgactcacttgtcaagattctcttttgttttctgattttttctatgaccagccatacactagccaaagaggtgaactaatagagtacwctctttggagacacacatctgatttgaatcctagctcaaccctatagtggctgtgtagactcagacctagtctctctaagcccatttgttttaatgtaaaataggcacaataacgtctccctcttaaggtgtttgtaagaattcaatcatcacatgtctggagagtgtctaggcaaatgggaggtattatgtgtccaactccaggacattgctcataaacctgtgatttagctcatagagcactgggcacctaaggagatcaaaagatctggattgcactgactacatcaggtggccaag

SEQ ID NO: 117412 - DNA, 601 bp, Human
aggcacaataacgtctccctcttaaggtgtttgtaagaattcaatcatcacatgtctggagagtgtctaggcaaatgggaggtattatgtgtccaactccaggacattgctcataaacctgtgatttagctcatagagcactgggcacctaaggagatcaaaagatctggattgcactgactacatcaggtggccaaggattggttggattagtggggcctctcaaatcacatttcacagggaacaatcctatggagagtgattaggaattaggttcaccaatctattttgagaggatttkgtttggtccagccaatattttgaagtactcacaatgccaggttctttgcttcgttcttgaaatatagatatgaaccaggaattaattctggtgccaaggaacttcacactgtagagatggatatgagcaattaccaaaaaatattctaaatattatctgataaagtttttaatggaggaaatcataggatgttaccaaggcaaagaggaaaaaatccctaacttagatcattgggattagggatggtttctcctaggggacaaaagagcttaagtcttcttgatgaaggtgtggtatata

SEQ ID NO: 117413 - DNA, 601 bp, Human
tgttacttcttacaacctacaaacagcattaattacactgaaatctccaggctggaccaagaagaggatccccttacaccacacataagtgcatttgcctggagtgaaacagcacaggtcttcctctcactgcaaggctgtgatcaattcttggctcccaaacccaaaagggatgtggaaatctggtgggaactgtaaaggcctggaatataagacttatgtgcacagatgaaaggcagcaggcttgttcagctgggaggaactgtaggatggcttaattataacctcctggtctatagcragttcttagatcactgatgaggtaaacccgctgctggatcccaagctgggagctacagcaaggactcaaacctatttatcttttatttttctatggtgtttgggatgcagctctgaataaagtggtggctgaggaaactgattcagcaactgcatttccagatccttttacagcagaaagagcttaactttggggtaattcaaacctgagtttgaattccaattacacaaattacaaactgtaactttggatatttcaactgcgtacattgtaattttcttaactataaaataaggttaa

SEQ ID NO: 117414 - DNA, 601 bp, Human
aaagtattacagataacatggaagctcttatccctaatatcattcccccttctctaaaggcaatcaccaatatgaattttattgtgtatcattgcagcccccattttctatgtttattatgagatatatccactaataatacatatggttgctatttcttacctatttacagaactatttcatactacagtttttaacaacttgtttcccctttgttactcaagattgcatttttgatatccattcatgtctttacacatagatctaattaattcattttgatttttgttattgtaaattscatgaatatattacaatttatttactcattctttctccactgaaggacataaagattgtttccaatttttcttcattgtaaacagacactgctataatgaacattctggtttatgtgcaggcatttctctgaagtagaatgagaagtcattgggcatgcacattttaacaatttcacgatctacagtcaaattgctctccaaagtgattgtactaatttagactcccaccagcagggtaggaaagttcagttttctcatgtctttaccaacagttgctattgacagactctttaatgctt

SEQ ID NO: 117415 - DNA, 601 bp, Human
tgttttaatttgcatttcctttatttctagtgaggataataatctattcatatgttcactggctcttctgaattgcctgttcccatcaattgccaacttctgtgttatattgttggttcgtttaaactgatacataatttctctacctattcaagataatctgtgtttgttttacacgtgtgtttgttttacacgttacagacatattttctaagcctgccatttttttaagtatgtttcatggtgtgcttcgtaatggggaaaatcttaattttgatgcacttggttttatcaatgctttcctataaattgctagtgtttgagagttttctaagaaatttgatttttatctcttagtcaaaaattgttatcctacattctcttctaattaaaaaatcccatttgcagttttatttagttatttttgtctataaagtgagttccgaatgggaaaccaggtcatttactgcacttttttccttcccactgatttataatgccacctctgtcatacaccaggctcatatgtgtttcagcttatttaagggcttcaaattttatttcattaacttgactttttctctgctccaatatcattctt

SEQ ID NO: 117416 - DNA, 601 bp, Human
tcttctgaccattctattaggttggtgcaaaagtaattgcagtttttaccaatttcaatctaataatctattagtctataataatttcaatctatagtctattagatgactactattatctactagattattccacctactatttttattgtacatgctagagcttaagaaaatttttcatcttagactatgctctaattatatcacctgtgtgcatttttcccattgtaaaacaaattgtttttctttttgatatatattggctggtgccaattgttctctcagagaagtaaatgggatytttaaggaaaaaaatatctaggtttcccacatttaacttactaatcttagcaatggctaatagggaaattcccagatgaatcaaggaaatatctcaccttccacaacaataatttattaattataattaatcagattggtagctaactgtgtgttgggcactgggctaagtactttatttatatacatgatgttatgtatttgcaaaaatcatatggtataagcagtgctagtctcagtttagagataataaaatttggattaatggggtttaagttacttgctcaagtgtgcataggtg

SEQ ID NO: 117417 - DNA, 601 bp, Human
tgttctgtcttatttatgttttattttttcttcttacactgcgtccaagaaacacctcctcatgctttggtgtcttctttcttctttttcctcttgtctgtgtttagtttcctcgttttctagttagtcctataattcttactgatccttctttacttttacattagaaaaaaggagggtttaaaaagcgttttttaaatgaaagaaaataaattgtccttcattggactattgttcctccaagctaggaagttgatgcttgattctctgataccccgggggcctgggtggtgttttaagstgggagaagatgggcactctcctgaactgccttagatgcttccttatcctgggcctctctgacaggcaacatgcctcaactttgtcaacaagttgtggtttgtttcactggccaagcataagacagagcatgaaggccgagctgcgtgcctggtgctgcatgtttcctgtttctgtaagctatttgttgtcaactctcttttttcctttatgatatttaattgaaatcacagcttaatgaggcctgaccagtatttttcctttggtcacagatttgatgctactgccaatgtacctgaat

SEQ ID NO: 117418 - DNA, 601 bp, Human
tttatgttttattttttcttcttacactgcgtccaagaaacacctcctcatgctttggtgtcttctttcttctttttcctcttgtctgtgtttagtttcctcgttttctagttagtcctataattcttactgatccttctttacttttacattagaaaaaaggagggtttaaaaagcgttttttaaatgaaagaaaataaattgtccttcattggactattgttcctccaagctaggaagttgatgcttgattctctgataccccgggggcctgggtggtgttttaagctgggagaagatsggcactctcctgaactgccttagatgcttccttatcctgggcctctctgacaggcaacatgcctcaactttgtcaacaagttgtggtttgtttcactggccaagcataagacagagcatgaaggccgagctgcgtgcctggtgctgcatgtttcctgtttctgtaagctatttgttgtcaactctcttttttcctttatgatatttaattgaaatcacagcttaatgaggcctgaccagtatttttcctttggtcacagatttgatgctactgccaatgtacctgaataagaagacaact

SEQ ID NO: 117419 - DNA, 601 bp, Human
acctcctcatgctttggtgtcttctttcttctttttcctcttgtctgtgtttagtttcctcgttttctagttagtcctataattcttactgatccttctttacttttacattagaaaaaaggagggtttaaaaagcgttttttaaatgaaagaaaataaattgtccttcattggactattgttcctccaagctaggaagttgatgcttgattctctgataccccgggggcctgggtggtgttttaagctgggagaagatgggcactctcctgaactgccttagatgcttccttatcctggrcctctctgacaggcaacatgcctcaactttgtcaacaagttgtggtttgtttcactggccaagcataagacagagcatgaaggccgagctgcgtgcctggtgctgcatgtttcctgtttctgtaagctatttgttgtcaactctcttttttcctttatgatatttaattgaaatcacagcttaatgaggcctgaccagtatttttcctttggtcacagatttgatgctactgccaatgtacctgaataagaagacaactctttctggaaaaagggaaaacttgaagggctattgaaggcc

SEQ ID NO: 117420 - DNA, 601 bp, Human
gccagttgaagttcaggttttgtgacctcacctaaaatttgctcctggggcttggaaagtttaaaattgtgcttttttattttccccttcttttttttagcacagttcagatgccatgtccctaggaatttttccttaattcccaaattgcaataatatatccatcatctgcacatctacattacttgtatttaaactgtttcatggcattaaccatgttttaccctgatgcaatgagatacaatgcagttagatgagagaatatgagtactggagctggacaggaatggatgtgaagccygtggcagttatttactgggtgatcttaacatctcaatattttcttcttcataaaatgataatattaaaaataatagactgttaatatgacctaccttatcttgttgttgggataatttaaggaaattacacattgtattagtctgttctcatactgctgatgaagacataccaaagactgggtaatttataaaggaaagaggtttaattgactcacagttccacatggctagggaggcctcacaatcacggtggaaggcaaaggagaagcaaggacatttcttacatggtgacaggcaag

SEQ ID NO: 117421 - DNA, 601 bp, Human
ttaaaaaatatcgtacattatcttcgggccttattttttaacctgcctatggaacgtggctctaaacctttgcactgaggctagcttcagtgaaattttgaaggagttaatgccttcctctttttgatacaagattaaacatggattgcaactagaaaccacaaagctgagtgtttattaaatatactaattttcctttcatccagttggccaatgttttcaaccataatctacttttctctaaatttttccatggagcaggatgatgattccaaatcctaaaattctgaaaaaaaaaaaatcacttaatgaccactggtgaactcctgtaaactcatcccagaatcagtaatgagtatttggaaaagattcatgggtaagctccaattctcaccaaaatggccctttgagtagcaatcaaggattctctgagggaactgggaagttccagatggcttttaagggaggctatttggtttagtttaatagaacttggtgctattaaggccaatggttggagtcctttgtcctattctagtatatatatacatatacatacgtacatacatatatactccttactctattaatgtatttagaa

SEQ ID NO: 117422 - DNA, 601 bp, Human
tattctagtatatatatacatatacatacgtacatacatatatactccttactctattaatgtatttagaaagtaaatagtataggttataaataggcagaaaaaaaaacagtgggaatggcttagtgtgaaccattaactctatatattcattcaacatgaatttgctaaaagcccattaggtactagtctctggagacacatggtcaacttgaacaagaattggctttgaggaaataatggactaagggggatatataaacagataattgtgatgtgtgttttttgtttttttttttttaattatactttaagttttagggtacatgtgcacatcgtgcaggttagttacatatgtatacatgtgccatgctggtgcactgcacccactaactcatcatctagcattaggtatatctcccgatgctatccctcccccttccccccaccccacaacagtccccagagtgtgatattccccttcctgtgtccatgtgacctcattgttcaattcccacctatgagtgagaatatgcggtgtttggttttttgttcttgcgatagtttactgagaatgatgatttccaatttcatccatgtc

SEQ ID NO: 117423 - DNA, 601 bp, Human
caaacagcatcaggtttgaaagaattgtctccaattttgaaggaagttatactgtgagcaatatgctatcaaacagcatcacatgccaaagagaaatattttgtgaaaggaagagtcaatcaacatagcaaacttcattgttatcttaagtaatttccatagccaccaaaccttcagcaaccaccaccctcaccagtcagcagccatcaatactggggcagaatctccactggcaaaaagattaggacttgctgaaggcttagatgaccattagcatttttaaacaagaaagcatttttttagttaagctatgtgcatttttagatttgaaagacatttctcaaaagaagacatacaagtggcaagcaggcatatgaaaagatgctacacatcatccatcatcagataaatgcaaatcaaaactacaaggagatatcatctcacaccagttagaatggcttatatccaaaacacaggcaataacaaatgctgatgaggaagtggagaaaagaggacagtcaatgggaatgtaaattagcacaactatggagtacagtttagaggtttcacaaaaaactaaaaatgagctaccatatgatcc

SEQ ID NO: 117424 - DNA, 601 bp, Human
gcatttttagatttgaaagacatttctcaaaagaagacatacaagtggcaagcaggcatatgaaaagatgctacacatcatccatcatcagataaatgcaaatcaaaactacaaggagatatcatctcacaccagttagaatggcttatatccaaaacacaggcaataacaaatgctgatgaggaagtggagaaaagaggacagtcaatgggaatgtaaattagcacaactatggagtacagtttagaggtttcacaaaaaactaaaaatgagctaccatatgatccagcaatcccactgatgagtatatattgaaaagaaggtatatcagtatattgaagagatatctgcactcttatgtttgttgcagcactgtttacagcaactaagatttggaagcaacctaagtgttcaacagatgaatggttaaagaaaatgcggtacatacagacaatggagtactactcagccataaaaaaaatgatatccagtcatttgcagcaacgtggatggaactggagaccattatgttaagtgaaataaaccaggcacagaaagacaaacatcgcatgttctcccttatttgtgggatccaaacaac

SEQ ID NO: 117425 - DNA, 601 bp, Human
acagaaagacaaacatcgcatgttctcccttatttgtgggatccaaacaacaaaacaattgaactcatgctcatagagaggagaaggatggttaccagaggctgggaaaggtagtgggaaggtggaaagggaggtggggatcggtaatgtataaaaaaatactggaaagagtgaataagacctactatttgatagtacaatggatgattatagtcaataataacctaattgtatattttcaaataacataaagagtgtaattggattgtttgtaactcaaaggataaatgcttgaggggayagatacaccattctccatgatgtgtttatttcacatttcatgactgtattaaaacattttatgtaccccataaatatatatacctactacatacccacaaaaattaaacattaaaaaaagatatgtacatttttaagacacaatgctatgcacttaatagtccacagtatagtgtaaaagtaacttttatatttactgggagagcaaaaaaaattgtgtgacttgctttattggtatacttgctgtatttcagtggtgtgtaatcaaacccataatatctcagaggtttgcctgtacact

SEQ ID NO: 117426 - DNA, 601 bp, Human
gatcacaaggtcaagagatcaagaccgtcctggccaacgtggtgaaaccctatctctactaaaaatacaaaaattagctgggcgtggtggtgcatgcctgtagtcccagctactcaggaggctgaggcaggagaatcgcttgaacctgggaggcagaggttgcagtgagatgagattccgccactgcactccagcctgggtgacagagtgagactctgtctcaaaaaaaaaaaaaaaaaaaaaaagttttccaatgcctcaagaaactcctaatggtattctcaacttataaagaaggacyaatctctagaactatagacttctgaaaaggaaaatgaaagaacaatctttcttccttctttcttctctcttttcctttttcttactcttctttctgtcctttcctttcttctctccctccttcccttcctttctggtatacttcctttctcccttccttcctcctttcttcttttattcatttttctttatttcctctctctttttgaacttttctactcatttcttttctacctttatgtagtgaaaatgcaaatttgctcacatcacaattcagacatgcaataaaaatgtagcctgc

SEQ ID NO: 117427 - DNA, 601 bp, Human
ttttactaacctttggcccaaaagaagcagattttgttttcctctctggtctagatgaaacatctccctaaatcattcatacttcatgaagtagcatctacgtaaatcatactgatacatcatgaagtagcaactaccttcccatttcctcctattgtctttatttagaatgtagtgctaggagaaataaaaatgtcttactatcaaggaacttaaatttagaagtagttagaaatatattatcacttctgtttctggctattagaaagtagtggtggctagaattattcccttatcatamatgctagaagactggacaaaagatagaaaacaaacatttttaatcattggctaatatgcagtaggactgtggttcctgtaaaaagggaaacaaatgaagtaagccctggaatcacgcaggctttctactgggaggcaatttctagaatgcttcatagggaagggcagctcaaggattaagagtaatcttgctgagtagctaagacagagattgcagtttatgaggccaaagtggttaaaatgtatatagttaagagagtacctgagaggagtgaacttaacaaagaacaagtaccagaaa

SEQ ID NO: 117428 - DNA, 601 bp, Human
acaaaaagctgagaatatttgttactagcaaacctatgctataagtaatgtgacaggctggatacagtggttcgtgcctataatcccagtactttgggaggttgaggtgagaagatcacttgagcccaggagtttgagatcagactgggcaacatagtgagaccctgtttctaaaataaggaaagtaagaaagaatgaaaggaagaaaagaaagaaatgttataggaagttctttaggcctaaggaaaatgagccccaactactggtattcacatctttgtgtagtttcttcccacattgyatcatgtttggtctgtctaaccaaggaaatatggctgatgtgatggtatgtcacttccgagattaggttataaaagacaagtctttctatgcctctgtttctgcctgtctcttctcattaatcactctgcgagaagccaattgtgatgttataagaagactcaggcaacctacgaaaaggcccacattgtaagaaactgtggtttcagccaacaggcatgtgaatgagcttggaaatgaattctccagccacagatgacttcatccctaatgggctgatatggtttggctctgtgttctc

SEQ ID NO: 117429 - DNA, 601 bp, Human
ctgtctaaccaaggaaatatggctgatgtgatggtatgtcacttccgagattaggttataaaagacaagtctttctatgcctctgtttctgcctgtctcttctcattaatcactctgcgagaagccaattgtgatgttataagaagactcaggcaacctacgaaaaggcccacattgtaagaaactgtggtttcagccaacaggcatgtgaatgagcttggaaatgaattctccagccacagatgacttcatccctaatgggctgatatggtttggctctgtgttctcacccaaatttcaycttgtagcttccataattcccacatgttgtagaagggacctgatgggagatgactgaatcatgagggtgggtcttttccatgctgttcttgtgatagtgaatgggtctcatgacatatgatggttttaaaaacaggagtttctctacacaagaactctttttgcctgctgccatccacataagatgtgactttctcctccttgcttcccaccataattgtgaggccttcccacccatgtggaactacaagtccaataaacctctttcttcagtaaattgtccagtctcgggtatgtcttt

SEQ ID NO: 117430 - DNA, 601 bp, Human
catgacatatgatggttttaaaaacaggagtttctctacacaagaactctttttgcctgctgccatccacataagatgtgactttctcctccttgcttcccaccataattgtgaggccttcccacccatgtggaactacaagtccaataaacctctttcttcagtaaattgtccagtctcgggtatgtctttatcagcagtgtgaaaacggactaataaatgggcagtatgactacaacctcttgagacaccctgaccagtacatccatctaagctctcttggatctctgactgaaaaaacaaaacaaaactgtaagatagtaagtatttgttgctataagatgctatgttttgggggcatttgttatgcagctatagataactaacatactttcaaattaattctacaaggcaacattatccagaaataaaatacacccaatattcttataaaaaagattcaaaatatttaataaatactagcaaatcaaatagagcaatatataaaatgtattacagtatgactaagtgagttctaccccagaaatgtaatgtttatctattaatcaaaatgacacaacaaaatttactgtatttacag

SEQ ID NO: 117431 - DNA, 601 bp, Human
ctgccatccacataagatgtgactttctcctccttgcttcccaccataattgtgaggccttcccacccatgtggaactacaagtccaataaacctctttcttcagtaaattgtccagtctcgggtatgtctttatcagcagtgtgaaaacggactaataaatgggcagtatgactacaacctcttgagacaccctgaccagtacatccatctaagctctcttggatctctgactgaaaaaaaaaaacaaaactgtaagatagtaagtatttgttgctataagatgctatgttttgggggcwtttgttatgcagctatagataactaacatactttcaaattaattctacaaggcaacattatccagaaataaaatacacccaatattcttataaaaaagattcaaaatatttaataaatactagcaaatcaaatagagcaatatataaaatgtattacagtatgactaagtgagttctaccccagaaatgtaatgtttatctattaatcaaaatgacacaacaaaatttactgtatttacagggtaaaaaacaaacaccaaaactaaaggattacctcaatagaggcagagtaagcatttg

SEQ ID NO: 117432 - DNA, 601 bp, Human
ctgaccagtacatccatctaagctctcttggatctctgactgaaaaaaaaaaacaaaactgtaagatagtaagtatttgttgctataagatgctatgttttgggggcatttgttatgcagctatagataactaacatactttcaaattaattctacaaggcaacattatccagaaataaaatacacccaatattcttataaaaaagattcaaaatatttaataaatactagcaaatcaaatagagcaatatataaaatgtattacagtatgactaagtgagttctaccccagaaatgtaatgtttatctattaatcaaaatgacacaacaaaatttactgtatttacagggtaaaaaacaaacaccaaaactaaaggattacctcaatagaggcagagtaagcatttgaataaactcaatatgtattaagatacaaacctctcagagccctagaagtagagggagcttttaacctgataaaaagcaagcaagcaagtgacaataacaacaaaaacttttgttaactcatatttaattgtgaaggactgactgcattttccatgaaatcagagagaaggcaaggttctttacttcttcactt

SEQ ID NO: 117433 - DNA, 601 bp, Human
tttctattcagcattatactggaagtcctatgcaatgaaataacacaagaattcaaacttataaaaaaataaaaattgcctttattttcaggcaagatttagaagaaaccataggagtaaatatttgctattgggaatagtgaaaaaaagttcttaaataagacacaaaaaagtataaaccatgaaagtaaatattagtaaatatacttcatggaatttaaacatttctgctcttcacaatatattcttacaaatttgaagggcaagctatggactatgagaaaatattttcaataggtaygtctaacaaaggacttgtatctagaatatatatataagaacatttacagcttaaaaataagaagataaactgctcaataaatattggcaaaaaattttagcagacactttacaaaagaagacacaaatgaccaataagcttatggaaacatgttaagcatcattagacatcatgaaaatacaaattaaaaccatagtgagatgccactgcacaaccattacaacggctatgattttaaaaaatgattttaagttttggtgagaagtgcaacaactggaaactcaaatgttgctaatggga

SEQ ID NO: 117434 - DNA, 601 bp, Human
tctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgggcaaggacttcatgtccaaaacaccaaaagcaatggcaacaaaagccaaaattgacaaatgggatctaattaaactamagagcttctgcacagcaaaagaaactaccatcagagtgaacaggcaacctacaacatgggagaaaattttcgcaacctactcatctgacaaagggctaatatccagaatctacaatgaactgaaacaaatttacaagaagtgtggcatattaatacaatagaatattattctgcaaataaaaatgaaccaactactgatatgcacaacataatgaatgcattattctaagtgaaagaagccagagtcagaagactacacactatgattaaaattttgtgaaattttagaaaaggcaaaac

SEQ ID NO: 117435 - DNA, 601 bp, Human
gaaacacgaaacaggaaggcccaagatggtcgaagtttgtgaccgtcaaacatcatggtgtagccataaaataagtacttagtaaaaagtattgttattaccattacaattctggctgtaggtgacgttaaagccccaaaacaaagcatcatgctacctctacatgctaatgggatgtagccactagagaagggatataagtggagtgacattcttctgaacatcaaaaaggatgagatccagagtatgggatccagtttttggtaagataaaggacattcctttcggtctatcaggagcrtggaaggaagtaatgagtgaagatgcaaatacgtgtgtaacttttatgacacaaagttgagggagctttgactgatggcttttgtttttttctgtggagtcaaggtcatacggagactaagggagagaggtgggagtcataggtttgagagcaaagaagacagtttgaaatatgctgcctcagaaaaggggaaagtacttcccatagaaacataatagatccctgggcattattaaggacctagttaaggttgaggaccatgaattaagagcatttccaattgagagcgatttttttttt

SEQ ID NO: 117436 - DNA, 601 bp, Human
tgacgttaaagccccaaaacaaagcatcatgctacctctacatgctaatgggatgtagccactagagaagggatataagtggagtgacattcttctgaacatcaaaaaggatgagatccagagtatgggatccagtttttggtaagataaaggacattcctttcggtctatcaggagcgtggaaggaagtaatgagtgaagatgcaaatacgtgtgtaacttttatgacacaaagttgagggagctttgactgatggcttttgtttttttctgtggagtcaaggtcatacggagactaagsgagagaggtgggagtcataggtttgagagcaaagaagacagtttgaaatatgctgcctcagaaaaggggaaagtacttcccatagaaacataatagatccctgggcattattaaggacctagttaaggttgaggaccatgaattaagagcatttccaattgagagcgatttttttttttctttccacaattactcagcaacccaactgcaaggttgagaaaatagcaagttgagtttattcaggtttgaagttttacagatgactcataataagataattacaacttaagaaattaaaga

SEQ ID NO: 117437 - DNA, 601 bp, Human
tggaaggaagtaatgagtgaagatgcaaatacgtgtgtaacttttatgacacaaagttgagggagctttgactgatggcttttgtttttttctgtggagtcaaggtcatacggagactaagggagagaggtgggagtcataggtttgagagcaaagaagacagtttgaaatatgctgcctcagaaaaggggaaagtacttcccatagaaacataatagatccctgggcattattaaggacctagttaaggttgaggaccatgaattaagagcatttccaattgagagcgatttttttttttctttccacaattactcagcaacccaactgcaaggttgagaaaatagcaagttgagtttattcaggtttgaagttttacagatgactcataataagataattacaacttaagaaattaaagattttgaagacagtaattaatgtgattatcaataaaatcttagctagataatgagagaagtggaaacaggggagtcctgagaagtaaggagaaagtaaaggagtcggtaaactggaagttcctagaaggcctataaaatagtatattggggatcagtgaattgggataatgtggccaaag

SEQ ID NO: 117438 - DNA, 601 bp, Human
agcatttccaattgagagcgatttttttttttctttccacaattactcagcaacccaactgcaaggttgagaaaatagcaagttgagtttattcaggtttgaagttttacagatgactcataataagataattacaacttaagaaattaaagattttgaagacagtaattaatgtgattatcaataaaatcttagctagataatgagagaagtggaaacaggggagtcctgagaagtaaggagaaagtaaaggagtcggtaaactggaagttcctagaaggcctataaaatagtatattgkggatcagtgaattgggataatgtggccaaagtgaagaaattgagaccataggggatgaagagggcaaggaatctgcaaagctaggttgttgaaaggatcacccaatgccgaaatcaccaataatagcaatgcctgtggtgggagaagatggaaaggcagaggccaatcttcagagaatttagaggattggccaggacataaagtcttttgatcaagtgctaaggagtaccccaaggtggaatcacaggcaaacactttcagtaagtgggaactgtatggaaggagtgaggaaatctaatc

SEQ ID NO: 117439 - DNA, 601 bp, Human
gcagtctgccgaattttgatgagagagctgtattcctgtaagagacatcatcgtccagatgtagatgcactgccgtgatgtccaaataggaaacaaagaccacttggaagtggatactttcctgaacttactgctctgatgaggggcccttcttttgaagcaaaatgagtcttcatgtagctgagaactctcttctcctatcactttacaaactctatcttcccccaaaggcctttccaaaggaagcagccaggctcagtggccatgatgttttcctgaaggtatgggagatagattatcmagttaaaaacacagttatttccctaaacctgacttaacctctgcatataactgcctggagcctattcaacgcagttgacaattgcctgccccggggcctccctctgtcctgaaattacccatttaaatcttcctattttttttaatccctaatagtctgtggcctactttttgttgtttacgttttgtatgtttttcaaaaccccaaagatttgcttcaaattctactcattcatttattttgtaaataaatgcattcattcaatgttgtcgtgagttgggagggagaaatgtctgactg

SEQ ID NO: 117440 - DNA, 601 bp, Human
catcatcgtccagatgtagatgcactgccgtgatgtccaaataggaaacaaagaccacttggaagtggatactttcctgaacttactgctctgatgaggggcccttcttttgaagcaaaatgagtcttcatgtagctgagaactctcttctcctatcactttacaaactctatcttcccccaaaggcctttccaaaggaagcagccaggctcagtggccatgatgttttcctgaaggtatgggagatagattatcaagttaaaaacacagttatttccctaaacctgacttaacctctgcrtataactgcctggagcctattcaacgcagttgacaattgcctgccccggggcctccctctgtcctgaaattacccatttaaatcttcctattttttttaatccctaatagtctgtggcctactttttgttgtttacgttttgtatgtttttcaaaaccccaaagatttgcttcaaattctactcattcatttattttgtaaataaatgcattcattcaatgttgtcgtgagttgggagggagaaatgtctgactgttcatttttctgccaaatgattatatagaacttaatagtatgcat

SEQ ID NO: 117441 - DNA, 601 bp, Human
acaaagaccacttggaagtggatactttcctgaacttactgctctgatgaggggcccttcttttgaagcaaaatgagtcttcatgtagctgagaactctcttctcctatcactttacaaactctatcttcccccaaaggcctttccaaaggaagcagccaggctcagtggccatgatgttttcctgaaggtatgggagatagattatcaagttaaaaacacagttatttccctaaacctgacttaacctctgcatataactgcctggagcctattcaacgcagttgacaattgcctgcccyggggcctccctctgtcctgaaattacccatttaaatcttcctattttttttaatccctaatagtctgtggcctactttttgttgtttacgttttgtatgtttttcaaaaccccaaagatttgcttcaaattctactcattcatttattttgtaaataaatgcattcattcaatgttgtcgtgagttgggagggagaaatgtctgactgttcatttttctgccaaatgattatatagaacttaatagtatgcattatgaatcagactgcttgggattgaatcacaggtctgccactatcta

SEQ ID NO: 117442 - DNA, 601 bp, Human
tgcatataactgcctggagcctattcaacgcagttgacaattgcctgccccggggcctccctctgtcctgaaattacccatttaaatcttcctattttttttaatccctaatagtctgtggcctactttttgttgtttacgttttgtatgtttttcaaaaccccaaagatttgcttcaaattctactcattcatttattttgtaaataaatgcattcattcaatgttgtcgtgagttgggagggagaaatgtctgactgttcatttttctgccaaatgattatatagaacttaatagtatrcattatgaatcagactgcttgggattgaatcacaggtctgccactatctatgtgaccttgagtaagttgtttaacctctctgcacctcagttcccatctgtgaaatggggatataataataacttcatggagttgttgtgaggattaaattaattcataaatacaaagtacttaaaacggtgcctggtgcagcttaagagctatagacaactttgctattatttatctagtgatcttagcatgccccattagaatggaaaggggtggagcttcataaatctttttgaagtgagatcttca

SEQ ID NO: 117443 - DNA, 601 bp, Human
tgatcttggctcactgcaacctctgcttccagggttcaagtgattctcctgcctcagcctcctgagtaggtgggcttataggtgcccgccatgatgcccagctaatttttgtttcattagtacaaatagggtttcactatgtcggccaggcttgtctcgaattcctgacctcaggtgatctgcccgcctcggcctcccaaagtgctgggattacaggtgtgaaccaccgtgcccggtttgagtaacctttaagtaagaaagtgccttttgggttgagtttaacaatttccatggtagagartctcttctgctatatgctgtttacttagcttctgcctagtatatgcagcagcagaaaatggtttcccttgttgtaggtctaatgagatttagaacactttgggtcctcagatatagtgagcaagattttcacttcatagatgaaggaactgcagcctaaagaattgggaagaaaaggtttatccaggcttgctgtgcattccttcctttctctgggaattcccttggagaagaaatctggctgatcaaatctccttgtaaacatgctgtgaagactctggggaaaaccactaatgatatt

SEQ ID NO: 117444 - DNA, 601 bp, Human
gcccgccatgatgcccagctaatttttgtttcattagtacaaatagggtttcactatgtcggccaggcttgtctcgaattcctgacctcaggtgatctgcccgcctcggcctcccaaagtgctgggattacaggtgtgaaccaccgtgcccggtttgagtaacctttaagtaagaaagtgccttttgggttgagtttaacaatttccatggtagagagtctcttctgctatatgctgtttacttagcttctgcctagtatatgcagcagcagaaaatggtttcccttgttgtaggtctaaygagatttagaacactttgggtcctcagatatagtgagcaagattttcacttcatagatgaaggaactgcagcctaaagaattgggaagaaaaggtttatccaggcttgctgtgcattccttcctttctctgggaattcccttggagaagaaatctggctgatcaaatctccttgtaaacatgctgtgaagactctggggaaaaccactaatgatatttgttagtggcagtctttatctttgagagacttttagcagcatgaaccttacccccgtagttagaattgtatatggtaaacaaa

SEQ ID NO: 117445 - DNA, 601 bp, Human
tgtaaacatgctgtgaagactctggggaaaaccactaatgatatttgttagtggcagtctttatctttgagagacttttagcagcatgaaccttacccccgtagttagaattgtatatggtaaacaaacctggaaatctaaggattcatgggtaatggcttcttgaaaagtgtcaagtaagctatgtaactatggcaggagatggaactacttcagggttaaaaaagctggctttcatttcgtgcaagtaatgtacttgtgtacatcttttggagaaccatatgttaaatccgaatcagaycaagtcctaatgtggtaagaaaagggctgtggagtagtattggcagtcctgggcttttccctatgttccctgtaccttgtgattacttatagctttgacattattagtaaagcttgatacttggtaaaatattttattcttgtgggtctaatttgaaaatctagcccttgtgttatctccaacagatactgcctgatccaagatcacaaagttgggcagcaatgaaagatctaatctcagacctcttctctcctgtatcccaaaccagtgcaacaatgaggtttcctctgttcctacata

SEQ ID NO: 117446 - DNA, 601 bp, Human
cctgggcttttccctatgttccctgtaccttgtgattacttatagctttgacattattagtaaagcttgatacttggtaaaatattttattcttgtgggtctaatttgaaaatctagcccttgtgttatctccaacagatactgcctgatccaagatcacaaagttgggcagcaatgaaagatctaatctcagacctcttctctcctgtatcccaaaccagtgcaacaatgaggtttcctctgttcctacatatttatttctacatcttcttacgtggtttagaatgatgatgatgatgatgatgatgataatgataaaatcagcaactacctttaatttaccttactatgtgtcagacatagtgcttctcattatataaaaacagtataagcaacacatctatatgtaaaaactctcacgtcgtgaaacatatgtatagagaccctatcgggttaaaccttatgaaacttctaatatgtatttaacctacaaaacaggaatgtcatttggctcaatccaatataatatgccaggtagtttaaattaggtggacaagaaaggcctctgaagatctgagatcgaacaacgggaacttggcat

SEQ ID NO: 117447 - DNA, 601 bp, Human
ctttggaagtaggagtaaagagtttgagttttatactaaatgggttttgactggggacagagaggaaaaaatgagatgtgattgattgattgataatttattatttttatagatttagggggtgcaagtgcaaatttgctacatggatgtactgcattgtggtgaagtctgggcttttcgtgtactcatcacccaaattgtgaacactgtaccatataggtaatttttcaaccctcatcctcctcttgccctcccacattctggagtctccaatgtctagtcttccacactgtacgtccayatttacccattgtttagctcccatgtactcatcacccaattagtgaacactgtaccatataggtaatttttcaacccttatccccttcttgccctcccaccttccggagtctccagtgtctagtcttccacactgtatgtccatgtgtacccattgtttagctcccacatactcatcgcccaattaatgaacactgtaccatataggtagtttttcaaccttcatccccctcttgccctcccaccttctggagtctccaatgtcttgtcttccacactgtatgtccatgggtacccattg

SEQ ID NO: 117448 - DNA, 601 bp, Human
gagaagggtttgctttgggtagcttagagcacttgacaggaggcattttgtagcagccctattacccaaggggtataggaaaagctacagaccagaactgatatgctcttctctagaaaatgaaactgcttccagatccagagataattagacaaatgtctcactgctgcagggagcaagaaagaagggctacgatgggcagattcttggcatagctcttcaggatgtacaaggacttgcccagtgaccaggagagtaggggccactgaggaaaacaggctaaattaattgaatgatgggsagaaggatgaggaggagaggaaagggagattggaatctgggactgcgcccaggctgcctttgtatgcgagttccctaacaacgctttctgagggaagtcagggactgactgaagcttaattcagattctctgaatgtgccttaaggagacagactgaggaatggtctgatgaaatgcaggggaagcaaaacttggcaagggcacagtggcaaatgagctgagaatatggggggagatcctgccaagacccccttccccccaggaccacccttggtgtatccggagaaatcaatcaattgg

SEQ ID NO: 117449 - DNA, 601 bp, Human
ggttccaatatccctacactgggggcatttgtaagagccttgtagagagttcacaaaaatcattaagtctacaaaacatcccttcctgatgccacctctttcctctcttgggtatttgtagtattctcctctaaatatctagctggatacattcgtgcccccacttaggcagccaaatcttcattcactcccttctggggtcgtctgccagatttgttgaaattaaaagttggaaataacttgatatatgtaaacttcctcctgcacctcctatcaattttataaccaaatgtaagaaaakcttttataatatccaaagagctttacccaatatatctctgcatctcactcaaagtttgtgaagtagctattattatccccaactgacttgtgaaaaacaggctcagagaagcagaggcctgcccaaagtcacactgtaaatgtcctgaaacagaggggcctggaacccaggtctcctagtttctatccagcctactcacccctgtacaatgctaccttcattatcttactttttattccactatgtcaatgggtaaaacagaataaaataatattcccttgttcccatgtctacctaaat

SEQ ID NO: 117450 - DNA, 601 bp, Human
acccctgtacaatgctaccttcattatcttactttttattccactatgtcaatgggtaaaacagaataaaataatattcccttgttcccatgtctacctaaatgtggatgcagtctctagtatgctttccttgaactcagtggagacaatctttcatctggaaaaaattcattttttaaggtttccagtctcattgactgccctctccaacctcatactttctgatccaacactactactcataatgatttaaataaaccccaaactgttatttcacactactgcatgtttctttgttaargctcttttccctattccaattgtccttctctttgaatagaaaacttctatccttcctcaagccctagaaatctacccttgacctccaagtaagtcaaatgggttgtctgatcccatatcccctctctatatgtacctcatcatagcactcactgggctctcttagaattgtctctttaaatgcctggcctcttcctctggcccagaagccacttggggacagggactttctatctccagcatctaatgcagaatttgaccaataattgcaggtgcttgggaaacatttattgccttgatc

SEQ ID NO: 117451 - DNA, 601 bp, Human
gcatgaatcttccgtaggtaattcctccctgaggaagaaagagttagctctcaattacatacagcgatgggggtgcatggtggctgaaatgatacaaatgccacttatattcaagttggagccttttcacaaagtcacagaaagacacagtgagatttgagtcccagaagcataaaagtcccagagaaaggggccttgacatagctttacttgcattgaatacagatttgttcaacccccatgagaggagaaatactgaaacaccggaaaacattgtctcctctcataacattttcagctsatggtgaagacggacacatccataactatactaccagctaacatttcccactcatttggaaattatttttaccaatattttagtgactcaagcattcagggtcataataaaaggggaaaatgtactaaatcacaatttttactgagtctgatattcaatttctttgattcatttcttctttatttaatcaaatattcaccaagtattactaggtaccagacatcatgccagggactagaaataatgtgaaaaaaaaggatgttttctgctctcacggggttcacagctgtggtggctgag

SEQ ID NO: 117452 - DNA, 601 bp, Human
tgaaacaccggaaaacattgtctcctctcataacattttcagctcatggtgaagacggacacatccataactatactaccagctaacatttcccactcatttggaaattatttttaccaatattttagtgactcaagcattcagggtcataataaaaggggaaaatgtactaaatcacaatttttactgagtctgatattcaatttctttgattcatttcttctttatttaatcaaatattcaccaagtattactaggtaccagacatcatgccagggactagaaataatgtgaaaaaaaaggatgttttctgctctcacggggttcacagctgtggtggctgaggaactgtggtctctgctccccaccaattatacatcagctggacataagtaagtgtgcagtaaaacagaaatttaaattttgaggtagaaaatttacttatgaattctatcactcttaaatatatatattttgtattgagggaggagaaagtggattacagtttcaaagaggcataactaggagtcaggaagcctggcgtctattcccaaatccttttctcattagctggtgatttataaaagtcatttaaactcag

SEQ ID NO: 117453 - DNA, 601 bp, Human
tgtctcctctcataacattttcagctcatggtgaagacggacacatccataactatactaccagctaacatttcccactcatttggaaattatttttaccaatattttagtgactcaagcattcagggtcataataaaaggggaaaatgtactaaatcacaatttttactgagtctgatattcaatttctttgattcatttcttctttatttaatcaaatattcaccaagtattactaggtaccagacatcatgccagggactagaaataatgtgaaaaaaaaggatgttttctgctctcmcggggttcacagctgtggtggctgaggaactgtggtctctgctccccaccaattatacatcagctggacataagtaagtgtgcagtaaaacagaaatttaaattttgaggtagaaaatttacttatgaattctatcactcttaaatatatatattttgtattgagggaggagaaagtggattacagtttcaaagaggcataactaggagtcaggaagcctggcgtctattcccaaatccttttctcattagctggtgatttataaaagtcatttaaactcagtcccagttctgtcatatg

SEQ ID NO: 117454 - DNA, 601 bp, Human
ttgtattgagggaggagaaagtggattacagtttcaaagaggcataactaggagtcaggaagcctggcgtctattcccaaatccttttctcattagctggtgatttataaaagtcatttaaactcagtcccagttctgtcatatgtacaattgtgtaaggcttaccctggaagttataaattctatgtgtttttgatcggaatccttcactgtacaatttatttgttctcttatacattcaccacttattcattcattctgctaaataaacattcatttgtcccatgtgttaattttaatrgctactataacaaattacacaaatttggtggcctaaaacatgagaaatgtatcctttcccaattattggagaccaagagtccaaaatcagtattactgggctgaaatcaagttgtcagtaggatgtgttactttagggtgctctaggggatagtgtgttccttgcccctttgattttttagtggctgtctttattttttggctggtggctgcattactccaatctctgcccctgtaatcacattgcttcctcttctgagtgtgaaatctccctttgcctccttcttataaggatatatgt

SEQ ID NO: 117455 - DNA, 601 bp, Human
atttacatagggctcacaggcttccctgaactataaaatttcctgcacattttatagaatgtgagggtagagagggtaggagatatgacggtcacggacaggaaaggaggaaattaggatagaaaagttgaagaccctgttgctgacacccatcgggtggtcaaaggctggggtcagtccagaagcctttggatagcaccagggggtagcctcagccagaaatcctcgtttgctacaggacctcttccagccccagatgatggctaagtactctgtgaaaggaagctggttcaaacatggmcaatatgcccaggaacccatgggcaccgggggattctccatgttgtcctcagcaagcctgtcccccagatttgaagattctgtgggtagaaacagtggtaattggatgctgaatgtgaagaaaagagagaagttctagataatccctatcatttttcccaaatggtggagtgaaatgaggtcactcgttagacagagaacccaggcagaatggcaaaaattccataaagaataattatatttcctctttccttttaaagaaatccaaaagtcctcttccttctccccttccacatttccc

SEQ ID NO: 117456 - DNA, 601 bp, Human
tcacaggcttccctgaactataaaatttcctgcacattttatagaatgtgagggtagagagggtaggagatatgacggtcacggacaggaaaggaggaaattaggatagaaaagttgaagaccctgttgctgacacccatcgggtggtcaaaggctggggtcagtccagaagcctttggatagcaccagggggtagcctcagccagaaatcctcgtttgctacaggacctcttccagccccagatgatggctaagtactctgtgaaaggaagctggttcaaacatggccaatatgcccagsaacccatgggcaccgggggattctccatgttgtcctcagcaagcctgtcccccagatttgaagattctgtgggtagaaacagtggtaattggatgctgaatgtgaagaaaagagagaagttctagataatccctatcatttttcccaaatggtggagtgaaatgaggtcactcgttagacagagaacccaggcagaatggcaaaaattccataaagaataattatatttcctctttccttttaaagaaatccaaaagtcctcttccttctccccttccacatttcccttctcctttcctt

SEQ ID NO: 117457 - DNA, 601 bp, Human
aatgtgaagaaaagagagaagttctagataatccctatcatttttcccaaatggtggagtgaaatgaggtcactcgttagacagagaacccaggcagaatggcaaaaattccataaagaataattatatttcctctttccttttaaagaaatccaaaagtcctcttccttctccccttccacatttcccttctcctttccttctcctcctctctctcctccttctctttcttcttttcttctgtgtagctggcagcattggtataagccaacaggaaaaagtgagacaaatctcagactcracagaatgtgtcttttcctgtctcttccccaaacagctttctagatgccaagctctttcctacctggtggtcatcttgctgccaattgatctctttctgaaaggcttgtgtctaactacccccacccatgaacaccctctgcacacacaagacacagacatttaacctgctgatgtcctactcattatttaggctgtgtttaattgacatgttctaaggaaagtattcactatttttaagcattgactctccacctcactaccatgaaaatacacacacacacacacacacacacacaca

SEQ ID NO: 117458 - DNA, 601 bp, Human
tagataatccctatcatttttcccaaatggtggagtgaaatgaggtcactcgttagacagagaacccaggcagaatggcaaaaattccataaagaataattatatttcctctttccttttaaagaaatccaaaagtcctcttccttctccccttccacatttcccttctcctttccttctcctcctctctctcctccttctctttcttcttttcttctgtgtagctggcagcattggtataagccaacaggaaaaagtgagacaaatctcagactcgacagaatgtgtcttttcctgtctsttccccaaacagctttctagatgccaagctctttcctacctggtggtcatcttgctgccaattgatctctttctgaaaggcttgtgtctaactacccccacccatgaacaccctctgcacacacaagacacagacatttaacctgctgatgtcctactcattatttaggctgtgtttaattgacatgttctaaggaaagtattcactatttttaagcattgactctccacctcactaccatgaaaatacacacacacacacacacacacacacacacacacagtttatgctctgttatat

SEQ ID NO: 117459 - DNA, 601 bp, Human
gaatggcaaaaattccataaagaataattatatttcctctttccttttaaagaaatccaaaagtcctcttccttctccccttccacatttcccttctcctttccttctcctcctctctctcctccttctctttcttcttttcttctgtgtagctggcagcattggtataagccaacaggaaaaagtgagacaaatctcagactcgacagaatgtgtcttttcctgtctcttccccaaacagctttctagatgccaagctctttcctacctggtggtcatcttgctgccaattgatctcttyctgaaaggcttgtgtctaactacccccacccatgaacaccctctgcacacacaagacacagacatttaacctgctgatgtcctactcattatttaggctgtgtttaattgacatgttctaaggaaagtattcactatttttaagcattgactctccacctcactaccatgaaaatacacacacacacacacacacacacacacacacacagtttatgctctgttatatactgctctgattttctgtatctttcactttttgcactatcacaactataataaaatatttgaattactatct

SEQ ID NO: 117460 - DNA, 601 bp, Human
atgtgtcttttcctgtctcttccccaaacagctttctagatgccaagctctttcctacctggtggtcatcttgctgccaattgatctctttctgaaaggcttgtgtctaactacccccacccatgaacaccctctgcacacacaagacacagacatttaacctgctgatgtcctactcattatttaggctgtgtttaattgacatgttctaaggaaagtattcactatttttaagcattgactctccacctcactaccatgaaaatacacacacacacacacacacacacacacacacacagtttatgctctgttatatactgctctgattttctgtatctttcactttttgcactatcacaactataataaaatatttgaattactatctatataatgcccttctctcccattagtccataagcaccaagagacaaaatccatgtctgctttcctcactgtggtatcttttgaacttatcacagaacctggaaaataccaagttataaacatattctgaatgaaataatacaaacgaatcaatgaatgaatgatggataaatgcagtgtactataataatgatgtaaggaaccacttcta

SEQ ID NO: 117461 - DNA, 601 bp, Human
tctaatacacagcaaagtggaagctgtctctcttgaccttgagccactccttgcggcaaagtttccagttaacatgaaacccaatcagattccccaaaatagcagcctgttcctctagggagaagaggagccccacccaaagcttgctccagagtcttggaggaaagaaaaaggagggagcagagagtcttgcttaaaaatgtgacacatattttccaggagctgcctccaggcctgggatggagattctgagcatcatgattttaaactttttacttaatttttcattcttgcttcaggmctgggcaagctggactctcgagtcttgaacaaaaatggaaaaataagggctgcagttgaaatcatttcactgtgcctatttcacatgatgctgcctgcaaaaaatatagcaaacaagattcctctgttcagtttatctccagaaagagggaacctgcatggagaaactgtaaggagtgagagagaggtttcggagaaagatgagctttagctttgcaaaggtgggatttgttttgcacagtaaatttctggaattatttcatttgatttcccattgtttgagtgtactgggtggtacacc

SEQ ID NO: 117462 - DNA, 601 bp, Human
gaaaagcaaacaaaagaacacacatcactggaggaagagttctagcaaatagttttccagttcctgacagcttcaagaacattaggtcaccctgatatctcttttgcataaaaaagggagctctgagctaaaaagcaagagttctagtttaaaaaaaaggaaaaaaaaaaaaaaaaaaaagaaggtgagaagagctcaagaaataatcaaagaagaaattttaagtaatattgaagtggaagacacatgaaaattccagaagtagaatgaactcaactgaaaacatagtcaaggacaaagstgtgcttgagaacaatcacattagaaaatgttttatgagatgaaaataatttaacagaaagaaacatcatcatattacatgccaagaaatttttatatagaatcaacagcacagatcccagtaaatttaatacatttcagatgtgataataataatgtaataataataataaagtaatttagaaggaaaaaattcagagttgccttatactcctccacagcaacatgtaatagcagaagacagtggcataatatccataatgtttaaagggaagaaaactagacccattatacccagcat

SEQ ID NO: 117463 - DNA, 601 bp, Human
aatttaacagaaagaaacatcatcatattacatgccaagaaatttttatatagaatcaacagcacagatcccagtaaatttaatacatttcagatgtgataataataatgtaataataataataaagtaatttagaaggaaaaaattcagagttgccttatactcctccacagcaacatgtaatagcagaagacagtggcataatatccataatgtttaaagggaagaaaactagacccattatacccagcatagcttgtctttagaagatgaagacaaaggatctacaacctcagacatrcagatattcatcctatggcatgcataaatcttccttagaattaaaaaaacagacacaagacaaagaaatgcacccaatgaagaaatgaaaaaggaaaaataaaaacttagagaagtctaggaaaaagattgattggtagtgaacattaaatccatttaagtatataactaagattactagctctgagtattactattacctagtagaataaaatattataaaacttgacaataaaaataatactgtaaataagaaaacagggaaatcaagaattcaagagatactatgtgcatggtgcga

SEQ ID NO: 117464 - DNA, 601 bp, Human
gtatctgttttaagaagtgcacatgatggaatcaagtgggcaatctctcagaagccataggagatgtgttaataaaatagtagaatagggatcaaatagaattagattgaaattaaaatctatgaaggtgaagaagaaaaaagaataatgaataaaagatgaggaaatgaggaaagatgtactgtgccttaggactactgaataccataataagccatgctcagtagtaaaagagaatgtcataggaagtgtgtattacaactgtgagccctacacagctcaacacttatacttggtaggyttcttataacatctgatactaatacgccctttgcattaaaaataaaagttttttgtacaattaaccttctcaaatgtcatcaacaagtcatcaggactgatgtttaaccaaatctgcttctaccttttgaaattaagatcagctatattattctctcaagagttttatcattagactctggacttggatgtctatcccactcatggttatagactctgtgaagaatatatattgtgtaatttttgcatgtttatttactatccttcagaatctggcatagtacttggcatgtagtagtgc

SEQ ID NO: 117465 - DNA, 601 bp, Human
tacgccctttgcattaaaaataaaagttttttgtacaattaaccttctcaaatgtcatcaacaagtcatcaggactgatgtttaaccaaatctgcttctaccttttgaaattaagatcagctatattattctctcaagagttttatcattagactctggacttggatgtctatcccactcatggttatagactctgtgaagaatatatattgtgtaatttttgcatgtttatttactatccttcagaatctggcatagtacttggcatgtagtagtgcttaataagtgtttgtgaattgarttaacaagtatttgtgaatgatatgtgtatgaagattaagccctcttcccaaggtgcacctaggaaggggaacatcacacaccagggcctgtcatggggtgggggagcaggggagggataacattaggagatatacctaatgtaaatgatgagttaatgggtgcagcacaccaacatggcacatgtatacatatataacaaacctgcgcattgtgcacatgtaccctagaacttaaagtataataaaaaaaggaaaaaaaaataaaaaaatatatagtgccaactactgttatattctag

SEQ ID NO: 117466 - DNA, 601 bp, Human
agtagtgcttaataagtgtttgtgaattgagttaacaagtatttgtgaatgatatgtgtatgaagattaagccctcttcccaaggtgcacctaggaaggggaacatcacacaccagggcctgtcatggggtgggggagcaggggagggataacattaggagatatacctaatgtaaatgatgagttaatgggtgcagcacaccaacatggcacatgtatacatatataacaaacctgcgcattgtgcacatgtaccctagaacttaaagtataataaaaaaaggaaaaaaaaataaaaaaatatatagtgccaactactgttatattctagagtgacccatgcagaatatgcagaggatgagcttaaagattatgtgaccaatagcccaatattcacctggaggatataaaatgaatgaaaagaagatttcactcacttcagtgagtgagtgaagctttaaggagactggaaactgtaggcagtggctgacgctggcttcctctctgttaaagcctaataagaaaaactgtgcctggtatttgctctggtaatagatgatgagggagagttctactgaaaaatacctgctcttccagagtg

SEQ ID NO: 117467 - DNA, 601 bp, Human
atatgcagaggatgagcttaaagattatgtgaccaatagcccaatattcacctggaggatataaaatgaatgaaaagaagatttcactcacttcagtgagtgagtgaagctttaaggagactggaaactgtaggcagtggctgacgctggcttcctctctgttaaagcctaataagaaaaactgtgcctggtatttgctctggtaatagatgatgagggagagttctactgaaaaatacctgctcttccagagtgcattggagcataggatatatacttctaatgggtcagatggtggtcmcttggaaagagctgcccaggagtcatccaaaagaggttgtaatttttcccaagagagatttctggatgggtgatgagaccccagtagaaagtatcaatgaggtcaccagaggccaaagggaaattgtagggagtccaccacaggatactggaagtgggacaccctgaggtgatggaggaatgtccatgaaggacttataaacacatcttcaaaaagcttcagatttgaacatccatggaacccagactcagattttagatcccattatgcccaatggaaaccaatactagatgattatat

SEQ ID NO: 117468 - DNA, 601 bp, Human
ggagtcatccaaaagaggttgtaatttttcccaagagagatttctggatgggtgatgagaccccagtagaaagtatcaatgaggtcaccagaggccaaagggaaattgtagggagtccaccacaggatactggaagtgggacaccctgaggtgatggaggaatgtccatgaaggacttataaacacatcttcaaaaagcttcagatttgaacatccatggaacccagactcagattttagatcccattatgcccaatggaaaccaatactagatgattatattagcattgaaaaaggaacrctgtgatggttaataatgagtgtcaacttgattgaattgaaggatgcaaagtattgttcctaagtgtgtctgtgagggtgttgccaaaggagattaatatttgagtcagtggactgggagaggcagacccaccctcaatctgagtggccatcatctaatcagctgcctgcgaggatagaataaagcaggcagaagaacgtggaaggatttgacttgctaagtcttccagctttcatctttctcctgtgctggatgcttcctgcccttgaacgttggcctcgatgttcttcagcttttgga

SEQ ID NO: 117469 - DNA, 601 bp, Human
atgattatattagcattgaaaaaggaacactgtgatggttaataatgagtgtcaacttgattgaattgaaggatgcaaagtattgttcctaagtgtgtctgtgagggtgttgccaaaggagattaatatttgagtcagtggactgggagaggcagacccaccctcaatctgagtggccatcatctaatcagctgcctgcgaggatagaataaagcaggcagaagaacgtggaaggatttgacttgctaagtcttccagctttcatctttctcctgtgctggatgcttcctgcccttgaacrttggcctcgatgttcttcagcttttggactcttagagttacaccagtggtttgccaggggctcttgggcctttggccacacattgaagggtgctctgttggctttcatactttgaggttttgggacttggactggcttcctttcccctcagcttgcagatggccctattgtgggacctcaccttgtgattgtgtgagtaaatactccttaataaactccccttcatatatactatctatcctattacttctgtacttctagagaaccctgactaatacagagacctttcctgccctttat

SEQ ID NO: 117470 - DNA, 601 bp, Human
actatctatcctattacttctgtacttctagagaaccctgactaatacagagacctttcctgccctttatttcccctcagtgttccagtgaaatcctgaggagccagaggcagcttcctgaatgggtgaagggataacagccctcacaaggaaaaagagagaaaggcagccatgtccctgtgtttctcccatttttaaaaccatcagatctcatgagactcactcactatcatgagaacagcacagaaaagacccgcccccatggtttaatcatctttcactgggtccctcccacaacacmtgagaattatgtgagctacaagatgagatttgggtggggacatacagccaaaccatatcattctcccctgacacctcccaaatatcatgtcttcagatttcaaaaccaattatgccttcccaacagtccctcaaagtcttaactcatttcagcattaactcaaaagtccacagtccaaagtcttatctacgacaaggcaagtctctttggcctatgagcccataaaatcaaaagcaagttagttacttcctagatgcaatgggggtacaggcattgggtaaatacagccattccaaatgg

SEQ ID NO: 117471 - DNA, 601 bp, Human
ctcactatcatgagaacagcacagaaaagacccgcccccatggtttaatcatctttcactgggtccctcccacaacacctgagaattatgtgagctacaagatgagatttgggtggggacatacagccaaaccatatcattctcccctgacacctcccaaatatcatgtcttcagatttcaaaaccaattatgccttcccaacagtccctcaaagtcttaactcatttcagcattaactcaaaagtccacagtccaaagtcttatctacgacaaggcaagtctctttggcctatgagcccrtaaaatcaaaagcaagttagttacttcctagatgcaatgggggtacaggcattgggtaaatacagccattccaaatggggaaaattggccaaaacaaagaggctactggccccatgcaagtttgaaaaccagcagggcaatcaaatcttaaagctcccaaatgatctcttttagctccatgtctcacatccaggtcacactgatgcaacaggtaggctcccatggtcttgggcagctctgcccctgtggcttttcagggtacagcctccctcccagctgctttcatgggctggtgttgag

SEQ ID NO: 117472 - DNA, 601 bp, Human
catctgagaccacctcagtgtggcccttattgttcacatcactatcagcatttttgtcaaagccattgaacaagtttctaggaggttccaacctttcccatatttccctgtcttcttctgagccttccaaactgttccaacctctgcctgttacctatttccaaagtcgcttccgcatttcaggtctcttttcagcagtgctccactctactggtaccaatttagtgtattagtccatttttgtgctgctgataaagacatacccaagactgggcaatttacataagaaagaggtttaacyggacttacagtttcatgtggctggggaagtctctgaatcatggcagaaggcaagaaggagcaagtcccatcttatgtggatggcagcaagcaaaagataacttgcgcagggaaactcccatttttaaaaccatcagatctcctgagacccactcactatcatgagaacagcatgggaaagatccaacctcatgatttactcatcttccattgggtccctcccacaacacgtgggaattatgggagctacaagatgagatttgggtggggacacagagccaaaccatatcatcatctttaa

SEQ ID NO: 117473 - DNA, 601 bp, Human
ttccctgtcttcttctgagccttccaaactgttccaacctctgcctgttacctatttccaaagtcgcttccgcatttcaggtctcttttcagcagtgctccactctactggtaccaatttagtgtattagtccatttttgtgctgctgataaagacatacccaagactgggcaatttacataagaaagaggtttaaccggacttacagtttcatgtggctggggaagtctctgaatcatggcagaaggcaagaaggagcaagtcccatcttatgtggatggcagcaagcaaaagataactygcgcagggaaactcccatttttaaaaccatcagatctcctgagacccactcactatcatgagaacagcatgggaaagatccaacctcatgatttactcatcttccattgggtccctcccacaacacgtgggaattatgggagctacaagatgagatttgggtggggacacagagccaaaccatatcatcatctttaaggagacattattaagtttatgataaaggctctgataaaatgcccatgcttggagatgaagtagccttaaaaaattgattgcaacttaattcgctcactagcac

SEQ ID NO: 117474 - DNA, 601 bp, Human
tatcctgccatatatctctggagtgaagaagacctgggaggcgtgggcaggccaatgaatggagccattgactcagatgttcctcgatgggcaggcgtgattatttcagggggccagttcttccactgtgaccgcatagctgagggcacagccaatgaatgagcttcacccaataatttctggttgattcacatttgggtcagtgatgtggtgggcaatgccagctgcagccccaggctccaagggcaactttccaagctgggactccttacaattctgccctgttaatggaggttggggsaaaatctagggtgggtccctccaggcatgagtgagtgaggcgagggaaaagaaggaaatggttttcataaattattgctagagtttttagagaaataaaagcatgggtttgagaaggaggtggaggactctcagcatcatgccactcctattgctcttcggataaagttcaaattgcctcatgtggcctactaggcctgtcatgagcaggttgccatgttatctttctctctagcctccccttaggctgccgttatcttcaatatctaccctccagtcaggctgaccacgttttagtatc

SEQ ID NO: 117475 - DNA, 601 bp, Human
gccagctgcagccccaggctccaagggcaactttccaagctgggactccttacaattctgccctgttaatggaggttgggggaaaatctagggtgggtccctccaggcatgagtgagtgaggcgagggaaaagaaggaaatggttttcataaattattgctagagtttttagagaaataaaagcatgggtttgagaaggaggtggaggactctcagcatcatgccactcctattgctcttcggataaagttcaaattgcctcatgtggcctactaggcctgtcatgagcaggttgccatgytatctttctctctagcctccccttaggctgccgttatcttcaatatctaccctccagtcaggctgaccacgttttagtatctctaacacggcattgttctctcctcaaagtctttgcaaatgctattactttatcctggaagggcttactcttcaacccccaacctgattaaatccttctcatcattaggatatagttgggatgtaactttcttgacctcccagactagatcagattgtggttacatgtttccatagtaacttgatcttcattgcagttatttcaatagctgtgttttcc

SEQ ID NO: 117476 - DNA, 601 bp, Human
tactaggcctgtcatgagcaggttgccatgttatctttctctctagcctccccttaggctgccgttatcttcaatatctaccctccagtcaggctgaccacgttttagtatctctaacacggcattgttctctcctcaaagtctttgcaaatgctattactttatcctggaagggcttactcttcaacccccaacctgattaaatccttctcatcattaggatatagttgggatgtaactttcttgacctcccagactagatcagattgtggttacatgtttccatagtaacttgatcttcattgcagttatttcaatagctgtgttttccatctgtcttcctcatgagtctgtgagctataggagggccagaaaatatctaccttagtttatcttccatacctagtacctagtccagcgcctggcccgtagcaggttttactgaatatagtacttaataaaaaataataagggggagaaagaaggagagaagaaaagaagggagggaaggaaggaggacaggagcaaggaaggatacatggaagaaaggaagaggggaaagaagtagaagaaagaaagaagaaaggggataatttaattt

SEQ ID NO: 117477 - DNA, 601 bp, Human
tgatcaagcaggaactctatgccaaggactatgcagggcacatgaaacacattttctcatggcatcctcacaaaccacacactgaggtgaggattgttccccgcagtgaggctaatgagaaaatcaagactcagagagtttcagggtatatgaggagaaagaataataccctggagacctggatgctttggtcacttattccctttccccaccccaggcctacctgatgacttttacttacacttcacatttgattcaaatgtcactttttcaggaggcattttctttttttctttttttwaattttactttatgttctggggtacatgtgcagaacgtgcagttttgttacataggtgtacatgtgccatggtggtttgctgcacccatcaacccatcacctgcattaagtatttctcctaatgctatccctcccctagctccccaccccccaacaggccccggtgtgtgttgttcccctccctgtgtccatgtattctcattgttcaactcccacttatgagtgagaacatgcagtgtttggttttctgttcttgtgatagtttgctgagaatgatggtttccagcttggaggggattt

SEQ ID NO: 117478 - DNA, 601 bp, Human
gatcaagcaggaactctatgccaaggactatgcagggcacatgaaacacattttctcatggcatcctcacaaaccacacactgaggtgaggattgttccccgcagtgaggctaatgagaaaatcaagactcagagagtttcagggtatatgaggagaaagaataataccctggagacctggatgctttggtcacttattccctttccccaccccaggcctacctgatgacttttacttacacttcacatttgattcaaatgtcactttttcaggaggcattttctttttttcttttttttwattttactttatgttctggggtacatgtgcagaacgtgcagttttgttacataggtgtacatgtgccatggtggtttgctgcacccatcaacccatcacctgcattaagtatttctcctaatgctatccctcccctagctccccaccccccaacaggccccggtgtgtgttgttcccctccctgtgtccatgtattctcattgttcaactcccacttatgagtgagaacatgcagtgtttggttttctgttcttgtgatagtttgctgagaatgatggtttccagcttggaggggatttc

SEQ ID NO: 117479 - DNA, 552 bp, Human
agggtatatgaggagaaagaataataccctggagacctggatgctttggtcacttattccctttccccaccccaggcctacctgatgacttttacttacacttcacatttgattcaaatgtcactttttcaggaggcattttctttttttcttttttttaattttactttatgttctggggtacatgtgcagaacgtgcagttttgttacataggtgtacatgtgccatggtggtttgctgcacccatcaacccatcacctgcattaagtatttctcctaatgctatccctcccctagctycccaccccccaacaggccccggtgtgtgttgttcccctccctgtgtccatgtattctcattgttcaactcccacttatgagtgagaacatgcagtgtttggttttctgttcttgtgatagtttgctgagaatgatggtttccagcttggaggggatttcttaccaccctcactaggtcaactcctctcttacagacctccatttcctctttgtacttgtcacttctaatcatgcatttttgagtgattagt

SEQ ID NO: 117480 - DNA, 535 bp, Human
gcacatgtctgcattggtttgccgttgttttcccagctcctgaatagccctggcacataacaggttgccaataaccacttatgagcaaatgagttagatcattttgttgagcacatattctgtcctgggccctgtgctgattgatcttgctgtgtacagtggaaagtcatacatggtcactgctttcaaggagctcatagtcccatggggagattgtcttatttttttatgataytactatgttattttttaaagatactactttaaaaaataagagagttaaaatgttattggtaatagggggcccagggaagtccctgggtggagagaaggcagagatagttcattttacctaggaatgggtttctagaggagagggagcttggtgggagcccaggaaagtgaaaaggtgtttttcaggtggacaagggtgatatgtagttaggcagaaggaaatacagatgaagggagaaatatgagcagagggaaaagaaaaggagatgtgaaacaacatccatagcaaatggtttggttt

SEQ ID NO: 117481 - DNA, 579 bp, Human
gcacatgtctgcattggtttgccgttgttttcccagctcctgaatagccctggcacataacaggttgccaataaccacttatgagcaaatgagttagatcattttgttgagcacatattctgtcctgggccctgtgctgattgatcttgctgtgtacagtggaaagtcatacatggtcactgctttcaaggagctcatagtcccatggggagattgtcttatttttttatgatattactatgttattttttaaagatactactttaaaaaataagagacttaaaatgttattggtaatagggggcccagggaagtccctgggtggagagaaggcagagatagttcattttacctaggaatgggtttctagaggagagggagcttggtgggagcccaggaaagtgaaaaggtgtttttcaggtggacaagggtgatatgtagttaggcagaaggaaatacagatgaagggagaaatatgagcagagggaaaagaaaaggagatgtgaaacaacatccatagcaaatggtttggtttacctggagcacctgctttgttcagaggcatgtccaagattgcag

SEQ ID NO: 117482 - DNA, 601 bp, Human
caggaaagtgaaaaggtgtttttcaggtggacaagggtgatatgtagttaggcagaaggaaatacagatgaagggagaaatatgagcagagggaaaagaaaaggagatgtgaaacaacatccatagcaaatggtttggtttacctggagcacctgctttgttcagaggcatgtccaagattgcagttgaagaggtgtctgtgggttagatcaggaagtggttttcatgcttgccttgggaaattgaactcttaatagtaaccacatgttgatggctaaacacagttaaaaggatattgaaycattcatccattatttgagtaaacatttattgggtacttacgtgctagcacgctgaaaaatgtgggtagaaataatacaaattccctcctccaagaagcctgcagtctatcaaatatgtaacagcagtcaggccctgacttctacgttaacttgtaagacacaaaaacaaaaatgaagcaaactgaaagcaatcggtcatcttctactcagcatacccagagtgggctgatagtgacagagtaggcaatgatgagggatgtgaggaaaggaggaattactgtgaagggaggatacataac

SEQ ID NO: 117483 - DNA, 601 bp, Human
ttgaactcttaatagtaaccacatgttgatggctaaacacagttaaaaggatattgaaccattcatccattatttgagtaaacatttattgggtacttacgtgctagcacgctgaaaaatgtgggtagaaataatacaaattccctcctccaagaagcctgcagtctatcaaatatgtaacagcagtcaggccctgacttctacgttaacttgtaagacacaaaaacaaaaatgaagcaaactgaaagcaatcggtcatcttctactcagcatacccagagtgggctgatagtgacagagyaggcaatgatgagggatgtgaggaaaggaggaattactgtgaagggaggatacataactccaggagctcttcctggagaaagtggctcagaggataaattctgcaatgcaaagagaagaatatgttttcaatgcacacatttttatgttcttaaatatctgttgcatttcccccccacgactcaggtctaaaaaagcttcccatctctgacattaagtgaccactccaactttatagtcctcccacatcctccacctaactaacctttcttgaacacctacattttgccaggcactttta

SEQ ID NO: 117484 - DNA, 601 bp, Human
cagaggataaattctgcaatgcaaagagaagaatatgttttcaatgcacacatttttatgttcttaaatatctgttgcatttcccccccacgactcaggtctaaaaaagcttcccatctctgacattaagtgaccactccaactttatagtcctcccacatcctccacctaactaacctttcttgaacacctacattttgccaggcacttttataagcatttagttatagtattccatttacccactaacttgtaagatctgtttcataaacaccatcttgcagatgagacaactgaaacyagaaagtgttaggttgctgcaaaagtaattgtggttttgcattattggaatttgccatttgatattgaaatacattcttaaataaatgtggttatgttatacatcattttaatgggcatttcttgcttttattttttgctaatgacattacttgctgtttattttatgtttattttagactgtagaaatgatgttagacaaaaagcaaattcgagcaatttttttatacaagtttaaaatggtcataaagcagcacagacggttcacaacatcaacagcacatttggcccaggaactgct

SEQ ID NO: 117485 - DNA, 601 bp, Human
gtaagatctgtttcataaacaccatcttgcagatgagacaactgaaaccagaaagtgttaggttgctgcaaaagtaattgtggttttgcattattggaatttgccatttgatattgaaatacattcttaaataaatgtggttatgttatacatcattttaatgggcatttcttgcttttattttttgctaatgacattacttgctgtttattttatgtttattttagactgtagaaatgatgttagacaaaaagcaaattcgagcaatttttttatacaagtttaaaatggtcataaagcwgcacagacggttcacaacatcaacagcacatttggcccaggaactgctaacaaacgtacagtgcaatgatggttcaagaagttttgcaaaggagacaagagctttgatgatgaggagcatagtggctggccattggaagttggcaatggccagttgagagcaatcattgaagctgatcctcttacaactacatgagaatttgccaaagaactcaatattgaccattctacagtcactcagcatttgaagtaaattggaaaggttaaaaaacttgctaagtgggccgggcgtggtggctca

SEQ ID NO: 117486 - DNA, 601 bp, Human
gatctgtttcataaacaccatcttgcagatgagacaactgaaaccagaaagtgttaggttgctgcaaaagtaattgtggttttgcattattggaatttgccatttgatattgaaatacattcttaaataaatgtggttatgttatacatcattttaatgggcatttcttgcttttattttttgctaatgacattacttgctgtttattttatgtttattttagactgtagaaatgatgttagacaaaaagcaaattcgagcaatttttttatacaagtttaaaatggtcataaagcagcasagacggttcacaacatcaacagcacatttggcccaggaactgctaacaaacgtacagtgcaatgatggttcaagaagttttgcaaaggagacaagagctttgatgatgaggagcatagtggctggccattggaagttggcaatggccagttgagagcaatcattgaagctgatcctcttacaactacatgagaatttgccaaagaactcaatattgaccattctacagtcactcagcatttgaagtaaattggaaaggttaaaaaacttgctaagtgggccgggcgtggtggctcacgcc

SEQ ID NO: 117487 - DNA, 601 bp, Human
accatcttgcagatgagacaactgaaaccagaaagtgttaggttgctgcaaaagtaattgtggttttgcattattggaatttgccatttgatattgaaatacattcttaaataaatgtggttatgttatacatcattttaatgggcatttcttgcttttattttttgctaatgacattacttgctgtttattttatgtttattttagactgtagaaatgatgttagacaaaaagcaaattcgagcaatttttttatacaagtttaaaatggtcataaagcagcacagacggttcacaacawcaacagcacatttggcccaggaactgctaacaaacgtacagtgcaatgatggttcaagaagttttgcaaaggagacaagagctttgatgatgaggagcatagtggctggccattggaagttggcaatggccagttgagagcaatcattgaagctgatcctcttacaactacatgagaatttgccaaagaactcaatattgaccattctacagtcactcagcatttgaagtaaattggaaaggttaaaaaacttgctaagtgggccgggcgtggtggctcacgcctgtaatcccagcacgt

SEQ ID NO: 117488 - DNA, 601 bp, Human
cttgctgtttattttatgtttattttagactgtagaaatgatgttagacaaaaagcaaattcgagcaatttttttatacaagtttaaaatggtcataaagcagcacagacggttcacaacatcaacagcacatttggcccaggaactgctaacaaacgtacagtgcaatgatggttcaagaagttttgcaaaggagacaagagctttgatgatgaggagcatagtggctggccattggaagttggcaatggccagttgagagcaatcattgaagctgatcctcttacaactacatgagaakttgccaaagaactcaatattgaccattctacagtcactcagcatttgaagtaaattggaaaggttaaaaaacttgctaagtgggccgggcgtggtggctcacgcctgtaatcccagcacgttgggaggccgaggcgggcggatcacgaggtcaggagatcgagaccattctggctaacaggatgaaaccccatctctactaaaaatacaaaaaattagccgggcgcggtggtgggcgcctgtagtcccagctacttgggaggctgaggcaggagaatggcgtgaacccgggaggcggagc

SEQ ID NO: 117489 - DNA, 601 bp, Human
aagttttgcaaaggagacaagagctttgatgatgaggagcatagtggctggccattggaagttggcaatggccagttgagagcaatcattgaagctgatcctcttacaactacatgagaatttgccaaagaactcaatattgaccattctacagtcactcagcatttgaagtaaattggaaaggttaaaaaacttgctaagtgggccgggcgtggtggctcacgcctgtaatcccagcacgttgggaggccgaggcgggcggatcacgaggtcaggagatcgagaccattctggctaacasgatgaaaccccatctctactaaaaatacaaaaaattagccgggcgcggtggtgggcgcctgtagtcccagctacttgggaggctgaggcaggagaatggcgtgaacccgggaggcggagcttgcagtgagccgagatcgcgccaccgcactccagcctgggcgacagagcgagactccggctcaaaaacaaacaaacaaacaaacaaacaaacaaaaaaaaaacaaaaattgctaagtgggtgcctcatgagctgagtgaaaattaaaaaatagtcatttttgaagtgccgtcttctctt

SEQ ID NO: 117490 - DNA, 601 bp, Human
ggagacaagagctttgatgatgaggagcatagtggctggccattggaagttggcaatggccagttgagagcaatcattgaagctgatcctcttacaactacatgagaatttgccaaagaactcaatattgaccattctacagtcactcagcatttgaagtaaattggaaaggttaaaaaacttgctaagtgggccgggcgtggtggctcacgcctgtaatcccagcacgttgggaggccgaggcgggcggatcacgaggtcaggagatcgagaccattctggctaacaggatgaaaccccrtctctactaaaaatacaaaaaattagccgggcgcggtggtgggcgcctgtagtcccagctacttgggaggctgaggcaggagaatggcgtgaacccgggaggcggagcttgcagtgagccgagatcgcgccaccgcactccagcctgggcgacagagcgagactccggctcaaaaacaaacaaacaaacaaacaaacaaacaaaaaaaaaacaaaaattgctaagtgggtgcctcatgagctgagtgaaaattaaaaaatagtcatttttgaagtgccgtcttctcttattctacgcaac

SEQ ID NO: 117491 - DNA, 601 bp, Human
aaaacttgctaagtgggccgggcgtggtggctcacgcctgtaatcccagcacgttgggaggccgaggcgggcggatcacgaggtcaggagatcgagaccattctggctaacaggatgaaaccccatctctactaaaaatacaaaaaattagccgggcgcggtggtgggcgcctgtagtcccagctacttgggaggctgaggcaggagaatggcgtgaacccgggaggcggagcttgcagtgagccgagatcgcgccaccgcactccagcctgggcgacagagcgagactccggctcaaaawcaaacaaacaaacaaacaaacaaacaaaaaaaaaacaaaaattgctaagtgggtgcctcatgagctgagtgaaaattaaaaaatagtcatttttgaagtgccgtcttctcttattctacgcaacaaaccatttctcaattagattgtgacatgtgatgaaacgtggattttataccacaaccagtgaagactagctcagtggtttgactgagaagaagctccaaagcacttctcaaagccaaacttgcaccaaaaaaaaaatcatggtcaccagttggtggccggctgccagtctgatcc

SEQ ID NO: 117492 - DNA, 601 bp, Human
atcccagcacgttgggaggccgaggcgggcggatcacgaggtcaggagatcgagaccattctggctaacaggatgaaaccccatctctactaaaaatacaaaaaattagccgggcgcggtggtgggcgcctgtagtcccagctacttgggaggctgaggcaggagaatggcgtgaacccgggaggcggagcttgcagtgagccgagatcgcgccaccgcactccagcctgggcgacagagcgagactccggctcaaaaacaaacaaacaaacaaacaaacaaacaaaaaaaaaacaaaaactgctaagtgggtgcctcatgagctgagtgaaaattaaaaaatagtcatttttgaagtgccgtcttctcttattctacgcaacaaaccatttctcaattagattgtgacatgtgatgaaacgtggattttataccacaaccagtgaagactagctcagtggtttgactgagaagaagctccaaagcacttctcaaagccaaacttgcaccaaaaaaaaaatcatggtcaccagttggtggccggctgccagtctgatccactacagctttcttaatctgggtgaaagtattacatctgaga

SEQ ID NO: 117493 - DNA, 601 bp, Human
cgaggtcaggagatcgagaccattctggctaacaggatgaaaccccatctctactaaaaatacaaaaaattagccgggcgcggtggtgggcgcctgtagtcccagctacttgggaggctgaggcaggagaatggcgtgaacccgggaggcggagcttgcagtgagccgagatcgcgccaccgcactccagcctgggcgacagagcgagactccggctcaaaaacaaacaaacaaacaaacaaacaaacaaaaaaaaaacaaaaattgctaagtgggtgcctcatgagctgagtgaaaattwaaaaatagtcatttttgaagtgccgtcttctcttattctacgcaacaaaccatttctcaattagattgtgacatgtgatgaaacgtggattttataccacaaccagtgaagactagctcagtggtttgactgagaagaagctccaaagcacttctcaaagccaaacttgcaccaaaaaaaaaatcatggtcaccagttggtggccggctgccagtctgatccactacagctttcttaatctgggtgaaagtattacatctgagaagtatgctcagcaaatcgatgagatgcaccaaaaac

SEQ ID NO: 117494 - DNA, 601 bp, Human
gaaaaatgctttccaagagtttattgaatcccaaagcatagatttctactctacaggaataagcaaacttattcctcattggcaaaaatatgtctattgtaatggttcctattttgattaataaagatgtgtttgaccctagctataatgatttaaaattcgtggtccaaaaccacagttctttttgtaccaaccaatacagcaaaaatgtgttttcataaatgttctacaacaaaatctaagaactttccagtatattgtatggtataacacactttctagttcagatgtctgcaaactaaaaaaaaatgtgatgatcaaaaccattgaatgctagcaaagggattacccaatacttgtcatctcacagctattcattattgccaggaagttctcagacttcatgcaaaccttaccccctcatctttcacattaggaaactgaggcccagggaaattcagcactggctcagtgtgatggagagtgtttgtagccaggccagaagtgagatccaggtttatagttcctcttcttatgatcttctcactaacgtttatagttctaatgctagattctgattcttctcattttatgttctcct

SEQ ID NO: 117495 - DNA, 601 bp, Human
tctcattttatgttctccttgcagtttgtaaggtgtgttgggaagggtataggttttgaagccatttggatctcggtccaggttagagatctaccactgatttactctgtggccaagaacgagcttcctcctgggtttcaatgtcctgtcaaatggggtaaaacaatctctctctagtaggtttgtgataagtgttaaaaaaagtcacgtatagagtaactaggacagagttcaacatataatccgacctaatacatgttcgtttttcaacttcccttgctaggagatggaaggaaggtgaaatctgccacgatcgctactttcaaagaatgtgaactctctttgctccctgcaccccaacaaagatttctctcttatcactgtgactgtgttatcagagggggataacatagtggttggaaacacttcctcagactggagagactggctaggatttgaagaatgcctccctagggtctctatgtcagtaacactttatgttcaccagtggagcacaccagttactttctggatagataaaacaattccattacttacctgtgcacaaaatgatttccgtctttgtcagggctgaggtgct

SEQ ID NO: 117496 - DNA, 601 bp, Human
tgttctccttgcagtttgtaaggtgtgttgggaagggtataggttttgaagccatttggatctcggtccaggttagagatctaccactgatttactctgtggccaagaacgagcttcctcctgggtttcaatgtcctgtcaaatggggtaaaacaatctctctctagtaggtttgtgataagtgttaaaaaaagtcacgtatagagtaactaggacagagttcaacatataatccgacctaatacatgttcgtttttcaacttcccttgctaggagatggaaggaaggtgaaatctgccaygatcgctactttcaaagaatgtgaactctctttgctccctgcaccccaacaaagatttctctcttatcactgtgactgtgttatcagagggggataacatagtggttggaaacacttcctcagactggagagactggctaggatttgaagaatgcctccctagggtctctatgtcagtaacactttatgttcaccagtggagcacaccagttactttctggatagataaaacaattccattacttacctgtgcacaaaatgatttccgtctttgtcagggctgaggtgctagttttatga

SEQ ID NO: 117497 - DNA, 601 bp, Human
acatgttcgtttttcaacttcccttgctaggagatggaaggaaggtgaaatctgccacgatcgctactttcaaagaatgtgaactctctttgctccctgcaccccaacaaagatttctctcttatcactgtgactgtgttatcagagggggataacatagtggttggaaacacttcctcagactggagagactggctaggatttgaagaatgcctccctagggtctctatgtcagtaacactttatgttcaccagtggagcacaccagttactttctggatagataaaacaattccattayttacctgtgcacaaaatgatttccgtctttgtcagggctgaggtgctagttttatgacataagggaggactctgattcgagactgctctttagtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaa

SEQ ID NO: 117498 - DNA, 601 bp, Human
gatcgctactttcaaagaatgtgaactctctttgctccctgcaccccaacaaagatttctctcttatcactgtgactgtgttatcagagggggataacatagtggttggaaacacttcctcagactggagagactggctaggatttgaagaatgcctccctagggtctctatgtcagtaacactttatgttcaccagtggagcacaccagttactttctggatagataaaacaattccattacttacctgtgcacaaaatgatttccgtctttgtcagggctgaggtgctagttttatgayataagggaggactctgattcgagactgctctttagtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctct

SEQ ID NO: 117499 - DNA, 601 bp, Human
agactgctctttagtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctctctccctctgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaa

SEQ ID NO: 117500 - DNA, 601 bp, Human
tctttagtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctctctccctctgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaata

SEQ ID NO: 117501 - DNA, 601 bp, Human
tagtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctctctscctctgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatata

SEQ ID NO: 117502 - DNA, 601 bp, Human
agtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctctctcyctctgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatat

SEQ ID NO: 117503 - DNA, 601 bp, Human
gtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctctctccstctgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatata

SEQ ID NO: 117504 - DNA, 601 bp, Human
ctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctctctccctstgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatataga

SEQ ID NO: 117505 - DNA, 601 bp, Human
tcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctctctccctctgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatatagac

SEQ ID NO: 117506 - DNA, 601 bp, Human
ctctctctctccctctgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaayacaatatatatagacacaagtaatatctattttttttcttttcatgtacttctaacagtccacttttaagtgctcccatgaggcttttcttgatttgctttatttttcttttaaataaaatcttaagctgcccactccagtgatgaggtactacctagtcctagtaagagattgcagtgggatcgaatgggacaaaaacaaagaccatgaagcagtaagtacttcctaattattcaaagaaggcatgtggagcacttgccatgtggcagacacagtgctgggagctgaaattagaacagg

SEQ ID NO: 117507 - DNA, 601 bp, Human
gtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatatagacacaagtaayatctattttttttcttttcatgtacttctaacagtccacttttaagtgctcccatgaggcttttcttgatttgctttatttttcttttaaataaaatcttaagctgcccactccagtgatgaggtactacctagtcctagtaagagattgcagtgggatcgaatgggacaaaaacaaagaccatgaagcagtaagtacttcctaattattcaaagaaggcatgtggagcacttgccatgtggcagacacagtgctgggagctgaaattagaacagggggaaaaaagaaaagacatactac

SEQ ID NO: 117508 - DNA, 601 bp, Human
ttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatatagacacaagtaatatctattttttttcttttcatrtacttctaacagtccacttttaagtgctcccatgaggcttttcttgatttgctttatttttcttttaaataaaatcttaagctgcccactccagtgatgaggtactacctagtcctagtaagagattgcagtgggatcgaatgggacaaaaacaaagaccatgaagcagtaagtacttcctaattattcaaagaaggcatgtggagcacttgccatgtggcagacacagtgctgggagctgaaattagaacagggggaaaaaagaaaagacatactacttgcccatacagtgctagcttc

SEQ ID NO: 117509 - DNA, 601 bp, Human
tcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatatagacacaagtaatatctattttttttcttttcatgtacttctaacrgtccacttttaagtgctcccatgaggcttttcttgatttgctttatttttcttttaaataaaatcttaagctgcccactccagtgatgaggtactacctagtcctagtaagagattgcagtgggatcgaatgggacaaaaacaaagaccatgaagcagtaagtacttcctaattattcaaagaaggcatgtggagcacttgccatgtggcagacacagtgctgggagctgaaattagaacagggggaaaaaagaaaagacatactacttgcccatacagtgctagcttcttagaaatttt

SEQ ID NO: 117510 - DNA, 601 bp, Human
ctccagtgatgaggtactacctagtcctagtaagagattgcagtgggatcgaatgggacaaaaacaaagaccatgaagcagtaagtacttcctaattattcaaagaaggcatgtggagcacttgccatgtggcagacacagtgctgggagctgaaattagaacagggggaaaaaagaaaagacatactacttgcccatacagtgctagcttcttagaaatttttggctgaatttatgaatgagagtattttttcatttataaaatgtaaataaaagcaaccatgtactagggcagttgtgrgagttaaattacatgtatgcatgaatatgagtaaatatggcaaactggttaggaggtcaggctctgaagtcagaatgcctgagtttgaatcccagatctaagcactgaactctttttgcctcaagtttctcttcagtgaagtgagtgatatggtttggctttgtgtcctcacccaaatctcatctctaattgtaatctccatgtgttgagggagggacctgtaatcctcatgtgttgagggagggaggtgattggatcatgggggcagtttcccccatgctgttcttatgatagtgagtg

SEQ ID NO: 117511 - DNA, 601 bp, Human
gataatttatgaaaagcacttagtgctaagcacagagtaaatgctcaataatggtagttcttgggtacatagtagatgctcagttagattttgttactaattcactgaagccagaagaagacagaattttgcaatgtaagtagaactgaacgtgtttttatatgtgtagcttttctaagataattatgtttgagaggtgttgtttccagtagaactctttaaatattattacacagctcttgggaacttgggaaaattttactcattattccaatacatctccctgaagactgatttccaccccccacaagtttccatgttcttcatgggtctggaatttagtcagagagacaggctacttttctctaacccaagccttctccttgggtgattaagcacgtagtttcatgggaagtttaagaccaaagaattatggcattgtcatgtcaggcactcaagtgtcagggatttggcttaagtgaattgattactggaaacccttgaaacttgttatctttaagttgcttccagcccctgtgaccagaaatgcatggcgactcccaataacatctgcctttcttacaatcccgcccataccagt

SEQ ID NO: 117512 - DNA, 601 bp, Human
gatggacaagtcatctcgcatggataagcaagcattcatcccagggaacagactaaataaggaaggcctatgcccagcccaaagaaatgcagagatggacaagtcatctcgcatggataggcaatagaatggaatgtgtgtatttaagccccagagacaatggcgttccaaccttgcctttgtccctaccacctatggactttcatctttttgagactaagtttctttatagggaagatgtgatttttaacatccctgcgtggagttgttgtgaatatataatagctttatgtataatgcrtttatatataaaattctcagcacagggctatatacttcttctgggatactcagaaaagatcatttaagataagaagccatcctaaatttggatgttttctaatataccactgagaataactatatttattgaatgcttatattgtgttatgtgctgttctaagatttatagtgaccgtggatttaatcctgccaaagaccctataagatagtgaattctgttattctcactttacaaagaagaaaacagaagcctggtggaaatatgtatgaatttgcatgaagatgtatggccagaggt

SEQ ID NO: 117513 - DNA, 601 bp, Human
tgttgtgaatatataatagctttatgtataatgcatttatatataaaattctcagcacagggctatatacttcttctgggatactcagaaaagatcatttaagataagaagccatcctaaatttggatgttttctaatataccactgagaataactatatttattgaatgcttatattgtgttatgtgctgttctaagatttatagtgaccgtggatttaatcctgccaaagaccctataagatagtgaattctgttattctcactttacaaagaagaaaacagaagcctggtggaaatawgtatgaatttgcatgaagatgtatggccagaggtggtggagttgggactcaaacccaggctgtctgggattgaaatgctttcctatattgctgaaaaaaaaaaaaatggctgtacagtaaataaaatatcacagtgtcatgtatgaagtcagtggttctggcaaccctgatctaatgctgcagtggtcataaactgaactcagggaagttggaagttgagttttgaaacaactttaaatcatcttatttagccccttaatactcacatcagaaataatcttattttgtgtacattgttag

SEQ ID NO: 117514 - DNA, 601 bp, Human
atgtgctgttctaagatttatagtgaccgtggatttaatcctgccaaagaccctataagatagtgaattctgttattctcactttacaaagaagaaaacagaagcctggtggaaatatgtatgaatttgcatgaagatgtatggccagaggtggtggagttgggactcaaacccaggctgtctgggattgaaatgctttcctatattgctgaaaaaaaaaaaaatggctgtacagtaaataaaatatcacagtgtcatgtatgaagtcagtggttctggcaaccctgatctaatgctgcattggtcataaactgaactcagggaagttggaagttgagttttgaaacaactttaaatcatcttatttagccccttaatactcacatcagaaataatcttattttgtgtacattgttagacaattaccaataacctaactacggttttgtctaagacactgatttgacttagttgtctggaagatttagttgtctggaaatacattgtgatattgcataaacttttaaaaaatctagttaagtatcgccttttacacacaaagaaaaacagttttgtttaaggtgaagagacttgctgaaat

SEQ ID NO: 117515 - DNA, 601 bp, Human
tatcacagtgtcatgtatgaagtcagtggttctggcaaccctgatctaatgctgcagtggtcataaactgaactcagggaagttggaagttgagttttgaaacaactttaaatcatcttatttagccccttaatactcacatcagaaataatcttattttgtgtacattgttagacaattaccaataacctaactacggttttgtctaagacactgatttgacttagttgtctggaagatttagttgtctggaaatacattgtgatattgcataaacttttaaaaaatctagttaagtatygccttttacacacaaagaaaaacagttttgtttaaggtgaagagacttgctgaaatgtttgtaatcagtccatgaaactgatttcctaacaaagatatttggtgccatggagtttgaaaaacagggaagaattttcaggtatgatgcagtcttcatcactgaactcattgtactgtttagttatatgtaacagaaagaagtcaaacttgcttagaaaatgaaggggaatttatttatggttgtatccaaaatttcagaggtaggaggaactttatgtacagctcacatcagtgactcaag

SEQ ID NO: 117516 - DNA, 601 bp, Human
gtctggaaatacattgtgatattgcataaacttttaaaaaatctagttaagtatcgccttttacacacaaagaaaaacagttttgtttaaggtgaagagacttgctgaaatgtttgtaatcagtccatgaaactgatttcctaacaaagatatttggtgccatggagtttgaaaaacagggaagaattttcaggtatgatgcagtcttcatcactgaactcattgtactgtttagttatatgtaacagaaagaagtcaaacttgcttagaaaatgaaggggaatttatttatggttgtatmcaaaatttcagaggtaggaggaactttatgtacagctcacatcagtgactcaagattattaccaaaagactattttgtctttttcttctttgttttctatccttttgttatcatattagaatataaggtggctatactagccagatactccaggtcaacatgcttattcacaggcagtgatcgaaagaacatcgctggggatcagtcaaaactgcctgaaatgggtatccaagaatggtagcaggtcatttctcctaaggaaatttgtggaactattatccttaagaaagggaaatggag

SEQ ID NO: 117517 - DNA, 601 bp, Human
tatggttgtatccaaaatttcagaggtaggaggaactttatgtacagctcacatcagtgactcaagattattaccaaaagactattttgtctttttcttctttgttttctatccttttgttatcatattagaatataaggtggctatactagccagatactccaggtcaacatgcttattcacaggcagtgatcgaaagaacatcgctggggatcagtcaaaactgcctgaaatgggtatccaagaatggtagcaggtcatttctcctaaggaaatttgtggaactattatccttaagaargggaaatggaggtaaacagtaaaccaaggtgtacactgaaatctctttctaggagaaaagagtccacattcaaaagtcccaagcattgtctgagcaatgttatgtgacttcaataaacatttgcaactttgtatttattggattcatcggtggtcacttagcatgactgaatgacctgtccataaatatctgaaggtcattctcagatcttagaggaatattaaagtgtgaatgttttatttctaagattgggaaactgatgctccaggagagaaagtaacttgtctaaattctccagac

SEQ ID NO: 117518 - DNA, 601 bp, Human
aactgcctgaaatgggtatccaagaatggtagcaggtcatttctcctaaggaaatttgtggaactattatccttaagaaagggaaatggaggtaaacagtaaaccaaggtgtacactgaaatctctttctaggagaaaagagtccacattcaaaagtcccaagcattgtctgagcaatgttatgtgacttcaataaacatttgcaactttgtatttattggattcatcggtggtcacttagcatgactgaatgacctgtccataaatatctgaaggtcattctcagatcttagaggaataytaaagtgtgaatgttttatttctaagattgggaaactgatgctccaggagagaaagtaacttgtctaaattctccagacctgtaaacacaaagccggcatgagaacccactctttcttactgtctctctgaagtacatagagataaacaaaagaaatttcaactaatcatgacaagtaccaaattattcaagagattacccaaacaacttagctaattctgatggttttaaacactaaatcacaaatgaggcaagacaggagaatgtcagaggtgcacacataacatgttaggcatgcat

SEQ ID NO: 117519 - DNA, 601 bp, Human
aggagaaaagagtccacattcaaaagtcccaagcattgtctgagcaatgttatgtgacttcaataaacatttgcaactttgtatttattggattcatcggtggtcacttagcatgactgaatgacctgtccataaatatctgaaggtcattctcagatcttagaggaatattaaagtgtgaatgttttatttctaagattgggaaactgatgctccaggagagaaagtaacttgtctaaattctccagacctgtaaacacaaagccggcatgagaacccactctttcttactgtctctctkaagtacatagagataaacaaaagaaatttcaactaatcatgacaagtaccaaattattcaagagattacccaaacaacttagctaattctgatggttttaaacactaaatcacaaatgaggcaagacaggagaatgtcagaggtgcacacataacatgttaggcatgcatgggagcagtagcatgtttgcgttattatttgtttacatggcttagtatctaagggacatgaagtattgtcatttatcagagactaggtctcaagtttgactctggtttaagttttccataatctgctcag

SEQ ID NO: 117520 - DNA, 601 bp, Human
agtccacattcaaaagtcccaagcattgtctgagcaatgttatgtgacttcaataaacatttgcaactttgtatttattggattcatcggtggtcacttagcatgactgaatgacctgtccataaatatctgaaggtcattctcagatcttagaggaatattaaagtgtgaatgttttatttctaagattgggaaactgatgctccaggagagaaagtaacttgtctaaattctccagacctgtaaacacaaagccggcatgagaacccactctttcttactgtctctctgaagtacatasagataaacaaaagaaatttcaactaatcatgacaagtaccaaattattcaagagattacccaaacaacttagctaattctgatggttttaaacactaaatcacaaatgaggcaagacaggagaatgtcagaggtgcacacataacatgttaggcatgcatgggagcagtagcatgtttgcgttattatttgtttacatggcttagtatctaagggacatgaagtattgtcatttatcagagactaggtctcaagtttgactctggtttaagttttccataatctgctcagtacatttctt

SEQ ID NO: 117521 - DNA, 601 bp, Human
attgggaaactgatgctccaggagagaaagtaacttgtctaaattctccagacctgtaaacacaaagccggcatgagaacccactctttcttactgtctctctgaagtacatagagataaacaaaagaaatttcaactaatcatgacaagtaccaaattattcaagagattacccaaacaacttagctaattctgatggttttaaacactaaatcacaaatgaggcaagacaggagaatgtcagaggtgcacacataacatgttaggcatgcatgggagcagtagcatgtttgcgttattrtttgtttacatggcttagtatctaagggacatgaagtattgtcatttatcagagactaggtctcaagtttgactctggtttaagttttccataatctgctcagtacatttcttcatttaggcagctctttcacaacggtaaaagcatcaggtgacaacttccatctggctggtcccaagttacttttcatgtaattcatccttttaataagctatctcctgacatattgggtccatcttgacaagccatgtttttttttgtgagacatcattctaattatcttaatatcttagaaggaag

SEQ ID NO: 117522 - DNA, 601 bp, Human
tctttcttactgtctctctgaagtacatagagataaacaaaagaaatttcaactaatcatgacaagtaccaaattattcaagagattacccaaacaacttagctaattctgatggttttaaacactaaatcacaaatgaggcaagacaggagaatgtcagaggtgcacacataacatgttaggcatgcatgggagcagtagcatgtttgcgttattatttgtttacatggcttagtatctaagggacatgaagtattgtcatttatcagagactaggtctcaagtttgactctggtttaasttttccataatctgctcagtacatttcttcatttaggcagctctttcacaacggtaaaagcatcaggtgacaacttccatctggctggtcccaagttacttttcatgtaattcatccttttaataagctatctcctgacatattgggtccatcttgacaagccatgtttttttttgtgagacatcattctaattatcttaatatcttagaaggaagaactccataattatcttttatgggaaggctcgagacacacatttgaaattgtatgcccaggactttatgtgcagaagaatcaag

SEQ ID NO: 117523 - DNA, 601 bp, Human
gaagtacatagagataaacaaaagaaatttcaactaatcatgacaagtaccaaattattcaagagattacccaaacaacttagctaattctgatggttttaaacactaaatcacaaatgaggcaagacaggagaatgtcagaggtgcacacataacatgttaggcatgcatgggagcagtagcatgtttgcgttattatttgtttacatggcttagtatctaagggacatgaagtattgtcatttatcagagactaggtctcaagtttgactctggtttaagttttccataatctgctcastacatttcttcatttaggcagctctttcacaacggtaaaagcatcaggtgacaacttccatctggctggtcccaagttacttttcatgtaattcatccttttaataagctatctcctgacatattgggtccatcttgacaagccatgtttttttttgtgagacatcattctaattatcttaatatcttagaaggaagaactccataattatcttttatgggaaggctcgagacacacatttgaaattgtatgcccaggactttatgtgcagaagaatcaaggtatagtattatccagtgt

SEQ ID NO: 117524 - DNA, 601 bp, Human
aaacttgcttgtcttgtatcatcggaagatggtatgaattaaggctttctcattccagtcacagtacagattgcagctgaaaaacatctaaagggattcaagtgaccaagaacattgaacagaaaaaccataacaaacagtccctgcctttggggagtccctatgctatttgatacaacagaaaatgtaccatatgttaaaatttaagacagaccaaatatcaatcccttcctccaaataaatcaagctgtcagtagataagacctcctgcctctaaacttgactcctccagttcccaccrcaatgatcccgatctcttactacttttgcaatcaaacaacttcaatagattttcattgctttaatgatcaagttcaaatgccttaaaacagtggtccccaacctttttggcaccagggaccatgtttgtggaaaacaatttttccatggactgaggggggcaggatggtttcagaatgattcaagtgcattacacttctcatgtactttatttctattattattacattgttcattaatatataattaatatataatgaaataattatacaactctccaccatgtagaatcagtgggagc

SEQ ID NO: 117525 - DNA, 601 bp, Human
atgtttgtggaaaacaatttttccatggactgaggggggcaggatggtttcagaatgattcaagtgcattacacttctcatgtactttatttctattattattacattgttcattaatatataattaatatataatgaaataattatacaactctccaccatgtagaatcagtgggagccttgagcttgttttcctgcaactaggtggtcccatgtggaggtgatgggagacagtgacagattctcatacagagcacgctacctagatccctcacatacacagtccacaatagcgttcgtrcttctatgagaatctaatgctcaggctgtaatgcagcaagggggagtggctgtaaatacagatgaagcttcactctcttgcccactgctcacctcctgttttatggcccagttccacatggaccactatcagtctgtgggccaggggtgggggatccttcaaagatacacagtgcctcccctaccctcatctcttaatgttctttaaggcccctttttaccatcatacaaaaaatgacttaattttctgttacatgctaaacttattcacatagctaaacttttgaaaatactatttctt

SEQ ID NO: 117526 - DNA, 601 bp, Human
tttgtggaaaacaatttttccatggactgaggggggcaggatggtttcagaatgattcaagtgcattacacttctcatgtactttatttctattattattacattgttcattaatatataattaatatataatgaaataattatacaactctccaccatgtagaatcagtgggagccttgagcttgttttcctgcaactaggtggtcccatgtggaggtgatgggagacagtgacagattctcatacagagcacgctacctagatccctcacatacacagtccacaatagcgttcgtactyctatgagaatctaatgctcaggctgtaatgcagcaagggggagtggctgtaaatacagatgaagcttcactctcttgcccactgctcacctcctgttttatggcccagttccacatggaccactatcagtctgtgggccaggggtgggggatccttcaaagatacacagtgcctcccctaccctcatctcttaatgttctttaaggcccctttttaccatcatacaaaaaatgacttaattttctgttacatgctaaacttattcacatagctaaacttttgaaaatactatttcttcag

SEQ ID NO: 117527 - DNA, 601 bp, Human
cttctcatgtactttatttctattattattacattgttcattaatatataattaatatataatgaaataattatacaactctccaccatgtagaatcagtgggagccttgagcttgttttcctgcaactaggtggtcccatgtggaggtgatgggagacagtgacagattctcatacagagcacgctacctagatccctcacatacacagtccacaatagcgttcgtacttctatgagaatctaatgctcaggctgtaatgcagcaagggggagtggctgtaaatacagatgaagcttcaytctcttgcccactgctcacctcctgttttatggcccagttccacatggaccactatcagtctgtgggccaggggtgggggatccttcaaagatacacagtgcctcccctaccctcatctcttaatgttctttaaggcccctttttaccatcatacaaaaaatgacttaattttctgttacatgctaaacttattcacatagctaaacttttgaaaatactatttcttcagtctggaatgttctactctagtagtccaagtaataaaatcaccctttatgatgtagcttaattattgaaat

SEQ ID NO: 117528 - DNA, 601 bp, Human
ctaccctcatctcttaatgttctttaaggcccctttttaccatcatacaaaaaatgacttaattttctgttacatgctaaacttattcacatagctaaacttttgaaaatactatttcttcagtctggaatgttctactctagtagtccaagtaataaaatcaccctttatgatgtagcttaattattgaaatctttgagaagggtgaattttatggcatatgaaatatatcttaataacgatgctattaaaaacaacaaaacattgatgactcttttataagaaacttccctctcttaaytcattctaccatacagtcaggtacctgaaagcagatattaacacgtatacatgtacatgcacacgatactaggttagggaccaatttttttctcccttaaaaccctgcatacctacctattaactgtgtttataggtttacttgtttattttccatctagacttggagcctttaatgtggtagccattaatagcacgtggctgttgagctcttgaaagatggctagtccaaaatgagatatgctggaaatgtaaaattcacacacaacatttcaaagtcttgttatgaaacaatgtagac

SEQ ID NO: 117529 - DNA, 601 bp, Human
tacaaaaaatgacttaattttctgttacatgctaaacttattcacatagctaaacttttgaaaatactatttcttcagtctggaatgttctactctagtagtccaagtaataaaatcaccctttatgatgtagcttaattattgaaatctttgagaagggtgaattttatggcatatgaaatatatcttaataacgatgctattaaaaacaacaaaacattgatgactcttttataagaaacttccctctcttaattcattctaccatacagtcaggtacctgaaagcagatattaacacrtatacatgtacatgcacacgatactaggttagggaccaatttttttctcccttaaaaccctgcatacctacctattaactgtgtttataggtttacttgtttattttccatctagacttggagcctttaatgtggtagccattaatagcacgtggctgttgagctcttgaaagatggctagtccaaaatgagatatgctggaaatgtaaaattcacacacaacatttcaaagtcttgttatgaaacaatgtagactgtctcattagtagttttatagtgattacctattgaaattaatat

SEQ ID NO: 117530 - DNA, 601 bp, Human
atgtggtagccattaatagcacgtggctgttgagctcttgaaagatggctagtccaaaatgagatatgctggaaatgtaaaattcacacacaacatttcaaagtcttgttatgaaacaatgtagactgtctcattagtagttttatagtgattacctattgaaattaatatatacattgggctaagtgaaaatgttattaaaattaatttcattttttctctttattttttaaaatgtgtctacatgaaaatttaaatttatgtatagggctcattttatttcatttggacaacactgatytagaccgtgagatacttaaaggtagggacagtgttttattcatctctgcatatagagtcaggcctgtggtaggtgctcaaggacttctctgcatgagataagtgactgaatattaagtcccaaatgaacagtgcagacactgagaacaatgggactacaagggagaggaaatgaacactatttccatacaagtccaggaaaatctgtacaagggatgcagaaggcctcgaagctggaaacgaaggccttgaagctaaattcttgagtagctaaagaagagattgtgctgtgccaggtgcg

SEQ ID NO: 117531 - DNA, 601 bp, Human
aatgagatatgctggaaatgtaaaattcacacacaacatttcaaagtcttgttatgaaacaatgtagactgtctcattagtagttttatagtgattacctattgaaattaatatatacattgggctaagtgaaaatgttattaaaattaatttcattttttctctttattttttaaaatgtgtctacatgaaaatttaaatttatgtatagggctcattttatttcatttggacaacactgatttagaccgtgagatacttaaaggtagggacagtgttttattcatctctgcatatagaktcaggcctgtggtaggtgctcaaggacttctctgcatgagataagtgactgaatattaagtcccaaatgaacagtgcagacactgagaacaatgggactacaagggagaggaaatgaacactatttccatacaagtccaggaaaatctgtacaagggatgcagaaggcctcgaagctggaaacgaaggccttgaagctaaattcttgagtagctaaagaagagattgtgctgtgccaggtgcggtggctcacctctgtaatcccagcactttgggaggcaaaggtggacagatcatgagg

SEQ ID NO: 117532 - DNA, 601 bp, Human
gacaacactgatttagaccgtgagatacttaaaggtagggacagtgttttattcatctctgcatatagagtcaggcctgtggtaggtgctcaaggacttctctgcatgagataagtgactgaatattaagtcccaaatgaacagtgcagacactgagaacaatgggactacaagggagaggaaatgaacactatttccatacaagtccaggaaaatctgtacaagggatgcagaaggcctcgaagctggaaacgaaggccttgaagctaaattcttgagtagctaaagaagagattgtgcygtgccaggtgcggtggctcacctctgtaatcccagcactttgggaggcaaaggtggacagatcatgaggtcaggagttggagaccagcctgaccaacaaggtgaatccccgtctctactaaaaatacaaaaattagctgggtgtggtggcatgcgcctatagtcccagctaatctagaggctgaggcaggagaatcacttggacccgggaggcagaggttgcagtgagccgagatcgtgccactgcactctagcctggcaacagagcgagacttcgtctcaaaaaaaaataaaaaaaaaa

SEQ ID NO: 117533 - DNA, 601 bp, Human
tctgcatatagagtcaggcctgtggtaggtgctcaaggacttctctgcatgagataagtgactgaatattaagtcccaaatgaacagtgcagacactgagaacaatgggactacaagggagaggaaatgaacactatttccatacaagtccaggaaaatctgtacaagggatgcagaaggcctcgaagctggaaacgaaggccttgaagctaaattcttgagtagctaaagaagagattgtgctgtgccaggtgcggtggctcacctctgtaatcccagcactttgggaggcaaaggtggrcagatcatgaggtcaggagttggagaccagcctgaccaacaaggtgaatccccgtctctactaaaaatacaaaaattagctgggtgtggtggcatgcgcctatagtcccagctaatctagaggctgaggcaggagaatcacttggacccgggaggcagaggttgcagtgagccgagatcgtgccactgcactctagcctggcaacagagcgagacttcgtctcaaaaaaaaataaaaaaaaaaaagaagagattgtatgatttctccaagtcactgtcggcattcacgtttctcctatga

SEQ ID NO: 117534 - DNA, 601 bp, Human
ctctgcatgagataagtgactgaatattaagtcccaaatgaacagtgcagacactgagaacaatgggactacaagggagaggaaatgaacactatttccatacaagtccaggaaaatctgtacaagggatgcagaaggcctcgaagctggaaacgaaggccttgaagctaaattcttgagtagctaaagaagagattgtgctgtgccaggtgcggtggctcacctctgtaatcccagcactttgggaggcaaaggtggacagatcatgaggtcaggagttggagaccagcctgaccaacawggtgaatccccgtctctactaaaaatacaaaaattagctgggtgtggtggcatgcgcctatagtcccagctaatctagaggctgaggcaggagaatcacttggacccgggaggcagaggttgcagtgagccgagatcgtgccactgcactctagcctggcaacagagcgagacttcgtctcaaaaaaaaataaaaaaaaaaaagaagagattgtatgatttctccaagtcactgtcggcattcacgtttctcctatgaaaataaaaggccagcataaaatgggctttgatatgacttcat

SEQ ID NO: 117535 - DNA, 601 bp, Human
aaacaatgctaataacaaaatgtattgaaaattcactatattggacattgaatgttatttacattacctcattcaaactccacaagaataaagtttggattgccattctacatttacagttgagttaagtggctcagaaagtggaaacaactgggccaaagtggaggaggaattagaactcaagtctgttttgctcatttttgctaccatgtgaagctatctttagggtgtcagccataagttttgatcaggttgtcctgccactgacttgataaatcagcccctcaggaaataatctacrtgcagaacttccaactgattggagaaaacagaagctcagaaccctgcatttctgtcgcataccattcttagtgtagaattggaactttcaatactggaaccctgctctgagactctgcaggcctaatcatcaacgcctcctctaggtgccagccatagaaggaccacgttgggtctggcccttatttcagggaaaaggagactttctgcccagtctccaggctgctgaatcagcctctttcttcctttggctttcagaatttactttcaaccctttatttttcagtttgatggcctcaca

SEQ ID NO: 117536 - DNA, 601 bp, Human
tatgatgaggaaaaataaaataaaatttaaaaatcacttagcatagtgcctgcgcataccaagggcaaaataaatgctggcttttgtcattggaggaggcaggatttgtgaggtttgtttgagagtctttcctgctatgttctatgcttatataggaaattatgaataataactttgatgagaacagaaaagttcaataaaaccatcatctctttgttccatttggttacttcaaatttgacaattatcttttaatggagaactgaactaaatgttctcattattttctttccagactaawtgctccttcttaaactaagtctcccaatcccacctcatatgtaactattttatttcttcccacaagctcaaggaatgtaaaaaaaaaaaaacgaatcttaagatgttaagcttagtggaaatgcaggaagggcttacaggttggttgcctggtgcaattttctgtcatgcagggaaaccaagactgagagagggaaatggattcacctcctgacacagtggacaagccaggacttgaacccaggtctctttaatacagtttctgccatgtttccctgacactcacacagagaaaacaaat

SEQ ID NO: 117537 - DNA, 601 bp, Human
gcttttgtcattggaggaggcaggatttgtgaggtttgtttgagagtctttcctgctatgttctatgcttatataggaaattatgaataataactttgatgagaacagaaaagttcaataaaaccatcatctctttgttccatttggttacttcaaatttgacaattatcttttaatggagaactgaactaaatgttctcattattttctttccagactaaatgctccttcttaaactaagtctcccaatcccacctcatatgtaactattttatttcttcccacaagctcaaggaatgtaaaaaaaaaaaaacgaatcttaagatgttaagcttagtggaaatgcaggaagggcttacaggttggttgcctggtgcaattttctgtcatgcagggaaaccaagactgagagagggaaatggattcacctcctgacacagtggacaagccaggacttgaacccaggtctctttaatacagtttctgccatgtttccctgacactcacacagagaaaacaaatctacaacagttatgtctccacttcgtaaaccttccattctccatcaccacttccaaataaagaataacggttgttacag

SEQ ID NO: 117538 - DNA, 601 bp, Human
tcatatgtaactattttatttcttcccacaagctcaaggaatgtaaaaaaaaaaaaacgaatcttaagatgttaagcttagtggaaatgcaggaagggcttacaggttggttgcctggtgcaattttctgtcatgcagggaaaccaagactgagagagggaaatggattcacctcctgacacagtggacaagccaggacttgaacccaggtctctttaatacagtttctgccatgtttccctgacactcacacagagaaaacaaatctacaacagttatgtctccacttcgtaaaccttcmattctccatcaccacttccaaataaagaataacggttgttacaggaatatgtcattacttgcccatttcgaattgccaaccagggactcccatttccaacatgtttatgtaaaagattaggagactctttgctctaattggtcatttttccactgagtaatagagttgcatcattgttgaattggctcagcctgacacaggcagacacactgatatatgtatgctttaatctgttaggaccaatgaggaaagaaaaccgttatttactttttgtcctgacctcaccatttagccatggct

SEQ ID NO: 117539 - DNA, 601 bp, Human
ttccaacatgtttatgtaaaagattaggagactctttgctctaattggtcatttttccactgagtaatagagttgcatcattgttgaattggctcagcctgacacaggcagacacactgatatatgtatgctttaatctgttaggaccaatgaggaaagaaaaccgttatttactttttgtcctgacctcaccatttagccatggctctttgagagcatacttcatttactgaacaaactgctcagtagcatcaataacttgttttagattcttttaaagaggacttcatatggcattcartccttgattccccaataaaacaacacagctgttcccttgcagctcgtctctcagcaggagctgcaaaatcatatttaatcaactttgctttaaaagccatccagtttcctttagggctttggcgaacttccctggccaggatggcccctgctgacatgtcagcagctacagcttttccaagccctggcggagggagttgccatttgctgagcactttctcatgtgccagtccctctattgggcactttaaattcaaggttttatttaatccacatggcagtctcatgagatggggattga

SEQ ID NO: 117540 - DNA, 601 bp, Human
ggattgatctctgattttaagataaggaaactgaggcttagaagtgtaaaaacatttttcccaaatcaaagagcaacaagtgaaagaattgggattcagccaagttctctctaattccaaaatctgtgcattttctacttttcagtttggctttctacataaagaggtaccaaggaattatacaggggtgagtgagacacaatttagtcagtatgtcaaatttggcaacagagtcccattgctatagctcctaagtctttttaagacttacagctttttcttaccatgatgaaatttgctrttagaatataaataatcttgatggcatcttgtattcaataaagattaacaattattatgtacaatttactcttcaaagtgaggtgaagggatgcagagatcaaataggtatacatcttgctctcaagaagctctaagtctagaaatagagatacaacagcaacatcaaacatgctaatgaaaaatagaaagtgataagtgttatgagtgggttaaattatgatggaaatttgaaaaaggagaagtctattctagctaaggcataagtcttatccaaaactttgaatgtaaagactataag

SEQ ID NO: 117541 - DNA, 601 bp, Human
cttccagcctcctatctggaggctggaagtctaagatgaagatccttgcaggtttgcatctggcaaaaacctgcttcctggttcatagatggccatcttctctctctgtatgctcacatagtggagaacagagagaggaaaagcaagctctctcatctctttttttttttttaaaggcactaaccttgttcaaggggattccacccttatgacctaattacctcccataggtctcacctcttaatgccatcatattggggatgagaatttcaacatatgaatttggggggaaggcaaaccktccacagcagggtgtgatggttaattttgtgtatcaatttagctaaactatggtgcccagttgtttggtgaaacagtagtttagatgttgctgtgaaagtattttgtagacacgatgaacatttacaatcagttgacttaaaataaacgatattattcttgacaatgtgtctcatccaatcagttgaaggcctgaaaaataaaactgaagtttttcagagaggaaattctgcctcaagagtaacgaggaaatcctacttgagttttcagtctgctgacctgctctgctctgtagattttg

SEQ ID NO: 117542 - DNA, 601 bp, Human
gacctgctctgctctgtagattttgaatttctagcttactggcttgccatccaaattttagacttatcagtccctacaatcatgtaagaaaattccttaaagataagtgtgtgtgtgtgtgtgtgtgtgtgtgtatgtgtgtgtgtgtgagtgtgagtgtaggttcggtctctggagaaccctgactgatacaaggggtgacaacagcatgatggcatttgattttgttgctttaggtgaaggttgcaagttgggttacaaagagagcttgggtgcctgaaagtggtgtcaacaccaaaayggaaaagatttcaggagaagaaagttcagatttggaactttgtcctttagatgtcacctggacaaacaaatagacatccttcagaagaacgttcattcagagctaagcagaagtcagcattatttccagtgtgcaaagatattttgaagagaatgtatatctcctttaggatccttcaacagatacgccacctgtttgcctgcagcagtttcctgaggctgcaatttggaacaaatgcctctagtgacagggaacaaaaagagttgctttgtcctgaaaggaggttaagagtcatttgag

SEQ ID NO: 117543 - DNA, 601 bp, Human
tatatagagttcccgcaatgcagacactcactaaacactggggtcacacgggggaaagacacaagtccagcctcattttgaatcagtctttttgtgtgttttagtagcttcccaaacataactttgtcttatcactcatagatgtaatgaggtagcttgattctatttattcaacaaagacttattgatttcctacaacaaaccatgcactgttcttgctatggggaatatagtagtgaagaaaattggctaaacttactccttgccttcatggagctgacattctcatgtgggtgacagraaataccatgataaataagtaaactacacagtaggatctgtggtgatatgttagagaaaaaaaataaagcagctttatcaatcaagagaggttaggcagccaacatgcaataattaacaaactggaatctcagtgacttttccactcgcctaattttcatcgtgggccagaaggggcctctgctcccacaacgtcactgtcttccttgctctaggactctgactatagagcaacgaatatctgtgctattataggggaaaaaataaaaagagatttctgctgggtctcaccttggggaag

SEQ ID NO: 117544 - DNA, 601 bp, Human
ctatttattcaacaaagacttattgatttcctacaacaaaccatgcactgttcttgctatggggaatatagtagtgaagaaaattggctaaacttactccttgccttcatggagctgacattctcatgtgggtgacagaaaataccatgataaataagtaaactacacagtaggatctgtggtgatatgttagagaaaaaaaataaagcagctttatcaatcaagagaggttaggcagccaacatgcaataattaacaaactggaatctcagtgacttttccactcgcctaattttcatcrtgggccagaaggggcctctgctcccacaacgtcactgtcttccttgctctaggactctgactatagagcaacgaatatctgtgctattataggggaaaaaataaaaagagatttctgctgggtctcaccttggggaagcaatgctcagcctgaaattgatgcacattatttccacacatcattcattggaatgaactgattagttggattgacctaaaatatggaagcaggaagtacagttctatcatgtgttcagactgggggaaatcctgtaaatatggcaaacaaaaatagggtcat

SEQ ID NO: 117545 - DNA, 601 bp, Human
tacaacaaaccatgcactgttcttgctatggggaatatagtagtgaagaaaattggctaaacttactccttgccttcatggagctgacattctcatgtgggtgacagaaaataccatgataaataagtaaactacacagtaggatctgtggtgatatgttagagaaaaaaaataaagcagctttatcaatcaagagaggttaggcagccaacatgcaataattaacaaactggaatctcagtgacttttccactcgcctaattttcatcgtgggccagaaggggcctctgctcccacaacktcactgtcttccttgctctaggactctgactatagagcaacgaatatctgtgctattataggggaaaaaataaaaagagatttctgctgggtctcaccttggggaagcaatgctcagcctgaaattgatgcacattatttccacacatcattcattggaatgaactgattagttggattgacctaaaatatggaagcaggaagtacagttctatcatgtgttcagactgggggaaatcctgtaaatatggcaaacaaaaatagggtcatttaggtcacagtgaggactttggcttctccc

SEQ ID NO: 117546 - DNA, 601 bp, Human
ggactttggcttctcccatgagtaaaatgggaagccattggagactgtgaacagtcgagtgagtgcagaatgagacagacttttgttgagatcttggctctgtgacccagaacatgtgatctataaattggggcaacaaaacctaccttattagattggtagtaagattcactgagatatttgtgtaatgcctggcataaaataaattttggcaaaatgacaatgatatattgaatttcctataaacctatttgtttcatcaaatgaggatgaatttcccccaaagcaaaaaccatgtctrattcatcattgaattctcaattcctaatacaagattggacccacttcattcccctaatatgtgtacttcattctccacaggatggctgagaggagggaaaagatgcagagagcatctgtgtatccttgctgctaagaattcaccttttttaaaaaagggagctgtcaccttgaataaaaaaggctgaagcagcaattcataagccacagttaatgatcaaactcatggcaagtcagctttagaatccagtggaggcatgttctctgtggccttatggcttgggggactgtttggaatatg

SEQ ID NO: 117547 - DNA, 601 bp, Human
aattttttttattatctttctttatatgtgtctcctttcactgcatagctttttctccacactcctttcatattgatctggcaataatgctaactttggtgcattcaagaggcccctttccccaccttcattttgtcttttctctaacagcacttgtttttcatattcttgaacacattcagctagtggctgtgaatttggagagataagcatataataactatgatgatcatacttcttagtttgcccagaacagtcatggcttttgcccaatgtctaggtgtaaatattaatgataatmccttttattctcaaatttttctcagttagaaaaatatatggtcctatttattatagaaatttatccttttctgaagggccacacaatgccagaaactattatgcctttccaccagcgtgatcctagagttaactcaaagtttcacgtgttgttagaaatatgaggggtttcaaagtcaaccaaaatagctggaagggaaggacattgtcatagtccatccagggagttagcagcccactctgctgccaatctcaaccagaatttgacctccccatcaagttctgctgtcacattatcctc

SEQ ID NO: 117548 - DNA, 601 bp, Human
atttttgaggttcagagccgtaagaacatatcatggaatttgcccacaagtgataaagtatcatctcaaatttgggcttaacttgtgttggggactcatatttgccttagggagttaaaatttttactatgtaagatagggagagagatatcaaattatggtgtatagaacatctgctttaaaatcatttggaaaactttaaaatgctgacttctgtaccttatctttgacctactgaatcagactatttgagaaatgaatatgaaggttgattagctcacagagttttactatcctcatrattattgagaaaccattaggctagtggctctatgaataggttagcataataaaagagaattatcttcatcaagatccaataatggtagttgctaccatctttatctgaccattgagaaaactgatgtaggaggagttgcaatctgccaaagacccaaaaggatatagttacaaaagaaggagattatttgtttttgtttttttgttttttttgagacagagtctcgcgctgtcgcccaggctggagtgcagtggcacgatctcggctcactgcaagctccgcctcccggggtcaggccat

SEQ ID NO: 117549 - DNA, 601 bp, Human
agagttttactatcctcatgattattgagaaaccattaggctagtggctctatgaataggttagcataataaaagagaattatcttcatcaagatccaataatggtagttgctaccatctttatctgaccattgagaaaactgatgtaggaggagttgcaatctgccaaagacccaaaaggatatagttacaaaagaaggagattatttgtttttgtttttttgttttttttgagacagagtctcgcgctgtcgcccaggctggagtgcagtggcacgatctcggctcactgcaagctccrcctcccggggtcaggccattctcctgcctcagcctccctagtagctgggactacaggcgcctgccaccacgcccaactaatttttttgtatttttagtcgagacggggtttcactatgttagccaggatggtctcgatctcctgacctcgtgatccacccacctcggcctcccaaagtgctgggattacaggcgtgagccaccacgccctgccaaaagaaggagattatttgtctttgccatgttctaatggaagtagaggtaagatgcttactcagattcttttctccctgaatcagtg

SEQ ID NO: 117550 - DNA, 601 bp, Human
acatttttagtgagatagtttgaggagcctgtagaggcagagaaatcagtatgaaatctgggagaaaaaaagggcattcatttttgaaacaggtataatttataggaatggacacttcaatccttttctttagaacacagttttcatctgaccagtttgcttcttgcattgcccagaaagcaatcgatcatctactcctttttttcaatgtgatcaatagagaagagtgtgctgacttagagaagagattctcaaacttcaatgcacccacaaatcacctatcttgttaaaatgcagatcrtgcttcatcaggcctgagaatctgcatttctaaccagctgtcatggctgctggtctgtggaccacactgcaagaccaggacttagagcatggtcagttgcccaagttcacttgagaccatgagaacattactgagcttctgagccttcatttcctcattttaaacatttgcatataatacagataatgaaagtgcctaacatataggactattttaagtacagaatatagtccacataaagtgctaaaataattaattgtcacatcatattctatcagtaaatgtttgctatcattatta

SEQ ID NO: 117551 - DNA, 601 bp, Human
tggaagaatagcagtaccattggagtaccctaaatgggaccccaatgatgaaatgggagagttgaagaggaaacactttaaaatgtgtgtatattagagggctttgtaagggactgagactagacctctcaatctcactgggctacctgtggtagaccagggatttgacaggagtcccactgccttcctggaaaggctaagaggggtcttggcaaaacacacccttctctcccctcattcaatagagggatagctggtcctaggggatgagtttgttactcaggcagcctctggtatcagraggaagctgcagaaacaggacataggaccagtagtactttagaggacctcctgaaagtggccaccttggtcttttataatagagatcaggaggccagagagagggaaaggagacagaaaaaaaagcagagagtctcatagccaccttacaggctcagaaaccccagagttcctaagatgtacttgttgacttctgcaaatgtaaaccactggaggtcagactgttcctgagacacaggtaaccaggtccagggctggtctttcaaatggtacagcaaggcttatgggtcccagggttctt

SEQ ID NO: 117552 - DNA, 601 bp, Human
ccccaattcctgggactgctattcctgggacttcctttatctcccttgtttgaggaggacctggccccacagctttgcctgcttgtgatagggaggcaacagaggagtgggccctgccagttgctagatgcaatgtggcaagggtcatttgggactaatttaaagggttcatataccctcctgaggcaccttttatcccaaactttggtttgaagccctgtaatggaacactagacctaaggcagatgacagtgggagttgagggtcacagcacaggtgagcatgactaattcctgccaawtaggccctcccacttcacggatggaggttatgctcatggtatagataaggtctaaggaactcacagattaccgagagtgggaggcttaggctccactcagatgagtgtgaatattcctgtcagctatgcttcccacttcatgggtgaaggttgcacttgcacccatagttggcacctgcacaagtcactgggactcagggatataaggtcaggagaagaaagagggatgccttttcttctcttcatcatgtaacctgggtggttgctgggatggtgaaaggaacaaagggatgccttttt

SEQ ID NO: 117553 - DNA, 601 bp, Human
ttgtgatagggaggcaacagaggagtgggccctgccagttgctagatgcaatgtggcaagggtcatttgggactaatttaaagggttcatataccctcctgaggcaccttttatcccaaactttggtttgaagccctgtaatggaacactagacctaaggcagatgacagtgggagttgagggtcacagcacaggtgagcatgactaattcctgccaaataggccctcccacttcacggatggaggttatgctcatggtatagataaggtctaaggaactcacagattaccgagagtgggwggcttaggctccactcagatgagtgtgaatattcctgtcagctatgcttcccacttcatgggtgaaggttgcacttgcacccatagttggcacctgcacaagtcactgggactcagggatataaggtcaggagaagaaagagggatgccttttcttctcttcatcatgtaacctgggtggttgctgggatggtgaaaggaacaaagggatgcctttttcccctctttccagatgggtaaccaaccaatcattttcaacctgccctcctcaagtgcatcctaaatcactggacaggacttc

SEQ ID NO: 117554 - DNA, 601 bp, Human
ggtcatttgggactaatttaaagggttcatataccctcctgaggcaccttttatcccaaactttggtttgaagccctgtaatggaacactagacctaaggcagatgacagtgggagttgagggtcacagcacaggtgagcatgactaattcctgccaaataggccctcccacttcacggatggaggttatgctcatggtatagataaggtctaaggaactcacagattaccgagagtgggaggcttaggctccactcagatgagtgtgaatattcctgtcagctatgcttcccacttcatkggtgaaggttgcacttgcacccatagttggcacctgcacaagtcactgggactcagggatataaggtcaggagaagaaagagggatgccttttcttctcttcatcatgtaacctgggtggttgctgggatggtgaaaggaacaaagggatgcctttttcccctctttccagatgggtaaccaaccaatcattttcaacctgccctcctcaagtgcatcctaaatcactggacaggacttcagagctcatggctcagggaaaggaaacccagaagcctgaaatgctggcaaaagtggaaag

SEQ ID NO: 117555 - DNA, 601 bp, Human
gtgggagttgagggtcacagcacaggtgagcatgactaattcctgccaaataggccctcccacttcacggatggaggttatgctcatggtatagataaggtctaaggaactcacagattaccgagagtgggaggcttaggctccactcagatgagtgtgaatattcctgtcagctatgcttcccacttcatgggtgaaggttgcacttgcacccatagttggcacctgcacaagtcactgggactcagggatataaggtcaggagaagaaagagggatgccttttcttctcttcatcatgyaacctgggtggttgctgggatggtgaaaggaacaaagggatgcctttttcccctctttccagatgggtaaccaaccaatcattttcaacctgccctcctcaagtgcatcctaaatcactggacaggacttcagagctcatggctcagggaaaggaaacccagaagcctgaaatgctggcaaaagtggaaaggttcttgccattcagactgtggcttctctctttctgtgcaaactagttgcaggaatgatataaatcacttctttacttaatttatgagcaccgttttacttataagcca

SEQ ID NO: 117556 - DNA, 601 bp, Human
aataaatttgagtcatcattgtagctaaacggatgacttatggcaatctgaaattctattaagtgtttgagtctttacagcttcaaaattgcctttcctaactcccaacttttggaagctacagagggaccctggagtgtccaaagtagaggtaaacaggattatttgacatgtttagttatataggattattgaaataaggtggtgcttgatcttcaggttatattttagtgaaaaatgttaatatgtgttccaaaatagtatgagatttctggagtactgatgtctgagtctgtgttaktaatcataattagggtcattgtgttaggttatcgtaaatcacagaggtgaccaaatttctttgtcaattatgtttttgactgtaactaacctaggacattttaacattcatagacaattgttgtcttgttttgatcctcttcaaagaatggattataaccctcaagtgcaggtttcttataactttgaagattgtgaacaggagttgagtaggtaaactgaactattggaagaccaatcttttttgactttttgcttttttcttggaacagtgctgatccttatgtcctgtttttcagaa

SEQ ID NO: 117557 - DNA, 601 bp, Human
gtcaagtttcttgaactcccaggctttattgtcctgatttacaaagttgagataataagatgacagttgcgaggattaaacatcttagcagaaaacatttggattatcatcttgcttctttaagcactcaataaatgcaatcatcattgtcctcctcctcctcctcctttactagtcctttttccttactattttttacaaactctgtgaccttagtcacctcacattagccacgactcatcgctttctaaaatgttcaactattaatatatattggagctatttttacttttttttttgmgtggtttctgaaacaatcaaaagattaaaccagaagtcaacaaactgttttctgtactagaccaaatagtaaacattttaggctttactatagacaatatagtacaatacacaaatgggcatggctgtattccaatcaaatcttatttacaaaataaaataaaataaaataaaataaaataaaataaaataaaggtaggtcgacaggacttagtttgctcacccctcctttaaagtaaagaagctgtaaatgttctgtgatttataaggaagtaagtttcacccaacacaaacctgtgat

SEQ ID NO: 117558 - DNA, 601 bp, Human
gcttagattcttcctgcaaatagcaaagaggtaaaccattttgatataaacttaacgatgtgtacctatacaattccatttatatgaaatgtccagagaaggtaaatggtcagagataaaaagtagattagtttttgcctgaagctgggagtgggaatggggagtgactgcaagggccatgaaggatattcctggagtgatgggaaagttttaaaattgggttaatattattattattctgagacagaatctcactctgttgcccaggctagagtgcagtggcatgatcacaactcactgyagcctccatctgctgggctcaggtgattctcccacctcagcctcctcagagctgggactataggcatgcatcaccatgcccagctaagtttttgtagagatggggtttcaccatatttcccaggctggtctcgaactcctgggctcaagcaacctgcccaccttggcctcccaaaagaataattgtgtgattatagacatgagtcactacacctggctttaaaatggattataataaggctgggtgtggtggctcacgcctgtaatcccagcactttgggaggccgaggtgggtggatca

SEQ ID NO: 117559 - DNA, 601 bp, Human
tccaggatcttactttagctttgaggagacagtcaatgaacaaatgattagaaagacacagtgaatttggataaataaaggatattatgaaggaactaaacagagagtaacttattaggggtggactgcagggaactacttcagcaaggatagtcacagatgctctctttggggacacagtatttgatcttagacatgaaaaatgaaaaagaaccagccttatgaatagttaggtacaataatagtctaggtagagagaaaagcaagtaaaaagacccagaggcaggaaagaatttggtgtttttttaaggaaaacaggaaatcaggccagtgttgctaaagcctagtgagagagaaaaagaaaaggaataggaagataggaagaatcaaatcatgaaaggccttgcaggccacaggaaggagtgcaaatttcattctatgagcaatggatgaaggacctttaagagcaaagtgacgtatatgttatttgtagtttagtgaaatgattttgtatgatttgtagcaaacgtataatattttggggctaaagcagtgaaatcatgaataaatactttttttttttttttgagacagggtctcg

SEQ ID NO: 117560 - DNA, 601 bp, Human
tgtcagagaacaaaaatggtaacttgcgagacattagagaaaattatctctgagagaaagacaggctcggcctaacgtgtctttccttgtggttacattatttggtgcttgctgggtgacaaatcatccatttttatcttttatgtaactttagttttgatgttaggagctaagaataactaatacccaagagggtatgaccctggagcaaggcatgctgggaaagcacatttctgggtgcatgttgcctctgtgcctagagacatggattcaaataaaagtcacagctactgtcccaccrggggccattgctttggaaagtttaactgagcttttgaatacatctttgtttgccattcttattcaaggttatccaaagacaaatctgcttcaagagaggagaaagtagtaaatttaaatggacctttcaaacaacgttcagtctaaaaatggagaagctcaagatcaaatacgtatttgaaatcactggctaagaaacaaaattagtgttttcaatgggcatcgtttccttggtcttgctggctcagaagagcaagtgcaagggttgagaaattctgttcttgctcaattccattaatgg

SEQ ID NO: 117561 - DNA, 601 bp, Human
ctaatacccaagagggtatgaccctggagcaaggcatgctgggaaagcacatttctgggtgcatgttgcctctgtgcctagagacatggattcaaataaaagtcacagctactgtcccaccgggggccattgctttggaaagtttaactgagcttttgaatacatctttgtttgccattcttattcaaggttatccaaagacaaatctgcttcaagagaggagaaagtagtaaatttaaatggacctttcaaacaacgttcagtctaaaaatggagaagctcaagatcaaatacgtatttraaatcactggctaagaaacaaaattagtgttttcaatgggcatcgtttccttggtcttgctggctcagaagagcaagtgcaagggttgagaaattctgttcttgctcaattccattaatggtcaggcagttgggggaagaaagccaatcacctcccatccttttctgactatttttgttgtctagagttatgtccataagaggtcaactcgctgtggctgaaaagaagggagcgtattggatatttagttgtgaacttttgcatgcataggctgagatgggctagtcagagattaatcat

SEQ ID NO: 117562 - DNA, 601 bp, Human
aaacagaggggtgaagataacaggaaaaaaaagggcatgtcctttggtaaattgcttattgttgcccagatatcactgtggtaacaaggaaagcccctgaaatcagtttgtccacagctcaagatataactccccagggttttcagtggcaagttaaggggttccaaggaggagccaggaatgaggcagtcacagatgggaacatttatttctttgagagtcttccgtttaagatgttctcagagttttggatgagctaaagggctcttcaggctagaacttggtcttggagggcagcttyccttccacctggccatgtttatcttacttccattagaaggcaagatgccaactttcctattcaatgaagtgtttagattccatgaggtttgtaaatagcctctgggaactcctttctgaaacttcccataggacttctaaactctccttaatcagagcagattgcaagagcaaatgcttcttattatgggttttaaaaaggtgagtagaccatagataaaaatcatagtaaaagtgggaatttgaggaaggtctgtttgctcaggaaaattttctaaatttcaaggttataaatgaaact

SEQ ID NO: 117563 - DNA, 601 bp, Human
gttgtggtaggcagagatgtctgattgcctttgaattctttgttttctaaccagaggggagatagttctttcaacagaaagtcccagcaagtgcaacaacaaccgcggcctggtgtgcctctacttgccttggctgcctcagaaagagccctgaacactcctcctagggcctgtctatgaaaccaactggatgtagtcttattatttatcagaagttgccaagcaagcagtggtagacagcaggctttcagggaattatcccagggattccttaccagtcttcaaccagatatcacaccasagcaatacatattccccatgcaagaagcagagtaagcaatccatacccttagatacataacactgattagtgcctctgttgttaaagttatttccctttgtataagatgtattcaatgtttcaatgtttacagtgaatttaagaggtagatataatagttatggtgaaaaccctcattttgcagaagagaaaacagaacattgcctatgcaaaatgaatctaccaaggtccgcagctattaagtgcaaagtacaggatttaaacctgttttgaaaaaattgacaaagtctcagggccttg

SEQ ID NO: 117564 - DNA, 601 bp, Human
aaacactgcaaaactgatccagaacaactgggggatgcatagcagcacagcagtttaggaaaccaccattggatttggccaggactgggtgtggatcttggttttgtccctttctggatgtggtctttgacaatgttgctcagtctttccgtgtgtccttaaacatcagtaatggctatagtatatttaacatggtctctggcgtattatgagtactcaaattgtagccactgtgtttattctagtaccactaaaatgtctcctgattttgaaaggagcatccccagagcattgtgtggcycatttacagatttgtaaaatgtaacatttacctacaccctcaatatctgctgaacactttcaataggcagtgaccatgggtcctccttgaaggtcataactagttaagtcaggaggattcttcaggggtttaggagagaatgagagagctgactcccggaagtgggaagggaatcaccctgactatttcctgtctttgctgctttcctttctcataagggagggctctgggaatgggaggcagcagcatccttgtccatactacacatcctttgttccctcccaccatgggcaaggaggg

SEQ ID NO: 117565 - DNA, 601 bp, Human
actgtgggctttgatgtaaatgtagtttactagactttccccagtctttcaccccagcctcaagtcatcactaattaggaccgtgctgctgtcaggaagcactgcacgcccacaagtgtgtagggcggccgttctgtttcatggtaatcagtcccaccatgacctctgcacacacagatgattgttcttttttttagtttgagacccggtctcgcagtgccgcccaggctggagtgcagtggtgcagtcacagctcactgcagcctcaaccttcccggctcagtgatcctcccacctcagmctcttatctgggaccacaggcacacgccaccacagctggctaattttttatgagatgatggtttttttaaagagtattcatttatcttctatataatcattatagacttaattctaacagtcttgtttgtgcctcactttcagactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttaccta

SEQ ID NO: 117566 - DNA, 601 bp, Human
tttaaaggttcaaatcagattttcaaagaagaggcttactgcaaacacaatatcttgctacctacaaacctttgcacagaatttcaactacaccaagtaaggttttttaaaatagtcacggaaaatatgtcactgtgaaacacaaaaacagcaatgtgtatttaccacatccaagtgacgaacaaatgaaatctgttagatctatattgtttacaatgtgcaagattagagaacagaacctaaacggcaggactgaaaagactaaaccgaatgccagtgaaacagaacagcatgacatttkctggtatacaaccaaatgtaaaaacacgtgagatagccgttttaatcctttagacttcaactcttcagaggtttcactttcaatccaaaatatctaaattccaaagcttattcatagaaatatattagtggtcacatataaaaactgaataagaaattaaaaagcagatatacccttgtccttccaatttttcttctgaccgtccatctcttgtcacgatctgctttgcagctccaattattaattatgcataccaacagaaaagctgtaactgcacaaacctactccctgagacatgaa

SEQ ID NO: 117567 - DNA, 601 bp, Human
caaccataaaatcttaccaatgtctcaatatggtctcaatcttaaattcaccttttccccacatctttattgaacaaatttttaaaaagacattgtaaaagttactgtaattagctctacatacttttagaaatattgttgccaatcctgctagaaggaaataattttttttaattataaaacttgaatgtagccaggaaaaaaattgcttacgtagaatgtctattttggactacttaaaaatagctctaataatttaaaggtaatttattataagtggtcagatatacagcctaccacyttcttttaaagaaaaaaaggtagatttaaccatctacataataaaatattctttaaatattctagtcaacattttaccatttacaggcttaaattcttacacaatgatccactgagatttgaaaggatctgggctttcaagggggaggaaaagggatcaaaatcactgattggttattacaaggacaaaggttagtgacttaaatatagacatgcatttaaaattactgcgtaattatactgtgtaatttgaatgatttcaagatgcacataatctgattaaaagaaagttggtaataat

SEQ ID NO: 117568 - DNA, 601 bp, Human
ataaaaatccttctctttaaattcacatgtaaagaaatcctaaaggcaaaacccaaagctgtattgttttctattattttttaagttgcaaccataaaatcttaccaatgtctcaatatggtctcaatcttaaattcaccttttccccacatctttattgaacaaatttttaaaaagacattgtaaaagttactgtaattagctctacatacttttagaaatattgttgccaatcctgctagaaggaaataattttttttaattataaaacttgaatgtagccaggaaaaaaattgcttaygtagaatgtctattttggactacttaaaaatagctctaataatttaaaggtaatttattataagtggtcagatatacagcctaccactttcttttaaagaaaaaaaggtagatttaaccatctacataataaaatattctttaaatattctagtcaacattttaccatttacaggcttaaattcttacacaatgatccactgagatttgaaaggatctgggctttcaagggggaggaaaagggatcaaaatcactgattggttattacaaggacaaaggttagtgacttaaatatagaca

SEQ ID NO: 117569 - DNA, 601 bp, Human
atttaagacttaagttattaataaagaaccttaatagttgcagaatgagccctgatacgacttttcacctacttttaaggcctgtatttattgtattattatcatttgtatcattttcacttagcaaaagctaccatatatcaattcatcaatctgtaacgtcaacggctaacaggatgaagaaataaaaatccttctctttaaattcacatgtaaagaaatcctaaaggcaaaacccaaagctgtattgttttctattattttttaagttgcaaccataaaatcttaccaatgtctcaatatggtctcaatcttaaattcaccttttccccacatctttattgaacaaatttttaaaaagacattgtaaaagttactgtaattagctctacatacttttagaaatattgttgccaatcctgctagaaggaaataattttttttaattataaaacttgaatgtagccaggaaaaaaattgcttacgtagaatgtctattttggactacttaaaaatagctctaataatttaaaggtaatttattataagtggtcagatatacagcctaccactttcttttaaagaaaaaaaggtagattta

SEQ ID NO: 117570 - DNA, 601 bp, Human
agtgaggcccaagtctaaacatgaaattcattctgtttcatctacatgttatacccataggctggaagtaattttatgcaatattttacataattctgtgcatgaaacaaagattgtgttaagtatttatgtgtggaattttctacttgtggtatcacatcagcgctcaaaatgtttcagactttggagcattttggcttttagattttcagattagggatgttcaacctgtacttgcaaactttagcaataacctgatttaactagatggaattaaaatattgtagtcattaaaatagcrtacagtatttaaaaaataaatacttaatggaggaaaaagactacagaataaaatataccacaaaaccctcccaacacacattaccctgttaaaaagataccccaaaactattctctatgcgatgtgagttttactcttctacttaccttctaaattctctataacacatacctatgtagtgctgcactactaacccaagatctagaaaatgtatctaatgaatgcctaaatattcggttttaacaaagtttagaactgaaaggagagtcgttccaatcagtaggccccataattaattaa

SEQ ID NO: 117571 - DNA, 601 bp, Human
tcctgtgtgggcctgacaaatatttaaatctctcgttttcttggtttccttgtcagtaaaacaggaaagttggaataaatgattaacagaatgccttatctgcaggaatactctaaaaattctgaatctacagaagttccttcagttgctgaattgttcctttaagaaggggaaaagtgggggaatcctttttctaattgctcccacttgaaatcatattttaaaattttccaaaaatttatgtgggtttaaggccagaagtaaacctggctgaacaatggagttctcagccttttccttyattgacaagctgcaccaagtcaatcagaagacccagtgatgaagccatcactgtttttggccttcaaaaaaatttggaggctggaaaaagagccaagatatttatgtataaataattgtaatagaaagtacaaaatgaaacccctcatgcccttcccttaggggggaaaaaaaagtacaaaatgaaaaccgagagatgggagtgaggaacactgaactacctccccagggaggcttagtgaacacctcaaggagaaccgggcctttgataaggactacttcagcaaaatgaaatgggaag

SEQ ID NO: 117572 - DNA, 601 bp, Human
aattattctcctggcccagagaactcccactaggtttaaccttttgacaatacctgtactaaatgactaaccacacctaccttcttccatgattagtgtgacagacaactgcctgccttttttattgcagtgaggacaatacgaaagaagtatacgacattcaataacatgccacaagtagactatgcacaaataaaatatcaaaacatgggccgttttagcttatatacttttcaatctttggttattcaagtgcaaatataaattataaaataaaaacaaaggcttcatgccaccatgracctgtggcatggtcctgtgtgggcctgacaaatatttaaatctctcgttttcttggtttccttgtcagtaaaacaggaaagttggaataaatgattaacagaatgccttatctgcaggaatactctaaaaattctgaatctacagaagttccttcagttgctgaattgttcctttaagaaggggaaaagtgggggaatcctttttctaattgctcccacttgaaatcatattttaaaattttccaaaaatttatgtgggtttaaggccagaagtaaacctggctgaacaatggagttct

SEQ ID NO: 117573 - DNA, 601 bp, Human
cctaaaccatgataattttctctttacagaataatcctacctttaatttcattttctctaaggtaaagctaaatatcttctctttaagtatgttggatatacatgactctccctacctgcactcactttaacgatttttcaattgtaaagaatgttaaaatgagaacttctcctatgacaagtctgtatttctgatacatgttgataagcatgtggttattaagttactagaattgatcaagacctgcataaatagaaacctaaaattagaaaataaactggttcaatgtataatttactwtagtttaaattttccttcttgttggcccatctaaagcttaaaataagtaggcaccaagtcttagaaacctgaggttactgctcaaaaccctattttctactaacaaaaactaaatggaaaacatactgtcctgtaactctagaaacttgaagcttaatatactggagttgggggaggggaagagctcaaagcaaattactagttcaaaacacagaatgaacctcactagtaagtaaatcagttatatttcttcttccataaccttatataactgttgtacacacaatataaatgttcatc

SEQ ID NO: 117574 - DNA, 601 bp, Human
ttcctaaaccatgataattttctctttacagaataatcctacctttaatttcattttctctaaggtaaagctaaatatcttctctttaagtatgttggatatacatgactctccctacctgcactcactttaacgatttttcaattgtaaagaatgttaaaatgagaacttctcctatgacaagtctgtatttctgatacatgttgataagcatgtggttattaagttactagaattgatcaagacctgcataaatagaaacctaaaattagaaaataaactggttcaatgtataatttaytatagtttaaattttccttcttgttggcccatctaaagcttaaaataagtaggcaccaagtcttagaaacctgaggttactgctcaaaaccctattttctactaacaaaaactaaatggaaaacatactgtcctgtaactctagaaacttgaagcttaatatactggagttgggggaggggaagagctcaaagcaaattactagttcaaaacacagaatgaacctcactagtaagtaaatcagttatatttcttcttccataaccttatataactgttgtacacacaatataaatgttca

SEQ ID NO: 117575 - DNA, 601 bp, Human
cagctttactaggagaaaacaagcaaaaaagggcagaaaacagttctaattttgcactcctagttttcctaaaccatgataattttctctttacagaataatcctacctttaatttcattttctctaaggtaaagctaaatatcttctctttaagtatgttggatatacatgactctccctacctgcactcactttaacgatttttcaattgtaaagaatgttaaaatgagaacttctcctatgacaagtctgtatttctgatacatgttgataagcatgtggttattaagttactagaaytgatcaagacctgcataaatagaaacctaaaattagaaaataaactggttcaatgtataatttactatagtttaaattttccttcttgttggcccatctaaagcttaaaataagtaggcaccaagtcttagaaacctgaggttactgctcaaaaccctattttctactaacaaaaactaaatggaaaacatactgtcctgtaactctagaaacttgaagcttaatatactggagttgggggaggggaagagctcaaagcaaattactagttcaaaacacagaatgaacctcactagtaag

SEQ ID NO: 117576 - DNA, 601 bp, Human
tatttaagacagtgtctccctctgtcacccaggctggagcagagtggcatcatcatagctcactgcagcctcgacctcctgggctcaagcaatcctgccacctcagcctcccaagtagctgggaccataggcgtgcaccaccacaccaagctaattttttaaaattttgtagaggcagggcctccctatgttgcccagactggtctcaaactcctgggctcaagcagtcctcccactgtggcctcccaaagtgctaggattacaggcgtgagctacaaggcccagccagtggtcttttttycctatatttcaagtagaaaatgcctcaaatatgttgcaggaacataaaaactacctatggctgtttgccatcttctaaggataacacgaatttctctaagagaaaagtgaagttcaataacaccatacatgcttcatttataattaaattcaccagtttacttcattagttcatgtggttttcaatatttcccttaatcctacactctttccagctttactaggagaaaacaagcaaaaaagggcagaaaacagttctaattttgcactcctagttttcctaaaccatgataattttctc

SEQ ID NO: 117577 - DNA, 601 bp, Human
ttaaaatttttaaataagcaataaacttgacaaacacagcatataaagcaacgaaaataccatttctagaaaatctccaggaaacagaagccaaacataaagatgtgaagttaagtcaatgtttactattcattttattaaaaaaccaatcctacacccaggatagaaccttattattattactgagaacaaacggcctttacaattaaaatcgttgtaaacaccgagtgtgttttcacacacatactcctttccccacataacatgaactaaaagatggtttgtgatttaaaaaatatgygtctctagctctctagtaaccaacactatttgaggagtacaagattctcttacccaagtttagtattgttaaatggtccctgcagttatgaagttgcataggaaagaaaattttcataaataagaaaacatccactaagtaatcttcaaaattaatccaagctcataaatatcccttactgtttaaattcaccatccagcctcactcattacctaaatgtcttgtcagataaaaccacccaaatcaacagtgcaaaattgcaaatcttcctattaacatgaaattccacaaagttaatgt

SEQ ID NO: 117578 - DNA, 601 bp, Human
attgttctcaccttaaaaataaatttatactataaataacaatctatgtaattacatatgaactataaaaatagataaaaaagacattggtgaatttaagaatgatattaaaatttttaaataagcaataaacttgacaaacacagcatataaagcaacgaaaataccatttctagaaaatctccaggaaacagaagccaaacataaagatgtgaagttaagtcaatgtttactattcattttattaaaaaaccaatcctacacccaggatagaaccttattattattactgagaacaaayggcctttacaattaaaatcgttgtaaacaccgagtgtgttttcacacacatactcctttccccacataacatgaactaaaagatggtttgtgatttaaaaaatatgcgtctctagctctctagtaaccaacactatttgaggagtacaagattctcttacccaagtttagtattgttaaatggtccctgcagttatgaagttgcataggaaagaaaattttcataaataagaaaacatccactaagtaatcttcaaaattaatccaagctcataaatatcccttactgtttaaattcacc

SEQ ID NO: 117579 - DNA, 601 bp, Human
cttcaggttagtatcaatatgatctgagaagataatgtaatctctgtttccctgtgtgtaaaattagaaaaataatacccacccctaagaaattatttgaagctgaattgaaatttcacatatggaaatgcttggtaaactgaacacactggtactaaagctcaagagataaggtcaagaaaggcaatcaaatattatatgtaatgcttagctaagccctgattttttaaaaaaggtgaattcaactttctctgaaagtatatgtaaagaggtttcaattagcaagtctcagcctgatggktacctgttactgctacaaaagtatctcaaccaaatacctggcaagccagcatctgtcttggctatctcctcttcctttaactagagtttttaaacagatacgtgcaaaatttcaggtccttgtctcttccactaaatctttcctgtcttactttgataacgttacagtgctttggcgaatttgaaccaccacacctaagaaaataacactttacatgacaaacaaatagcactaataaacaatcagcaaaatttctatacttcccctttctacaataattttgtaatctcccagtctgag

SEQ ID NO: 117580 - DNA, 601 bp, Human
atttcttccttcaggttagtatcaatatgatctgagaagataatgtaatctctgtttccctgtgtgtaaaattagaaaaataatacccacccctaagaaattatttgaagctgaattgaaatttcacatatggaaatgcttggtaaactgaacacactggtactaaagctcaagagataaggtcaagaaaggcaatcaaatattatatgtaatgcttagctaagccctgattttttaaaaaaggtgaattcaactttctctgaaagtatatgtaaagaggtttcaattagcaagtctcagsctgatgggtacctgttactgctacaaaagtatctcaaccaaatacctggcaagccagcatctgtcttggctatctcctcttcctttaactagagtttttaaacagatacgtgcaaaatttcaggtccttgtctcttccactaaatctttcctgtcttactttgataacgttacagtgctttggcgaatttgaaccaccacacctaagaaaataacactttacatgacaaacaaatagcactaataaacaatcagcaaaatttctatacttcccctttctacaataattttgtaatctccc

SEQ ID NO: 117581 - DNA, 601 bp, Human
gaccttaagtcctatttcttttgagtcctatttcttccttcaggttagtatcaatatgatctgagaagataatgtaatctctgtttccctgtgtgtaaaattagaaaaataatacccacccctaagaaattatttgaagctgaattgaaatttcacatatggaaatgcttggtaaactgaacacactggtactaaagctcaagagataaggtcaagaaaggcaatcaaatattatatgtaatgcttagctaagccctgattttttaaaaaaggtgaattcaactttctctgaaagtatatstaaagaggtttcaattagcaagtctcagcctgatgggtacctgttactgctacaaaagtatctcaaccaaatacctggcaagccagcatctgtcttggctatctcctcttcctttaactagagtttttaaacagatacgtgcaaaatttcaggtccttgtctcttccactaaatctttcctgtcttactttgataacgttacagtgctttggcgaatttgaaccaccacacctaagaaaataacactttacatgacaaacaaatagcactaataaacaatcagcaaaatttctatacttc

SEQ ID NO: 117582 - DNA, 601 bp, Human
aatcccatacagacagtggccccagcaaggaattgtttttttttctcttcctcatgcacattataacgaaacaacactgaacaaaacaatgatatgagggtctgttgtatgtattttaaaaattctaaggaatccacaaaaagctactagaaataatgaatgagagtccagcaaggctgtaggacacaatatcaatatacaaaaattgtatttctatacactagcaataaacaatctgaaaatgaattaaataattccatttgtaatagcatagaaaaaataagatacttaggaatacagygaaaagaatttcaagacatatgaactatacataacacactgtcgaaagaaattaaagatgacttaaataattggaaagactcctgttcatgaattgaaagacattaagacagtaacactcctcaaattgatctaaaatacaaacactatcaaaatcccagctgtcttttagcgaaaattgacatgccaattgcaaaattcatatggaaatataagggatccaaaaaatcaagaaaaacttgaaaaagtacaacaaaggttggaggactcgaacctccctatatcaaaacttcctaaaaag

SEQ ID NO: 117583 - DNA, 601 bp, Human
gggggtgctatgcagtgcaactggccaagaaaaagacatacaaggcatccatattggaaaggaagagattaaactctatttaaagataacatgatcttatacagtaaatcctcacttaaatgttgaggatagctttctggaaactgcaactttaagtgaaatgacatgtaacagaaccaattttaccataggctaatttatataaacaagacttcattttctatggcatatttctggtcacaaaaacatcatcatattctaaataaaggtcgggcgcagtggctcacgcctgtaatcccarcactttcagaggccaaggcaggcagatcacctgaggtcacgagtttgagcctggtcaacatggtgaaaccccatctctactaaaaatacaaaaattagctgggcatggtggccggtgcctgtaatcccagctactcgggaggctgaggcaggagaataacttgaactcaggaggcggaggttgcagcaagctgagatcacatcactacactacagcctgcatgacacagaaagaccctatctctaaaaaaaaaaaaaaatctaaataaagactcaaaacacttctactattaaacactga

SEQ ID NO: 117584 - DNA, 601 bp, Human
taagttgttgaaaaatgacttttaaaaactatgtgaatctaattaaataaaatcagggtatatttatgcaagagaaatgtgtagccattaaaaaaaagtgatacagatctacattatcacagaaacatgtccataatgataaatgaaaacagcatgttacaaaaagactcacagtatattctcacttaagaaattaaacatatggccgggcgtggtggctcacgcctgtaatctcagcactttagaaggccgaggcaggtggatcatgcggtcaggagatcgagaccatccttcctaacayggtgaaaccccgtctctactaaaaatacaaaaaaaaaaattagccgggcttggtggtgggcacctgtagtcccagctactcaggaggctgaggcaggagaatggcgtgaacccgagaggcggaggttgcagtgagccgagattgcgccactgcactccagcctgggcaacagagcgagactccatctcggaaaaaaaaaaaaaaaaaagaaaagaaattaaacatataactatgaagtctgaaagtatatctactaagcagtgtttttatctctgcataacgggattatcaatgagtttt

SEQ ID NO: 117585 - DNA, 601 bp, Human
ataagtactttcccacagtagagaactataattaagttgttgaaaaatgacttttaaaaactatgtgaatctaattaaataaaatcagggtatatttatgcaagagaaatgtgtagccattaaaaaaaagtgatacagatctacattatcacagaaacatgtccataatgataaatgaaaacagcatgttacaaaaagactcacagtatattctcacttaagaaattaaacatatggccgggcgtggtggctcacgcctgtaatctcagcactttagaaggccgaggcaggtggatcatgmggtcaggagatcgagaccatccttcctaacatggtgaaaccccgtctctactaaaaatacaaaaaaaaaaattagccgggcttggtggtgggcacctgtagtcccagctactcaggaggctgaggcaggagaatggcgtgaacccgagaggcggaggttgcagtgagccgagattgcgccactgcactccagcctgggcaacagagcgagactccatctcggaaaaaaaaaaaaaaaaaagaaaagaaattaaacatataactatgaagtctgaaagtatatctactaagcagtgttttt

SEQ ID NO: 117586 - DNA, 601 bp, Human
taaagaagaaaatttcaaacttattattaactttaggttaataaactatactgttgtgttatattgtaaacatgttactttataaaccatatgggaaagaattttaaagcttatctaagtttttactattatagggtaagtaaaagctaatagcccaaaggaatcagcaagtaaggtgtacctcaaatatatttttcttttactttttttttttgagacagagtctcgcactgtcgcccgggctggagtgcagtggcgcgatctcggctcattgcaagctccgcctcccaggttcatggcwttctcctgcctcagcctcccgagtagctggggcaggcgcccgccaccatgcccggctgattttttgtttttttagtagagacggggtttcaccgtgttaggaaggatggtctcgatctgctgacctcatgatccgcccgcctcggcctctcaaagtgctgggattacaggcgtgggctaccatgcccggcctctcaaatctatttttcatatgaacaaatgctcctttataaaagtggttctcaaactgctcagaaacattaattaaccttcaaaatcactattggtgagaagttaaagt

SEQ ID NO: 117587 - DNA, 601 bp, Human
tacttctgtagggaaaactatgtatgtgaactgcacaatgttggatattagtacaaagcccttaactgctgctagtatatcatgagtactgtttaggatattttaaatgcccatcactgtgtccagtacatagcagggattcaaacacttatttcagttgcctaaatggtctggcttgaatgctattaatttaacattctatatatgatttcgaagtttgttttcaaactctgatttcaactatttattcaaatattcccaaacttgtttgttacagcccctgcctaaaacatctaaaggmgcttagtgctattccactagtttctactattgtactagcacaactgaggactgacaagaacttgaaatggcctatctataggttgtcaaagggacattacgaataatgtcatattgaataaagagataagagcaacgctaataggtttctggcaatcagcaaacacttaatgaggtgaaactgttcaagtaactcaacctagcagaatgagaaaactcattctgattcttgaaggtcttgtccaacattacaattctaggaaagataagacatataaaagcaagtcaatgaaggtataaa

SEQ ID NO: 117588 - DNA, 601 bp, Human
ttccagccatctcacctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaactaaaaattgaaaaagaaatctgaaattagaatgttattttatcaatttggatttgctccatctatgaaaacaaaaasgctactacataaagtaaaatcaaacctaaaaatttaaagaaacactaagttaaagaaacactaactttataacccacattttaaacccactcttagttgtatattagtataacacctttatttttgaccacgaaatgttttttattcaaatttatttctgcataaccaaatcattctagccatacacaatgattaaatgtctccaaagcctagaagacttctaatccaaaacaaggagttacttaaaataatcttgggggctgggtgcggtggttcatgcctgtaatcccagcactgtgg

SEQ ID NO: 117589 - DNA, 601 bp, Human
aacctacccatgttaaaaagatacaacactcattcaagtaagataaccaatgcttaactctaataaatattcctaacaagtagcagagttagtttaatgatacataaacagtctcctccatcatgagcctttaaaacgacttttagaaaatctcaaaagcagatgtttttggtatagctcaagcaaataactgcaattatctttaacaaaaaaatgcatgcttgtaactctatagacagtagatgaagtcttaataccaatcctgtttacactattgccaatgcatgccttgttttccagmcatctcacctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaactaaaaattgaaaaagaaatctgaaattagaatgttattttatcaatttggatttgctccatctatgaaaacaaaaaggctact

SEQ ID NO: 117590 - DNA, 601 bp, Human
agttactgaattccaactttttccccatcaccccataaaatggagtgataccacctatctcacagaattatcacaaatttaaaataaacttattaaaatatgtacataaaaggttagacacataggagctattcaataaatgttggtctctccccctaaacttgtataacatcattacttcatcacaaagagaaagccagagaaaaatcaccagtctttacaataaacaaaataattcagtaggtctcctctttcaaagtctgtaaatccatttaagtttacccattaatatcaactggaccatgttgtaggtaggtacatagtcatatgcccaaacagatattaccttgccacaaatagttttttcctttgtttcccctactttcaagctaacaagttagaaatagtttttaaattatctcaatctatttgaagaaaaatgatctccttatgcaaaacaattaacatttcaaaggcttagttaatgcagtaggaactgaattttcggatcatttggggtcagggttaggaaattctccaaagagctgggtcttgaaccaaactaagaaccaaataaaaagtatgactgaggcagctaagg

SEQ ID NO: 117591 - DNA, 601 bp, Human
ttttttttttttttttttttttttttgaaagagtctcgttctattgcctaggctggagtatagtggcatgatcacagctcactgcagccttgaactcctgggttctagcaattttcttagctcagctgcctgaatagctgggactactggcatgcatcaccacacctggctaatttttaattttttgtagagatgggagtctcactatgttgcccagggtggtctccaactcctggcttcaagcaatcctcctgcctcaggatcccaaagcactagtattacaggcatgagccaacacgtytggctggctctgccattttcaaactacaatttcaagttactgaattccaactttttccccatcaccccataaaatggagtgataccacctatctcacagaattatcacaaatttaaaataaacttattaaaatatgtacataaaaggttagacacataggagctattcaataaatgttggtctctccccctaaacttgtataacatcattacttcatcacaaagagaaagccagagaaaaatcaccagtctttacaataaacaaaataattcagtaggtctcctctttcaaagtctgtaa

SEQ ID NO: 117592 - DNA, 601 bp, Human
tccaacaagcttaaactggtatgttggctgaatttactttataatgactataaaaggactttaagaatataaagtgtttctagccaggcacagtggtgcatgcctgtagtcccagctacttgggacattgaggcaggaggattgcttgagtccaggagttcgagactagcctgggcgacacagtgagacccatctctttgaagaaagtttaaaaaatgaataaagttgtttctaagaaggaaataaatcactaatattttccaaaaacctcaaaaatcaaatgatgtgtaaaattggaackgtagaaaatttagaagttttggcttgacaatatttttacatatttcagcataactaattaaaaatcatacttctttatgatttgtggcttgataataatatgactcggccttttttttttttttttttttttttttgaaagagtctcgttctattgcctaggctggagtatagtggcatgatcacagctcactgcagccttgaactcctgggttctagcaattttcttagctcagctgcctgaatagctgggactactggcatgcatcaccacacctggctaatttttaattttttgtag

SEQ ID NO: 117593 - DNA, 601 bp, Human
ttgtttacccaaatttgagaaatataggaaagtggctgatataaccctggttggtattctgcttctttgtaccactgttacttgttcttgctgaagacaagatgcctaagcagaagccataaagacagtactccccatcaatgacatcctgtagatatttacactaattcaactgacatttatgtgatattaatacaatgccagcactgttcatcactcagtaaccacaggtattagatacaaaccacataatatcacctctactagtatgattaaggggtactaggaaaaactgtccaasaagcttaaactggtatgttggctgaatttactttataatgactataaaaggactttaagaatataaagtgtttctagccaggcacagtggtgcatgcctgtagtcccagctacttgggacattgaggcaggaggattgcttgagtccaggagttcgagactagcctgggcgacacagtgagacccatctctttgaagaaagtttaaaaaatgaataaagttgtttctaagaaggaaataaatcactaatattttccaaaaacctcaaaaatcaaatgatgtgtaaaattggaactgtaga

SEQ ID NO: 117594 - DNA, 601 bp, Human
tgagtcattcactaagtattttttaaccttaatgtagcccttattaatcatatggttttcccaatctgcaatgctctcttacctctggtgataccttatttagccagttagccccatctcaaatctcacccatacatagagccttatctgccaatctctttcataaaaccctgatgttctctctcactcctgtataattctaacaatgctttcttttgtgttagtcttatagtatttactagattcagctctgaaatatagacacatgtatacttgtatatttttcctactagagtataarctgttatggaccaggaatgtatctttactaatacatggtctaacacactgttagacaattattaacaaaaaactgaattattaatatcaagttaaaaatactcaaatactcgcactgatatttaaaccagcaattatttgtttacccaaatttgagaaatataggaaagtggctgatataaccctggttggtattctgcttctttgtaccactgttacttgttcttgctgaagacaagatgcctaagcagaagccataaagacagtactccccatcaatgacatcctgtagatatttaca

SEQ ID NO: 117595 - DNA, 601 bp, Human
tttcctcagttccttcaggctcaaacattctgtgattctatgactccaacttttcaaccagggacatcctcctaaatctttccaaccttacttccaactactctttatgttgcagccagaaatgagtcattcactaagtattttttaaccttaatgtagcccttattaatcatatggttttcccaatctgcaatgctctcttacctctggtgataccttatttagccagttagccccatctcaaatctcacccatacatagagccttatctgccaatctctttcataaaaccctgatgttmtctctcactcctgtataattctaacaatgctttcttttgtgttagtcttatagtatttactagattcagctctgaaatatagacacatgtatacttgtatatttttcctactagagtataagctgttatggaccaggaatgtatctttactaatacatggtctaacacactgttagacaattattaacaaaaaactgaattattaatatcaagttaaaaatactcaaatactcgcactgatatttaaaccagcaattatttgtttacccaaatttgagaaatataggaaagtggctgata

SEQ ID NO: 117596 - DNA, 601 bp, Human
aagaagccattttatcttggcagggtacaaccaactcagaagtgctgagtgttccctcgtatctgttggaagtagtcctcataacctccctatgtctcaggatgccagtttcttacagtggaaataacatcttagacaactccttgtcccatagttttacctctgcaacatgccccaaatatgtctcctggtttttattcacagtgccatcactctattttaagcacttactatttacgagctggaatattctatcactctccaaaccaatctctgatctgcctgcatccaaatccattcygtcagccaatgccagaataaccttatgtgagctatcttagatagtgctgtctaggctgaactcaagcaagagttagaagacctgccactacctagctatacaacattgcaaaaggcatttaacttctctgggtaagtgctccaactctgtaaatttgagaaacagactttcctcagttccttcaggctcaaacattctgtgattctatgactccaacttttcaaccagggacatcctcctaaatctttccaaccttacttccaactactctttatgttgcagccagaaatgagtcattca

SEQ ID NO: 117597 - DNA, 601 bp, Human
tatgactatggttgtttttttttttttcttaaagttgacactatgttgtctcatcacgttttcctaacaaagatctttttcatttccaaatcctaaactctctcagactaacctttaggggaaattgttcaatatgtcaagcaccagattgtaaagtggctgccaaaagcacagtagcaatcctagcaaaacataagagttacatcatctagatgttttaatccataccgagatggctaaaattgttaaatttaaaagtattgtattggtaataaataaataaataaataaataaataaawaaaaatactatactggggaaaaagtcaagtccacaggaatgtaagaaacagtttcattactgtttcaaagaagccattttatcttggcagggtacaaccaactcagaagtgctgagtgttccctcgtatctgttggaagtagtcctcataacctccctatgtctcaggatgccagtttcttacagtggaaataacatcttagacaactccttgtcccatagttttacctctgcaacatgccccaaatatgtctcctggtttttattcacagtgccatcactctattttaagcacttacta

SEQ ID NO: 117598 - DNA, 601 bp, Human
tcttatctagaataagaaagagtccaagatatgaaatagctttcatgtacatatgaatcacatacaagctaagaaactaagtgctagactgtaaagcaaagtcagaatgaataaatctgataatgcattagacgatctttatgcttatagtcaaaattccgattaatttcctttccttttaatctttatgatttccgaaagtattactatatatatatataatttttttttgagacagagtttcactcttgttgcccaggctggaatgcaatggcgtgacctcagctcaccgaaacctctrcctcccgggttcaagcgattctcctgtgcctcagcttcctgagtagctgggattacaggcatgcaccaccacgcctggctaattttgtatttttagtagagacggggtttctccatgttggccaggctagtctcaaactcctgacctcaggtaatccacccgcctcggcctcccaaagtgctaggattacaggtgtgagccaccacacccggcccacaagtatgatttataacttattctcctttaaaaaggaatacaggactctctgtattaagtatgaccagaaaaaaaaagggaata

SEQ ID NO: 117599 - DNA, 601 bp, Human
acgcaaacagctgaaaataacgtatcaactactaggttataaaggctaaaatgttttttttttttttttttaaaaagcactttaagcacttaaacctattctgaccagttcagaaattgtttttctgagtctaaaggcccagtcaccttattactactatatccttggcatgtgtgataaatataaactagaacatttctcttggaaatgaaaaatgaaaaattatgagaattaccaccactacatttctgcccaggcttagattggaaacaagtctgcctgttttctgcagagtcacaggaaagagcatatacaacacaaatgacaagttctatgaaaaagaaaagcactacaggtccagtgcttcaggcttaaattacacaactgtggtttagtgcctgtttcgtcagtcagaactttgggagagtttatttgcaaggtgagactcttaacagctgcttatgtagcgagatccaaaaactaaagaaaaacttccaatgattaccaattgaagattagttgaagtgtttcagaatattaaatcttatctagaataagaaagagtccaagatatgaaatagctttcatgtacatatgaatc

SEQ ID NO: 117600 - DNA, 601 bp, Human
taaccaagcatgccaaacaacataaccgtaatctttttatttacagactaacatcagatcattttaaaacaccactacagatttagtcactaaatgcaaccactctatacgaaagaggtaagtaataaaaggaaactacattatttacccttgatgttattaggaagtaacttaagttccaagtcataaataaaaataagagatgcggctgggcgcagtggctcatacctgtaagcccagagacgcaaacagctgaaaataacgtatcaactactaggttataaaggctaaaatgtttttkttttttttttttaaaaagcactttaagcacttaaacctattctgaccagttcagaaattgtttttctgagtctaaaggcccagtcaccttattactactatatccttggcatgtgtgataaatataaactagaacatttctcttggaaatgaaaaatgaaaaattatgagaattaccaccactacatttctgcccaggcttagattggaaacaagtctgcctgttttctgcagagtcacaggaaagagcatatacaacacaaatgacaagttctatgaaaaagaaaagcactacaggtcc

SEQ ID NO: 117601 - DNA, 601 bp, Human
acaacagattttgcatttatgaagacaatgagttatagagatacttctttcaaattgttgtttaaaaactattattttgtaaacacagagcttgataaaaatgtcttttctaaatgacaaaaatttagaaatgagagtaatttctactacattttcctgaaattaagatggtttccattttcctagctatgaatcatataaaatcaatgtaattccaataaaaagctacttcctataaattttaaaaaactcattgttatttaaataagaaaaaacattcatctcaactggagagactggrgctattagcaaacttcccataaatttaaaatctgactgtaaggcattaaaataaatccgtttaaacaaggtaaatacatttttccttatgttgaaaaagtaaaaaaagaatgggaattggaaaaacattttttgcttgctttagggtgacagaatataactttccctaccagtttttgtggctaaaaggcaaaaagtaatacagtccactattaaggaacttaagattaagattttaataattttttttttttttttaaacagacagggtctcactctgttgccgtggctggaatgcagt

SEQ ID NO: 117602 - DNA, 601 bp, Human
gcatggtggctcacacctgtaatcccagcactctgggaggccaaggcaggcagatcacctgaggtcaggagttcgagaccagtctggccaacttggcaaaaccccatctcttctaaaaatacaaaaattagctgggcgtggtggcggacacctgtagtcccagctacttgggaggctgaagcaggagaatcacttgaacctggaaggcaaaggttgcagtgagcctaagatcgcaccaccgccctccagcctgggtgacacagcgagactctatctccaaaaaaaaaaaaaaaaaaaaaaagagctagtgataattgtgacccagaatctaaaaatgtagatataaatttgagggcacacaacagattttgcatttatgaagacaatgagttatagagatacttctttcaaattgttgtttaaaaactattattttgtaaacacagagcttgataaaaatgtcttttctaaatgacaaaaatttagaaatgagagtaatttctactacattttcctgaaattaagatggtttccattttcctagctatgaatcatataaaatcaatgtaattccaataaaaagctacttcctataaatttt

SEQ ID NO: 117603 - DNA, 601 bp, Human
tttagtgttcttctgggtcagctatttctggagctcaggccgttttttttttttttcttcctctcactttcagatttaagattgtgttctggaacattatagttgcgcctcaattacagaaaagtaagaacctctgctgaaaatacctggtcttagtccctaaaaaagtaaaattattagacagctttttgggatttgaggtttcaaaagacaggaacctgctaagaaggctcagtcagactcaattagcccaaaagctgagcccagtaggcattgtcatatgcttttctttcataattgsgggtgggaagcgaggggagggaggatttatagtttaatgccacaactttttaaaacagtgatttttgccatactatttgactaggaaaatgatcgttgctcactctataaatacttgaaatcttttctaggacttagaagtttgtagttaattgcaaaggagcaaaacaaacggaatattacacaagaatttaaaaggagaactctgcagaacatgtcttatttttattcgcccaagtcaaccaccaggaaacttggaccaggcacacggatacccatcatttcacaccggcgtttataa

SEQ ID NO: 117604 - DNA, 601 bp, Human
gtgcttagtaagatctcagaaattactctggcagttctgaccatttcaaaactttcctgcactctcaaactctaaactctacttgcccttctgtgtctccttcagattcattcattagttggtagtttggactctctctatatccccagcccacttccttctaatttttctgagagctcaagaaacctgaaaggaagctgtcaaaatgtgaatgttaacagctgcctatgagcctgagagctagattttagtgttcttctgggtcagctatttctggagctcaggccgttttttttttttttcttcctctcactttcagatttaagattgtgttctggaacattatagttgcgcctcaattacagaaaagtaagaacctctgctgaaaatacctggtcttagtccctaaaaaagtaaaattattagacagctttttgggatttgaggtttcaaaagacaggaacctgctaagaaggctcagtcagactcaattagcccaaaagctgagcccagtaggcattgtcatatgcttttctttcataattgggggtgggaagcgaggggagggaggatttatagtttaatgccacaactttttaaa

SEQ ID NO: 117605 - DNA, 601 bp, Human
aaggcaaacggtgggagagtgcttagtaagatctcagaaattactctggcagttctgaccatttcaaaactttcctgcactctcaaactctaaactctacttgcccttctgtgtctccttcagattcattcattagttggtagtttggactctctctatatccccagcccacttccttctaatttttctgagagctcaagaaacctgaaaggaagctgtcaaaatgtgaatgttaacagctgcctatgagcctgagagctagattttagtgttcttctgggtcagctatttctggagctcrggccgttttttttttttttcttcctctcactttcagatttaagattgtgttctggaacattatagttgcgcctcaattacagaaaagtaagaacctctgctgaaaatacctggtcttagtccctaaaaaagtaaaattattagacagctttttgggatttgaggtttcaaaagacaggaacctgctaagaaggctcagtcagactcaattagcccaaaagctgagcccagtaggcattgtcatatgcttttctttcataattgggggtgggaagcgaggggagggaggatttatagttta

SEQ ID NO: 117606 - DNA, 601 bp, Human
cctgctccatacgctgtggccatgcaaatattccaggccagtgttgccagaaatgtacacttttgtgtgctatcatataatttttaaatgttgcagctatgttgagaaaactgaatacttcggcggcccaaaacagaaatagtggttaagtgtattcagggaacacaccaccaggagagaaaggggtggcagcaagaactaacctagagagtaaccattattaatgggaatccaccacaaatgatggatttgtaacatggcaggaataaggtcaataaacactttaaagaagcaaacaggstgctctcattttggacttaacaaattctacacgattccatggcaaatactttgcaacattatagccaatacttattaactgaagaggtcaaagcttatctctccattgcacagtatcgagactggaggaaggaggcctaaaatgtaatgaagatctaacaaatacttactgaaaaggggcaagggccacatctggtttatctttcttccagggcaataagagaattaaattcactgtgtataacacacctgattaaagagctctgcagatttgtgatgtttcaatttgggggaaggggta

SEQ ID NO: 117607 - DNA, 601 bp, Human
tacttatcagggaaattacgtttcaggtaccaaaaatatcacctctagcctttgaaggatcaggcacaaagtcagtctgaattttgttaaacattggtcatcatcagttcctttgctttctaattcaaggccttcatgtgtatgtctggcaatcactttgacctacttagtaggtaacaaacatgatgccaccagctacagtgattatttaggcttatgtaacactataaatgaaaaggggagtagtagagcacccccattatctaaagcggggatcagcaaactttctctgtgaagagcyagacagtagaattttaggttttatgggccacatagggtttgtgtctcatattattctgtgtcgttgtcataaccctttaaaaatgtacaccacccactcttagctcccacactatacaaaaacaggccgtggcccaaacaagcagtggtttgctaacccttgatctaaagcatatatctttctccatgtattaaacgaactctgactgaatgcttactgaccattaattaagcagtcaaacattagtaagcatatttattacagcttaggaagacactttggatgactctaccaagcaac

SEQ ID NO: 117608 - DNA, 601 bp, Human
cactcaaaaaactattaaactggcaactcaagataaccaagcagtgttcctaatgaatgaataaaaacataaggatctctggatgcatctgctgttgaggagccactccagaggaatgaatgaactgtgtgaggctgcagttattagagctaggaaccatttctagcttcaaatcatatcacagtgagatttcataaaataaaggtatccctggttagatttatgactgcaccatcatataaagccaccctttatctggtttatcactgtttgttagtaggagctgtcttcagcaactaasgtagcatttcaataaaccgggaagcagtatcaccaacttatttaaagagaatacaacctcaaacttattttgagatggagtttcactcttgttgcccaacctggagtgcaatggcacgatctccgctcactgcaacctctgcctcttgggctcaagtgattctcctgcctcagcctccggagtagctgggattacaggcgtgcgccaccacgcccagctaattttttctatttttagtagaaatggggtttcaccatgttagccaggctggtctcgaactcctggccccaggtgatccgc

SEQ ID NO: 117609 - DNA, 601 bp, Human
ttaaacaaagccttaaacacataataaacccagaaacgaatggtccaaatgttagaaaaacaatcttttggcaactctgaagtcacacttaaggtctgatagagatttgttactcattatgcctgcaatatgaaaatactgttctcacaatccagcacaccttatcctagtaaaaacactgcagattttaaatacttacttagccatagcatctttaacattcttatttgcaagtcctagataatgatctatctgtgcctgaaagagaggtataaaggaattattaccgttgctaaagaakcttattaaccactactatgtgtcaagctaaaggcttaagaaaccatcacacttctcatttttgtaagacattgaaaatgggcactaatacatccgtaaatcccatgtaatagagtgagtgctctattctgaagtcagcagttagttaggaaattacctgatgccgttcataaataacaggaacactgaagagtgaaatgagagctgaaaagggaaatatacaacttttcaaaaagaacggaatgatttgggaggaataaacactcaaaaaactattaaactggcaactcaagataaccaa

SEQ ID NO: 117610 - DNA, 601 bp, Human; identical to SEQ ID NO: 20536

SEQ ID NO: 117611 - DNA, 601 bp, Human; identical to SEQ ID NO: 20537

SEQ ID NO: 117612 - DNA, 601 bp, Human
gaagctgggcgggtttgagagcctgagaggaggcctgtgtggaaatgcctagagaaggagcagcatgatactgatgagggtaagagagatccagaggccagtaggcctcgtaggcagtgtgaagtcatcgaaaggctttagccagctggatgacacgatccagtttagattttgaaatatggcttcagtgtatgggccacctaggaaacttgtaataggccagaaatggtagtagcttgaactacaatggtggcattgcagatggggaaaatggaaatattttagagatactaggaatgtwtattcaataggatctggtaatggattgggactgggtcagggagaaggtgtaaggaagaaagtactggtttacacagctatagatggataatggttccagtcatggaggggtttagaaggggagatgatgaattcagtcttggacatgttgattgtcaggttcctgtaagtcttccaagtagatacactgagaaggcaggtggatattctgctttctcaagaagcaggagagaggtataagctagagatacatatttgtgtggcatcgacatgtatggccattaaggctgtgggtactgat

SEQ ID NO: 117613 - DNA, 601 bp, Human
ttacattcccagcaatagttgtataagatttcccttgttttgcatttttaccaatacttaaaatggcctgccttgagttgttgatacttgtgtcatttttgacatctgtcatccagactcaacctcctagggagcttgacccttcccttttttcagttttctctctagcctaggttcagtcagcaagacctatcagatttttcttttatattgcctttgtccttcctccattgccacagctcaaatattagtcatatatggagtaaatatcaggtgatttggatatcaggattatgacagyagtctgccagttggtgcatcttctagtatttctgcttttccaataaatcctgcacagccaagaaaatgcttcatgaaacaccgcaccattgctctgctcaaaagccgtcaacaacccttcattgcccattggatatcagccttcctccccctcttccttttccacctgtacctctcttccttcctcccttcttccgttctttttttttaattaaagtgtaatatatatgaagtgcactatgacagagattaaagtatagagcattaccaacacccagaagcctccagtttgcctcttcct

SEQ ID NO: 117614 - DNA, 601 bp, Human
tattcaaggcctttgtgaaatttttattaggttgtccatctattaaattgtagaaatctttacatattttgagtgagttcttttttgggtatctgtattagagtcttccttagactgtggcttgtattttcactctctaatggtgtcttgtgatgaaaatctttgttttaatgaagtttgatttagtaattaaactttattcttattgcccttgtttcttgtttaataaatctttgtctaacttaagatcatgctgatcttttccaggtattttattttttttattttttttgtttttgaracagagtctcactttgttgcccaggcaggagtgcagtggcacgatccggcaccctccacctcctgggttcaagagattcttctgcctcagcctcccgagtagctgggattacaggcatgcgcccagctaatttttgtatttttagtagagacggggtttctctattgttggccaggctagtctcgaactcctgacctcaggttatccacccgcctcagcctcccaaagtgctgggattacaggcgtgagccgccgtgcctggccaggtaataaaagagccacctggctcttttatttata

SEQ ID NO: 117615 - DNA, 601 bp, Human
gcctcccgagtagctgggattacaggcatgcgcccagctaatttttgtatttttagtagagacggggtttctctattgttggccaggctagtctcgaactcctgacctcaggttatccacccgcctcagcctcccaaagtgctgggattacaggcgtgagccgccgtgcctggccaggtaataaaagagccacctggctcttttatttatagtttgtgaagagttttaatcatgatattatgatattaaattttctcaaatatttttactgcatatattaagggaatcatatgttttctcycttattttattaatttgtggtatatattgattgctgtttaaatgataaattgccctcacattctcatagtaaacctaatttggtttgatgtatcatctttttaatataatgctaaatctgacttgctgatattagttattagaacttttgcatctaaattcatgagagagactgccctattatttttttgtggtaactttgtcaggttttggcatcaagttttatgttgctctcagaaagcaggttgagacattttccttttttttttttctattctttgaaagactttagataaaattg

SEQ ID NO: 117616 - DNA, 601 bp, Human
cttctctgtgggaaggttttaatttccgatccaatttctttgatcagcataagctgttcagatttcctgttttttcttgggtcacttttggtatgttgcattttgcagtttgttcattttatgtaaactctcacatttaaagtttgaaatttttttaaaacaacctactgtcttgtgactaggatggatcagtgatgatgtctcattttttattctgatattggtcatttgtgcttgctttcactccatttctgtctcctcgatcagtcttggtgtgttttatcacttttgtgcctttttkcaaagaaccaacttttggctttgctgattttctctcgttcatttgttttgtattttcattgatttctgctcattattattttcttccattactctctgaattttagttgttcctttagcttcttgagatgaatactttattgatattttttagtcttcttttctcttaaatacatttaaagttaaaaattttccctctaaccacaggtttaaatgtgtcccacaagtttttctttttctttttctttttttgtttgtattttttcttttttgttttttgtattgttttttccttttatac

SEQ ID NO: 117617 - DNA, 601 bp, Human
gtcttgaactcctggcctcaagtgatctgccggtcctggcctgccaaagtgctgggattataggtgtgagccactatgcctggccaatgtttgtcttttaattggagtatttagtccatgaactttttttttttttttttgagacggagcctcgctctgtcacccaggctggagtgcagtggcactatctcagctcactgcaacctccgcctcctgattcaagcgattctcctgcctcagcctcctgagtagctgggattacagatgcccgccaccacacccagctaattttttgtttttygttttttgtttttttttttgagacggagtctcgctctgtcgcccaggctggagtgcagtggtgcggtctcggctcactgcaagttccacctcctgggttcatgccattctcctgcctcagcctcccgagtagctgggactacaggcgcccgccaccacgcccagctagttttttgtatttttagtagagacggggttttaccacgttagccaggatggtcttgatctcctgacctcgtgatccacctgcctcggcctcctaaaatgctgggattacaggcgtgagccactgcgcccggcc

SEQ ID NO: 117618 - DNA, 601 bp, Human
gtctcattcttttctgtatagattccagctctttggtctgggtttccatcttttagcctgttttaatggccatgccccattattgaaatagctgaatcccttggcatctgttctgttgtcttctttttcctcttggctttcagtcatctgtttctctttcctggtatgcctgtagttttttttttttttttttttttaattcaatgatgagtattgtgtatgaaaaaatatacggaggtcaggtgctgtggctcacgcctgtaatcccagcactttgggaggccaaggcgggtggatcatstaacgtcaggagttcaagaccagcctggccaacatggtgaaaccctgtctctactaaaaatacaaaaattagcgaggcgtggtggcgcacacctgtaatcccagctactcgggaggctgagggaggagaatggcttgaacccgggaggcggaggttgcagtgagccgagattgtgccattgcactccagcctgggtaacagcaaaactctgtctggaaaaaagaaagaaagaaggaaaaatatatgggttctgagtatgttatcttcctccagaggaaattttagtgtttttctggcaag

SEQ ID NO: 117619 - DNA, 601 bp, Human
gtccagtgtttgttccggatgagactgctgcggagtctagtttatgcctttctatgtggcccagtgtgccttgcatatgaataaggaaatgctctgaggccagaggctgcagggaagccagctcagagcatttgtcagtactctccaatcctggctatttggatccttctggaatgccttcaaaccatttgctctctttgcttgcttgtttctttttggtattttatccagcttgcatagttgttctcagagggcgggtcagcctggtaccttctgctgggccatagctagcagcgtaagmcttggagccctggcacttgaaaccccacactgtccaagcacaacttacccagccttgcctcttcacagccacctgttgtgtccaccctgtgcttagcctagactttccacacaaccttttcttgctgctctctcagtcctgtccattcccatcaaaaatcgaattgttcttcagacctgtacagtctccacttctgattcctggcattgtgacccatgagattcttcctctgcagtgaattcatagcaataactgaccggccactgtagcatttcttgatgtattatatcatgtgccttg

SEQ ID NO: 117620 - DNA, 601 bp, Human
tctgaggccagaggctgcagggaagccagctcagagcatttgtcagtactctccaatcctggctatttggatccttctggaatgccttcaaaccatttgctctctttgcttgcttgtttctttttggtattttatccagcttgcatagttgttctcagagggcgggtcagcctggtaccttctgctgggccatagctagcagcgtaagccttggagccctggcacttgaaaccccacactgtccaagcacaacttacccagccttgcctcttcacagccacctgttgtgtccaccctgtgsttagcctagactttccacacaaccttttcttgctgctctctcagtcctgtccattcccatcaaaaatcgaattgttcttcagacctgtacagtctccacttctgattcctggcattgtgacccatgagattcttcctctgcagtgaattcatagcaataactgaccggccactgtagcatttcttgatgtattatatcatgtgccttgtatttagctttcatccagttgggggagggcggggatgttgtagtgtacctctttgtaccaagattgatttgctgcatatcttgcaggtgaaa

SEQ ID NO: 117621 - DNA, 601 bp, Human
ccatttgctctctttgcttgcttgtttctttttggtattttatccagcttgcatagttgttctcagagggcgggtcagcctggtaccttctgctgggccatagctagcagcgtaagccttggagccctggcacttgaaaccccacactgtccaagcacaacttacccagccttgcctcttcacagccacctgttgtgtccaccctgtgcttagcctagactttccacacaaccttttcttgctgctctctcagtcctgtccattcccatcaaaaatcgaattgttcttcagacctgtacartctccacttctgattcctggcattgtgacccatgagattcttcctctgcagtgaattcatagcaataactgaccggccactgtagcatttcttgatgtattatatcatgtgccttgtatttagctttcatccagttgggggagggcggggatgttgtagtgtacctctttgtaccaagattgatttgctgcatatcttgcaggtgaaagcatgtattgccaatgtagaacccaaccaaacagtggagatcaatgagcaagaagcattggaagagaaattggaaaatgtgaaagccattct

SEQ ID NO: 117622 - DNA, 601 bp, Human
aaaatgtgaaagccattctgcaggcatatcattttacaggttttgtttgtttttttaacctaatttagtctgggtctgcctctagtgagttagtttgctagatgtgttatcagtcctggaattatttcataatttatagtattttacaccctctgccctcatcactcacacacacacacacacagacacacacacagctgacgtgctatttgtaggcctatcttcacctacaagattgactggcccctttgtacagcagctcagttggtggctggcttattccactcatcttaacagttcktcatgtgccagaccttgtactagaactgtctttactgctggcttgttttctgccactagtgaaatagtttgaactttccaagtctccgtttcaccgtaaatagggatttattctcccatctatgccacaagatagttgtgggaagaactggggactctgacaaattacttcacactcagaaataaagaatagctataaattaaatttttggccttgcttatgcctgtaatcccatcactttgggaggctgaggcaggattacttgagtccaggagttcgagaccagcctgggcaacatag

SEQ ID NO: 117623 - DNA, 601 bp, Human
gaggtggcatgcgcttgtggtcccagctgtttgggaggctgagatgggaggatcatttaagcccaggaagttgaggttgcagtgagctgagatcgtgccaccgcactccagcctgggtgacagagtgaaaccctatctcaaaaaaaaaaaaaaaaaaatttctcaatagtttgacatttaggttgttttttcatttttaccattcttccatggttttaacaactcagtctcaaagtgagccggagccaaggggaagaatgagcctatgatactcattgaacaaacatttgtgtacaaagtrtacatattctaggcactgtggaagctactggaggcacagatgagtaagacatcaccttggcctgctgtctattgaggtgtcttcttgtttgcctcaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagt

SEQ ID NO: 117624 - DNA, 601 bp, Human; identical to SEQ ID NO: 29226

SEQ ID NO: 117625 - DNA, 601 bp, Human
gtgctcgagatcacagaacattttcctttaaaaggaaatgatgccaataacttactacgaaggcggccgaggaacgtgtgtattggctttgtagcaaatgtaatgccctggatcttcctacgagtcctctggtactatgaggtactaacctccactgtaattaatcttaccgccacaaattccatagtgatcctccttccctaaaactatagtcctctgggattctctgggctagttgaggattgctaccctgtgccttcaaccctgtgatgtgggatcccagacttccctatctgttaactaaagggctgttttcaatcaaataattgttacgagaagcagactggcgcctgtagcactgctgttggagatccaaataggagattgggttgggaagtttttcccttgagtctctgctattttaatgtttaatttgcgctgtcgaggcgagtgtgtgtgttgcatctggacgccagggtttgcccaatctttgagtgtttggttaaatgttcaaactgtggcttcctcccggcgccagtcgcccgcctctgcccttaggttacattctcttaaacatgcctttctcccccactctttcgca

SEQ ID NO: 117626 - DNA, 601 bp, Human
cactatggagaacagtttggagggtcctcaaaaaactaaaaacaggggtaccatacgattcagcaatccgactactgggtatatatccaaaagaaaggaaatgagtacatcaaagagatatctggactcctatgtttgttgcagcactgtttacaacagtcaaaacttgaaagcaacctaagtgtccaccaacagataaatgtataaagaaaatgtggtacatatacacaatggagtactattcagccataaaaaaagaatgagatcttgtcatttgcaaaaatatggatggaactggagrtcattatgttacatgaaataagtcaggcatagaaagacaaacttcacatgttctcacttatttgtggaagctaaaaatcaaaacaaactcacggagacagagtaaaaggatggttatcagaggtgggaagggtagtggtagggaagtggagatggttaatgggtacagaaaaaatgagttagacccgatatttgatagcacacagggtaactacagtcaataataatttaattggacatttaaaaataactgaaagtgtaactggattgtcacacagaagacaaatgcttgaagggatgg

SEQ ID NO: 117627 - DNA, 601 bp, Human
attttacatttaaattcaaagcaatattcagaaataattatgatttggtttacctttctgtatgcatcacatacaaggatcatctcatgtaaaagtctcccatctggagttgttttaggaacaatttcccaaaataccagaagtaatttcttgatagtgtgatcctgaagaggtagcacaaaacgaatgatggtcatcagaagtccaggaagtttttcaccattcagaatcataatgattactttcttcaaagcttcagtctttgactttacatctcctttttctgaatcaaaaatttttaaaaaaaaaagcacaattatttcaaaagaaaattcatcacataaatttaaaagcaattaacaaaataaaatgtaccttcttacttcagtatcagcaatggtaataaaagtacaaacccaagtgacaaggttctccacctggttctccaccaaataatctgtctttgctcaagtcatttatctctggaaatcagactctttatatataatatgaaggcgctggattagatttctggttcctaaccaattgagttaatgcaggctccatgaatctacagtcataccaagtaaacgtgtttcaa

SEQ ID NO: 117628 - DNA, 601 bp, Human
attattttgaagcaaatcacaggcaatgtatcctttcttctgtaaatatattggtaggtttctctaaaatcaaggactctttacttgcaaaactaattattcatcatcacacctcacaaaattaataatttcctaatatcaagacatagtgttcacatttccaattgtcctataaatggcctaatttttctatgtgcactatagtttaaattctgaaatttgtgtagtctgtatggtaacattaaaggaactcaccctacattattattattattattatttttattattattttttgagrtggagttttggttttgttgcccaggctagagtgcaatagcgcgatctcggttcatcgcaacctctgcctcccaggttcgagcaattcttctgcttcagcctcctgagtagctaggactacaggcatgtgccaccacgcccagctaattttgtatttttagtagagacggggtttctccatgttggtcaggctggtctcgaactcccgacctcaggttatcggcccgcctcggcctcccaaagtgctgggattacaggcatgagccaccacgcctggctcatctacattattaaccagaat

SEQ ID NO: 117629 - DNA, 601 bp, Human
actttactattttagtaactctctggacaataccaaaattaaatttaatcaaactttacaacatacttttgcttttttttttttttggagacagagtctcactctgttgcctgggctggagtgcagtggtgcgatctcagctcactgctgcctccacttccagggttcaagcaattctcctgcctcagcctcccgagtagctgcgattataggtgcccaccactatgcccagctaattttttgtatttttagtagggatggggtttcaccatgttggccaggctggtcttgaactcctgayctcatgatttgcccaccttggcctccaaagtgctgggattacaggtgtgagccaccgtgcccagacaaggctagagtgcagtggagtgatctcggcttactgcaacctccgccttctaggtcgagtgattctcctgcctcagcctcctgagtatctgggactacaggcacgtgccaccatgccaggctaatttttgttatttttttagtagagacagcattttgccacgttggccaggcttgtctcatattcctgacctcgagtgatccacccacctcggcttcccaaagtgctgggatt

SEQ ID NO: 117630 - DNA, 601 bp, Human
tatcaataaattttattggactatttctgattacgcccctcaatgtaggttaacagcataatgccaaaagcattggtcagtaaaaccaattacacaagaggacaaaacactgctcatatacgcagctttctcataatcttgtttaggaagacaaaatgacaatattgaataccacttcacgtgcctattaacattgctactatcaaaaaaacaatagcaacaagtgttggcatggatgtggagaaaatggaacccttgtgcactactagtgagaatgtaaaatggtagagctgctgtgcaraacagtatggcacttcctaaaataattaaaaacagaattgctgtatattcagtaaatccacttctgggtgtatacccaaaataacagaaagcaaagtctcaaacagatacgtgtacatctacgttcacaatagcattattcctaatagctaaaagattgaagcaacccaagtgtccaccaatggatgaacaggtaaacacaatgtagcatatatttacaatggggtattatttagccttaaaaaggaaagaaattccaacacatgccgcaacataaatgaaccttgaagacattaggcta

SEQ ID NO: 117631 - DNA, 601 bp, Human
agttcaacaataaccagctgcagaatgtctccaaatgtttgaacttgatcaatgcaagtacttaagtaatccaaagctcgatcctaaaaaaaataagaatatatttatcattctccacctcattcaatagaaggacttaatgcatcttaaaaaatacacacattacaactcaatataaaacaaatgaggagatcagggcaaagagaaattaactgggaaaaaaatcaagaataaaattaacatataaaatataagacataaagttaaatatattttctggaaatgagccacaaacctgggrtctgattttctagcagctaaaccaaagagggaaaacactatgtgttatgggattcagggtatccatacaatcaaaaccagctgcttaggtgtatagttattcctattactgagacctaaaagaaaaatctcctatgtgtcctcatatattggacactgtaatatacagaactacaatgctgaaaacatctctccagtaaaagtatcaataaattttattggactatttctgattacgcccctcaatgtaggttaacagcataatgccaaaagcattggtcagtaaaaccaattacacaag

SEQ ID NO: 117632 - DNA, 601 bp, Human
aataaagccatctggacctatgttttgttggcctctaatggtatcaatagcaaagttggatcttcttgtaccttttatcagaacattaagatgtaaccaactctttcaaaggatatatcatagtaaagtgttgccaatatagtatttgatttaaaaatccaaaattcttagctggttttagatttcctgtcaatggcctacaatgtcatattaatgcatttaaagtttttctattctcttttacaaacagggaacataaaaagtatttaaggcttttttgtttgattttagtctgatgtawgctcaagaaaatcttgaattttattttaaagcctaattataatctattcagtgactgggaagttcacaatgatttatgtgcagctacactggctcaagccatgaatttttatcaaaatctttatggaggtttagaaaggatataagcaagtattctacttggaaaatacaataaaccaaaagtaaaagaaacaaaggctttaataggctatgctataaaatatttatactattaaaatatattatcctagcaataattatcccagaaagaaagtatttaaccctgtcttaaactgctgag

SEQ ID NO: 117633 - DNA, 601 bp, Human
atgtgtatgctatacacaagtgaaagagaaaaagaaaatgtaaagtaacaaaagtaaggacacattaacccagtacactaatatgggtactgtcacaggatattaaatttggtcctaaatgtttattctggatgccaaagggaaacatgacggatgatataaatctcaatagctaataaaaggaaaataccagtttttcaagcaagaaagataacacatttttcccaagtactactacttattatttgagactatattcaacattggagagaaaactaaaaatttctatcccattctaaaygtatcctgatacctttacttgtatagtaaatatcccttattttttctcttttgaagtcagtatttgtagtagattttcctaaaatatatatagtcaaaactctattacatggacatgacttaaaagttatttccttttactataacatggaccctacttaagtcattagatagcagggaaccgctaattttgagaacctcagtggtatcctaaactatacacatgaattaaaaagaactataggctggacatggtggctcacgcctgtaatctcagcactttgggaggccaaggtgggca

SEQ ID NO: 117634 - DNA, 601 bp, Human
gtaatcccagcattttgggaagccgaggttagcggatcacttgaggtcaggagttcaagaccagcctggccaacatggtgaaactccatctctactaaaaatacaaaaaattagctgggcatagcggtgggcacctgtaatcccagctactcgggaagctgaggcaggagaattgcttaaacccaggaggtggaggatgcagtgagccaagattgcctcactccagcctgggtgacaaagcaataccttgtctcaaaacaaaacaaaacaacccatattttgtatgttaaatgtattatayaatgtattcttataaagtaagctagaaaaaagaaaatgttaagaaaagcataaggaaaatatttactactcattaagaggaagtagatcatcataaaggtcttcatccccaacctctttacactgagtaggctgaggaggaggaggaggaagaggaagagggattagtcttgctgtctcaggagtagcagaggtagaaaaaaagtccatgtataagtggacctgcgcagttcgaacctgtgttgtcagaggttaactgtactgtcattctctgtctgtatctatatatgtgtgtatgaaa

SEQ ID NO: 117635 - DNA, 601 bp, Human
ctcctggttttaagcaatcctcccagcttggcctcccaaaatgctgggattttaggtgttagcctctgtgcccagccacgcacgtaacttttgactccccaaaaacttaactactaataacctactgttggccagaagccttaccaatgacacagttgattaaaacatgttttgtggccaggcgcggtggcttacgcctgtaatcccagcattttgggaagccgaggttagcggatcacttgaggtcaggagttcaagaccagcctggccaacatggtgaaactccatctctactaaaaayacaaaaaattagctgggcatagcggtgggcacctgtaatcccagctactcgggaagctgaggcaggagaattgcttaaacccaggaggtggaggatgcagtgagccaagattgcctcactccagcctgggtgacaaagcaataccttgtctcaaaacaaaacaaaacaacccatattttgtatgttaaatgtattatataatgtattcttataaagtaagctagaaaaaagaaaatgttaagaaaagcataaggaaaatatttactactcattaagaggaagtagatcatcataaaggtc

SEQ ID NO: 117636 - DNA, 601 bp, Human
ctctagtcccttgttatttttcaaacttacagaagattagaggcattacaaattaaaaggatgaaaaaaagctgctataggtagacatacttactaacagccaaaatttaagggttaaaactaaggaacaagccagaaaaatgcaggaaaagaatcccaagaagtacatcgattaagcatatttcagtttagaggcaaagtctaactcatctgcattgcagtacacaaacaacaagaatataaagatcacccagagttgttaaaatattttagtatttataataactattaataagacaawaaatgtgtaaagtattttagaatgatagaataaaatgtccatactgatacaaagaaagaaggaaggaaaagaagggagggagggaagagaaagaacagcccttccttgcataagaattccaataaataaatactgaatgagagaaatagaaaaccaccattagaataccaaagcaataattgtaagaaaatccactgatggatgctaaaataagtaggtgtgaatttgaggaacaacatatttgcatagtttcaaagtatctccccctacaacatgtactgattacactagaagaaatca

SEQ ID NO: 117637 - DNA, 601 bp, Human
ctctgcctcctgggttcaagtgattctcctgcctcagcctcccaagtagttgggattacaggcgcacttcaccacacccagctaatttttgttatttttagtatagacagggttttaccatgttggccaggctggtctcaaactcctgacctcagatgatgtgcccgcctctgcctcccaaagtgctgggattacaggcgtgagccaccgcgtccagccattttagaaatattttttgtggtaaagataataccccaaaaggctatgatgactcaatagttaacactttagctgatcaaamtataaactgctcagtttccaagcatttaggttaaccaagatgggcaaagcttgagaatgacctaaatttgaaaaacattttatttaggatctctctttttcagataacacttacctgtagtactcgttcatgagcaggatgctcttttaattctatcaagcgatccaaaactatgagttttacattgttgtcgctctccttaataattaaatcaatgtaacactgagcagcagcctatataaaaaaagaaatacattttaagaagttattcatctatcataaaatttgaaaataagcatg

SEQ ID NO: 117638 - DNA, 601 bp, Human
ttcaagaccagcctcacaaacatggtgaaacctcgtctctactgaaaatacaaaaaaaatttgctggatgcagtggcacgcacctgtagtccagatacttgggaggctgaggctggagaatcgcttgaacatgagaggcggcggttgcagtgagccgagatcgcgccactgcactctagcctgtgagacagagcaagactccatctcaaaaaaaaaaaaaaaaaaagaactgcctgaatccaggaggcggaggttgcaatgccctgagatagcgccactgcactccagcctgggtgacagrgcaagcttctgtctcaataacaaaaaaacaaaaaacaaaaaccaacaagattctgcagttctaaagtattttagataaatatttcagaaagaatctaacaaaacctaggtttcagttctctccagaaatcacaaagattaaaagtaaaataactgttcttattattaggaacattctaaaactggtaaacctagcagtaaaaataaaataccaaaatgtttcccagtaaagtgtccatttaggacacagtgaaggcaaatttggcttaatctcttactactctaagaaatgtattatttt

SEQ ID NO: 117639 - DNA, 601 bp, Human
tgaattctcactctgccacttactactttggacctcagtttcttaatctgctaagtggaaatcttaattctttctacacattttacctaatagaaaaatgcattggacagtgtctaacacaaagcagatggtcattaagtcgtattcctcttcttcattcctttccttgaaatgttaaccaaaacagtactcatccttctaaaatgaaataaatccgacttatttgtacataataacctcatcaactaacttttaaattaactgaatggctattatgtatttattactcaataccagtccrttacctaatgtaagagcactaagagtatttaatcattacctattttaatttattttataggtgaaaaacactgatgtcaagttaggttgaggaacttatattcaaggtcctccagctaactgtcgacacaacaatgactagaactaattgtcaggtctcctgataattagtccactgttctttctattctaccataaggttgttaggatgaagaatactgtcagttttagtgcataaatattctgaagtcagacttactctaaggcattcttccttcagaatacaggctaaagcagaatt

SEQ ID NO: 117640 - DNA, 601 bp, Human
aggaaaaagaaaaataatacatgactttaaaacttatctttggccaggtgcagtggctcacacctgtaatcccagcactttgggaggccaaggcgggcggattacctgaggtcaggagttcgaggacagcctggccaacatggtgaaaccccgtctctactaaaaatacaaaaattagctgggcatggtggcacaaacctgtaatcccagctactcaggagattgaggcaggagaactgcttgagcccaggagacaggttgcagtgagccatgatcgcgccactgcactctagcgtggccracagagcaagactctgtgtcaaaaaaaaaaaaaaaaaaaaaaaggaaaacttatctttgaatgacacaaaagccatcagaatatggaaagatacaatatttaattaggggcatacgtaattgcagctaatgaagtacctccgaattccagcttacctgtttatttactgggtaagcctcaaattcttcttccataaaatggagataatatattctatctcaaaggcttattgtcaagactatatgagacaaactacttagcacaatgcctagcacttagtgggtattcagtaaaatttta

SEQ ID NO: 117641 - DNA, 601 bp, Human
aggaaagagacggggtaacagccagttggtggagcagtcggaacacacacaacaattattgattacgtttactattttatatgggaatggttcctggcatcccaaaacaactatgatagtaacattaaagatcactgataacagatcaccataacagatgtaataataatgaaaaagtttgaaatattgtgagaattaccaaaatgtaacacagagatatgaagtgagcatatgcttatttggaaaaatgatgctaacagacttgctcaactcagggttcccacaaaccttcatttgtttaaaaaaaaaaaaaaaagcaatatgtgcaaagtacaataaaatgaagtatgcctgtaaatgctatgtaaataattgttacactgtattgttttcaactttctattattttttactgtttatcattttttaaaaaagatattttcaatccatagttggttgaatctgcaggtgcagaagctgtgaatatggaggaccaactgcataccattgtaaatgggtgtttggttagaacggtcagaagctacaaagcaggcatgaactacagatgagaataacttaagagacattctgggataaaaca

SEQ ID NO: 117642 - DNA, 601 bp, Human
gacctcgtgatccgcctgtctcgggcctcccaaagtgctggtgtgagtcaccacgcctgccaaatgtttcactttcttatcattcatgtgtttactggagtagcacttttaatttcctttaagagcatttcctttgcatgcataacttggctacctacttggcaaaagcagcctagcttttggcttagctcagcttttgacatgcattccttactaagtttaattatttctcacttttgatttaaagtgaaagacatgtgactcttcccttcacttagaagccactgtaggattattaacyggcctaatttcaatattgtggtatctcagggaatagaatagggaggcccaaggaggaaagagacggggtaacagccagttggtggagcagtcggaacacacacaacaattattgattacgtttactattttatatgggaatggttcctggcatcccaaaacaactatgatagtaacattaaagatcactgataacagatcaccataacagatgtaataataatgaaaaagtttgaaatattgtgagaattaccaaaatgtaacacagagatatgaagtgagcatatgcttatttggaaaa

SEQ ID NO: 117643 - DNA, 601 bp, Human
ttttttagatcaagctgttagtctccaaaaacgaaggaaatatgagtgatgtgagtgaaagtgtttcaatttagaaacctgctgtatagataaccaacataatacgaaagctgaaggaatcaaaaggagtcccattgctacaggcccaatttgaatgtcagaaattgctgtggtaggacattgtaaccaactctgcgctactaccacaaatgttctatggattctgtttcttaaataataagagttgaaactacttgatcagtggcagcataatggatgttgtcttagcaggcatgaaaayattcatttctttctacatctccatcagagctcttgggtgaccagctaaattgtcaatgaacagtaatattttaaaaggagtcttttatttctgagcagtaggtctcaatggtgagcttaaaatacttagtaagccatcccgtaaagaggatgtgctgacatccaggctttgttgttccactgacagagcacagacagagttgattaagcacaattcttaagagccctaggattttcaaaatgggaaatgagcaatggcttcaacttaagttactggttgtattagcccttaccaaaagag

SEQ ID NO: 117644 - DNA, 601 bp, Human
aattattgctcaaaaatcaaatcaattaagggataatataccttgtaaattatctggctctcatttatggcttttcttataatggaattaaaacaaaaacaaaaagaacctggccaggcacggtggctcatgcctgtaatcccagcactttgggaggccgaggtgggcggatcacctgaggtcagcagttcgagaccagcctggtcaacatggtgaaaccccagtctctactaaaaatacaaaaaaaattagacaggcgtggtggcaggcgcctgtagccccagctactcgggaggctgarccaggagaattgcttaaacccaggaggcggaggttgcagtgagctgagatcatgccatggcactccggcctgggcaagaagagtgagactccgtctaaaaaaaaatttttttttagatcaagctgttagtctccaaaaacgaaggaaatatgagtgatgtgagtgaaagtgtttcaatttagaaacctgctgtatagataaccaacataatacgaaagctgaaggaatcaaaaggagtcccattgctacaggcccaatttgaatgtcagaaattgctgtggtaggacattgtaaccaact

SEQ ID NO: 117645 - DNA, 601 bp, Human
aaaaccagcagaagagtaagtatatgtcccccaagtttggatactgtctccaaaaggagaggaaagagaggaggggacagaaaaaaaaatccgaggaaatgactgaaaatttcccaaactgatggagatataaacctgcaaacccaacaagctcaatgaaccacaagtacagcaaacatgaagaaaaccacactaaggcatatcctaatcaaattactgaaaccaagtgaaaaggagaaaatctaaaaccagtggaagaaatacacacacacacacacacacacacacacacacacacacwctctctctctctccacccagggagataagaatgacagtagacttctcaccaaaaagccagaagacaatggagctttacttttacactactgggaaaaaaaaacagaagacttagaatcctatacccacaaaggtaactttctaaagtgtacaaaaaaataggctttttccagacaaaaactggaacaatctgttgccaacaaatctgcactataagaaaagttaaagcaaattctttaggcaaaagatgtatgataccagaaacttagtcctacacaaagaaatgaagagtgttggaaat

SEQ ID NO: 117646 - DNA, 601 bp, Human
cattacatactgcacatatttattttatatatctgttttcccttactcaaccataatctatcatttgttcctcaccatggtagccctatccttatgacagaaattgcaacaaaataagcttactgactgaatgactctatacaagctaatccctaggtctgagatacccttgtgcacctagcaacaaatgactcaggtaaaatattatcctttgataacacaccatcttcctttataaagccttccacactgttagcattttttttttccctaacctcaaagcatatggtatataaaccawcctgtaacacactggactacaattatatattgccttagctagctcctccttttgcctgacagtttctagaggacagtgactctatctggttcatttctgtacatccagaacatagttcaatgcgtggtaccatagagagtatctcataaattatgaataaatggatttagatcctctcctcatacaatgtccccagctactcactatagaaattcttcagtaaaagtattcaaacattacatgccataaaacagcaccttacctatattaccaaaaattattccattttctgttgatgct

SEQ ID NO: 117647 - DNA, 601 bp, Human
atctgtagtcttctactgagcacttgctcctccatgaagccttttctaagcttttctcccaatcccccaccactctgagaactgaccaaatccctttatggattcctaccttacttagtacaggtttacttatttttttctttcacagtacttaccattacatactgcacatatttattttatatatctgttttcccttactcaaccataatctatcatttgttcctcaccatggtagccctatccttatgacagaaattgcaacaaaataagcttactgactgaatgactctatacaagytaatccctaggtctgagatacccttgtgcacctagcaacaaatgactcaggtaaaatattatcctttgataacacaccatcttcctttataaagccttccacactgttagcattttttttttccctaacctcaaagcatatggtatataaaccatcctgtaacacactggactacaattatatattgccttagctagctcctccttttgcctgacagtttctagaggacagtgactctatctggttcatttctgtacatccagaacatagttcaatgcgtggtaccatagagagtatctc

SEQ ID NO: 117648 - DNA, 601 bp, Human
tggtccaggaccccactccaatcactatctctttcatccttatgtctttactttcccattctctaccaactttcttcccttatggtctataaatatactcgaggttctcttattttcaaaaaataaatcctcactcattcttgccttctcttcttggtactgccccttcttattcctatcaaagccaagatcctacactcagaatagtctacactacctgtatttcttcatatcgtatttagtcttcaacccaccactaacacccaagatgtcccacaagaaatgttttaaaatcactaayagccaaatccaaaagacctctctttcagactttaataactaaagttattttatcttgtggagcttcaaatactttctgaaggtttttccttacttttctaaccacacttcagatacccttgtaggctctttctcctttgaccaagctttcagtgttgctgtttgcttggattctgttttcaaatctcccctctttttagtctgtatgccctctctgggtgatttcttctattcctatggcttttaaacaaatacttatctctagtttatttttacttatttatttatttttgagacagag

SEQ ID NO: 117649 - DNA, 601 bp, Human
cctcagcctcctgagtagctgggaccacaggcgcctgccaccgcgcctggctaattttttgtatttttagtagagatgtggtttcaccatcttggccaggctggtcttgaactcctgacctcatgatccacccgccttggcctcccaaagtgctgggattacaggcatgagccactgtgcccggcctctaggctcttttcttgacattcttccactctttcaactttcagggaaaactgaggctaccaagaataagctcctttaattttcagctccacatctaaaaacaactctctctctyggaattcactctcacatccttccctctcatacgtatcagagaagtactacctcatttcttcaagattaatacttcctgccatctgtgattcctgctttggtccaggaccccactccaatcactatctctttcatccttatgtctttactttcccattctctaccaactttcttcccttatggtctataaatatactcgaggttctcttattttcaaaaaataaatcctcactcattcttgccttctcttcttggtactgccccttcttattcctatcaaagccaagatcctacactcaga

SEQ ID NO: 117650 - DNA, 601 bp, Human
aataagattgtttatataatacttattatgtacagagctctattctacatgctttataaatattactggtttaatactcccatcaattctgatagtattattattttccatcttacatatgaggaaatgaaagcagagaagttaagtaagttgttccagatcacacaactgataagtggtggggataggattcgaactcaggcacactttgttttttgtggttaaacaaataattcaattcagtgagtacttacatagcagttgcagcatactaggcactgcagcagatatacaagtggaygatgttcccataggaggtacttaactaatacttttgaataaatattgctgacccatactacttaatgatacaagattagtcatccctcagtattaatggggaattgcttccaggaccccctatggataccaaaatctacagatgctcaagtccctgatattaaatggcatagtatttgcattacctatacacatcttctcatatattttaaatcatctctagcttacttacagtacctaatacaacataaatgctatgtaaatagttatactgtattgtttaggatataatgacaaggaa

SEQ ID NO: 117651 - DNA, 601 bp, Human
gatactacatatagaaataataaagtcataaattcctcccccctttgtcagtccagagatactctcaaaaaaaaaggaactgttacctggctctttgcacgaattcttatatggccggtaacagcagcatctggtccctggtgaattggcttctcaatgctgacatttgcaagtgcatcttcaccaaatatggaacgagcataaaggttggctgccataaagccacagtaaccagaaagggcctggaaaaaatttgtgataaattcattactttaccagatacctacatagaggcaaaaaycaaacagcataggtgactttttttttttttttttgagacagagtctcactctgttgtccagcttggagctggagtgcagtggcgtgatctcggctcactgcaaccttcctcccaggttcaggcgattctcctgcctcagcctcccaagtagctgggattacaggcattcgccaccacacctggctaatttttgtaattttagtagagacagggtttcaccatgttggccaggctggtcttgaactcctgacctcaagtgatccacccgcctcggcctcccaaaatgctgggactgcaggt

SEQ ID NO: 117652 - DNA, 601 bp, Human; identical to SEQ ID NO: 117626

SEQ ID NO: 117653 - DNA, 601 bp, Human; identical to SEQ ID NO: 117627

SEQ ID NO: 117654 - DNA, 601 bp, Human; identical to SEQ ID NO: 117628

SEQ ID NO: 117655 - DNA, 601 bp, Human; identical to SEQ ID NO: 117629

SEQ ID NO: 117656 - DNA, 601 bp, Human; identical to SEQ ID NO: 117630

SEQ ID NO: 117657 - DNA, 601 bp, Human; identical to SEQ ID NO: 117631

SEQ ID NO: 117658 - DNA, 601 bp, Human; identical to SEQ ID NO: 117632

SEQ ID NO: 117659 - DNA, 601 bp, Human; identical to SEQ ID NO: 117633

SEQ ID NO: 117660 - DNA, 601 bp, Human; identical to SEQ ID NO: 117634

SEQ ID NO: 117661 - DNA, 601 bp, Human; identical to SEQ ID NO: 117635

SEQ ID NO: 117662 - DNA, 601 bp, Human; identical to SEQ ID NO: 117636

SEQ ID NO: 117663 - DNA, 601 bp, Human; identical to SEQ ID NO: 117637

SEQ ID NO: 117664 - DNA, 601 bp, Human; identical to SEQ ID NO: 117638

SEQ ID NO: 117665 - DNA, 601 bp, Human; identical to SEQ ID NO: 117639

SEQ ID NO: 117666 - DNA, 601 bp, Human; identical to SEQ ID NO: 117640

SEQ ID NO: 117667 - DNA, 601 bp, Human; identical to SEQ ID NO: 117641

SEQ ID NO: 117668 - DNA, 601 bp, Human; identical to SEQ ID NO: 117642

SEQ ID NO: 117669 - DNA, 601 bp, Human; identical to SEQ ID NO: 117643

SEQ ID NO: 117670 - DNA, 601 bp, Human; identical to SEQ ID NO: 117644

SEQ ID NO: 117671 - DNA, 601 bp, Human; identical to SEQ ID NO: 117645

SEQ ID NO: 117672 - DNA, 601 bp, Human; identical to SEQ ID NO: 117646

SEQ ID NO: 117673 - DNA, 601 bp, Human; identical to SEQ ID NO: 117647

SEQ ID NO: 117674 - DNA, 601 bp, Human; identical to SEQ ID NO: 117648

SEQ ID NO: 117675 - DNA, 601 bp, Human; identical to SEQ ID NO: 117649

SEQ ID NO: 117676 - DNA, 601 bp, Human; identical to SEQ ID NO: 117650

SEQ ID NO: 117677 - DNA, 601 bp, Human; identical to SEQ ID NO: 117651

SEQ ID NO: 117678 - DNA, 601 bp, Human
tgatggccgggctcgcgcaggtaatcccagcacttagggaggccgaggagggaggatcacttgagaccaggtattcgagaccagcctggctaacatggcgaaactcttgtctctactagtaaaagcaaacaaacaaacaaacaaaaattagccaggtgtggtggcgggtgtctgttttcccagctactcaggaggctgaggcacgagaatctcttgaatccaggaggcggaggttgcagtgagccaagatcacgccactgcactccagcctgggagacagagcgagactctgtttcaaaaraaaataaaaactaaaaatataaaggaccaggcttctgcatcagaagtagccaagggcattctgatgaaaagatgcagcttagcccccagaggcctgcttgagaattcagcaggaatgcggctgccttaaagacttatcaccgggcctatcatactccatttacaaagtgactctctcccaccgggcaaggagttcttgaacgtagggacctctagtcactacctctatccccaaagcccagcacaatgccgctgcacaatttgctaaactcgcagcctgggtcaacgggagaatcggagg

SEQ ID NO: 117679 - DNA, 601 bp, Human
aacacacacacacacacagagtcatatggactctaaaaattatttttattaccagtcatactaaaatagttttgcttttatagcagcagctgtgggtgtaccaattaagccataacctgctttcgagacttagcacgattataagtatttcctcatgtttccaaatatttttatgaaattatatataatgtgtcactttgcttaatcacttccctaattctgccagacagtttccaattctgttctattgcagataaatcagcaggacgggaacagcctctcacaagactgatccatgtgwtgatatgatgttgcctcattctggcctctcacctcagtatcaggaagcagctgtgagcagcaggcacaatgcccaagagacagcttaagctacgaaagcatcttacccctgccccggtgcagcaagacatcctcgctcctctcataaaacctaactctgcctaatgttgcatagattagggaacagggagtgggagatcacactagatcagaacacgttgttactttatcataaccagcaacattctgagttcactattttacttattgccaattttcctcccatcttgcagccctccac

SEQ ID NO: 117680 - DNA, 472 bp, Human; identical to SEQ ID NO: 28497

SEQ ID NO: 117681 - DNA, 601 bp, Human; identical to SEQ ID NO: 28498

SEQ ID NO: 117682 - DNA, 601 bp, Human; identical to SEQ ID NO: 28499

SEQ ID NO: 117683 - DNA, 601 bp, Human; identical to SEQ ID NO: 28500

SEQ ID NO: 117684 - DNA, 601 bp, Human; identical to SEQ ID NO: 28501

SEQ ID NO: 117685 - DNA, 601 bp, Human; identical to SEQ ID NO: 28502

SEQ ID NO: 117686 - DNA, 601 bp, Human; identical to SEQ ID NO: 28503

SEQ ID NO: 117687 - DNA, 601 bp, Human; identical to SEQ ID NO: 28504

SEQ ID NO: 117688 - DNA, 601 bp, Human; identical to SEQ ID NO: 28505

SEQ ID NO: 117689 - DNA, 601 bp, Human; identical to SEQ ID NO: 28506

SEQ ID NO: 117690 - DNA, 601 bp, Human
ggggcctgtaggcagaagaatagggctgcagggcccttctgctgtctgacctggtgcccaaggagggcctctccctcccacctgggcctgagggtcagggtggcaagagggagaggccctcggcaggagtggcctctgggagggacttctgagcaccgccaacacgcccgctttgtgcatccgcaggctcttcgcggccaagtgcagcggctgcatggagaagatcgcccccaccgagttcgtgatgcgggcgctggagtgcgtgtaccacctgggctgcttctgctgctgcgtgtgtgarcggcagctacgcaagggcgacgaattcgtgctcaaggagggccagctgctgtgcaagggtgactacgagaaggagaaggacctgctcagctccgtgagccccgacgagtccgactccggtgaggcctggcctgagctgggggcaggcctcagggacgggggttgctggggtgtcctggaggggagtcccggctggagaagccacctcctgcttccaggacctgagctgcacacagatggtacatgcatatccagatgcacacgcgcactgacgtgtccacctgtgtgcacatgatacgaa

SEQ ID NO: 117691 - DNA, 601 bp, Human
acatggctgcacatatatgtttgtccacatgctcacatgtactgtggattgtgcttgtgtgcacacacacacctcttgttctctggcccaccccccttaccctctctgccttgatggccccccaccaacccgcagcccagctccacaggggtcttcaccagcacccagtccacaggctggggatgcctgagaggcagggagatgatgtgccttccccttctcagccccctggagccttcagcagtgagaagcaaacagcctcgagccagcctctgtttcccagccgaagggagggggctgrgccctctgtgctggagggaaagaccccatttcccagggtgaaggaccctccctcctctgctctagcccccaaaaggacgaggccaatttgaaggcctcctggcagacagggcaagcccagccaggagtgagccttaaggagggaaagcccaggaggtggctttggtccttgttcttcctgggaacagtggggaaggactggagcaggaggcatggagaggaggtgtcccggtctgccaggccccatgggtaacctggagccctccggcaacaggatctgccacatgggaagggttttcca

SEQ ID NO: 117692 - DNA, 601 bp, Human
agtgtgtgcagccacatgtacgtgtgtgcatgcctgtgctgtggttgtccgaggcgcacctgtgtgagttcctgtgcaggtgtgccctgcggcccaggatgagggagtgaggcgtgtgtgccggggaagggactcgcagggtacagcaggcaggagaccagggcccagatgaggtagggcctgtgggccacgggagggaaggagatcttatcctgggccactggggagccacggcaggtgtcaacagaggggacaggctcccatcgggcagcaggttgccgaaggggacaaggctgaggcytgggctgcccccgccccttcatcacaggccgggttgtgtcccccacagtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtccaagccttgccgaaaggtgaggggcggccggggggcggggctcaggctgatgcccgcacacccactgcctttctggagaccacccc

SEQ ID NO: 117693 - DNA, 601 bp, Human
ggccactggggagccacggcaggtgtcaacagaggggacaggctcccatcgggcagcaggttgccgaaggggacaaggctgaggcctgggctgcccccgccccttcatcacaggccgggttgtgtcccccacagtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcsaagccttgccgaaaggtgaggggcggccggggggcggggctcaggctgatgcccgcacacccactgcctttctggagaccaccccctgctcctgctgggggtagggacatccctccatcctccatctctccgcacatcccatcatacccctaaacccaccatctccccgttgctgcccctggagggcctgacctgttcccctctctctgagccaggtccgagagacactggcagctgagacgggcctcagtgtgcgcgtggtccaggtctggtttcagaaccaaagagcaaaggtaagag

SEQ ID NO: 117694 - DNA, 601 bp, Human
cccagggctagggacaaaggggcccgggatgtttcttttaacaaaacttctcaaaagccttccaccaaggccatcagatcccagggaacttctgctttaaaaccactgagacagagaaatagagaagccatggggactaggggacccagggaggagagatggcagagtggctgcctggagggttggcagaatttctgcaatcagaacagcaacagtctactcacactcactgcgtgcagacacgggtctcagccttcagcacaccccatctcaccctgtcctcataaatcactgcaagggrgggtattgccatgtcccatttcacagatgaggaaactgagggactgcctgggatccctcagccagtaaggcaaagctggacctcagccccaagcctggagctcaagcctgtacctttaacaggatgacactaccccactgccggaattctgcagacaaagcttgtcagggcgtgaagggcctggggagtcgggagggactagctgcaggggcatgagtcaggccccctcatcactgggctttaccaaaaatcgtgtttccacatcagaatcttgagccagggctggtctcctgggccttc

SEQ ID NO: 117695 - DNA, 601 bp, Human
ctgaccttccccatcccacactgctgatccactgaggtgccaagttggggagtgaagtcttctcatgtctctcgcaccctcctaggagctgtctctcccacagccaccttgacagagaccccacccttcctctggcttcctcacccactggccccagcctcggtctcctcctccagcctttctcaccctcgtctaccaaaccctccagcggctcccagcggcctcggggacccccacccagctcggcaccccagggctccccatgacctgtggtccctctcagctggtctcccccacaccracctctctccctgcctcttggccccacgtgctgcaccctcacttacccggcggtctgtctcctccatgcctttgccgcccctcagcctggcttgcctcccctgctctggcctgttgagcccctgctagttctttaagtcacatcagggcgggggccctttcctccaggaagtcttcccggggcctttttggcctgggtctgggaccttggtgctcccagatgcagcgcagaatcactattgcctgtgtggggtctgccgcctccctggatcccctggaggggcggggtggtgggaggaaa

SEQ ID NO: 117696 - DNA, 601 bp, Human
ggagtgaagtcttctcatgtctctcgcaccctcctaggagctgtctctcccacagccaccttgacagagaccccacccttcctctggcttcctcacccactggccccagcctcggtctcctcctccagcctttctcaccctcgtctaccaaaccctccagcggctcccagcggcctcggggacccccacccagctcggcaccccagggctccccatgacctgtggtccctctcagctggtctcccccacaccgacctctctccctgcctcttggccccacgtgctgcaccctcacttaccyggcggtctgtctcctccatgcctttgccgcccctcagcctggcttgcctcccctgctctggcctgttgagcccctgctagttctttaagtcacatcagggcgggggccctttcctccaggaagtcttcccggggcctttttggcctgggtctgggaccttggtgctcccagatgcagcgcagaatcactattgcctgtgtggggtctgccgcctccctggatcccctggaggggcggggtggtgggaggaaagaagatgaggaggggaggactctggcttttggtaagctgagcctggag

SEQ ID NO: 117697 - DNA, 601 bp, Human
cctgccgtggccctttctgggggatgtggtgggggtggagctgggactaggggaggctgaattcagccaggatctgcctgccaggcgcagctcccaggaagaaagcccaatgtctgggagggtcagaacccagagggctgtcaggttgtacagatgaggaaattgaggcttagcaagccaggaacttggctgaggtcagccatagcagcggtgcacagagcttagtgggcacatacatgcttggtgcccagctctgggctccttcccccagcatctcacccaatccttacagtcgccctgkggggagcaggctgtttgcacccctattttgcagctgagcagttatgctagagagctgaagccactcaaacccatgtctggtggacttgacctctgtcctgtgcctggagtgagcgctcactggattgcagctgtggttccttctctccctgtcacttcctcccccgacatcaaaccctcagtttcatttagtttttgcctcgggctgcaaatgcagcttagggacctgcggaggctgagggaggggggtgccccacccgctgctgggagggcaggagcaacgctgctgtctgattgcatc

SEQ ID NO: 117698 - DNA, 601 bp, Human
tgtggtgttgatgtcacgggcgcatccgcacgccgaaacttgctaaattggacacaaaaaaatatgcgattatttttgtagttgatgaatgtgctgattgggtattctcgtgtgtgtgtgaggtgccaccctcaaactttgttatgatgttggcacattacccatctgatatttaaaaaatgcaatttatgatatgtcaagtagacctcaatagagctgttttaaaacatacaacagaatttcccgcaacccaaccacaccacccgcgccatcacacgcaaacaggggtaggcttccacayatttcctgaatgccttctggagcagggggcaggaggcaggaggcaggacaggtggctctggggctcctggacctcctctgctcagtgaggctgctcacaggagattgggcggctggaaagtaaggtttagggcctctgggatggcccaggctacctgcaggcagctgagtagctctgcttttgcagagtggttcactgcactgtgaaaacagattccagacgccgggaactcacgcctccaatcccaggtactgcccaccttaagtcctccctgcctgccttcctccctccttccctcca

SEQ ID NO: 117699 - DNA, 601 bp, Human
acaccacccgcgccatcacacgcaaacaggggtaggcttccacacatttcctgaatgccttctggagcagggggcaggaggcaggaggcaggacaggtggctctggggctcctggacctcctctgctcagtgaggctgctcacaggagattgggcggctggaaagtaaggtttagggcctctgggatggcccaggctacctgcaggcagctgagtagctctgcttttgcagagtggttcactgcactgtgaaaacagattccagacgccgggaactcacgcctccaatcccaggtactgcycaccttaagtcctccctgcctgccttcctccctccttccctccatcctgcatggccaattgcctggctgcagttgccatggataccacctgctggctccagggttagggctggctgagtcaccagcaactcaggggcagggggttgaatgcccagtagggacgttgtgggcaccgaccagaaccatcttctctgccccagctgcatggtccatgaggtgtttccccttctaagtccaaagggcagcacaggcctgtgagccccggctgactggcaggtgggaccgtgcagcatgcacggg

SEQ ID NO: 117700 - DNA, 601 bp, Human
ccagacgccgggaactcacgcctccaatcccaggtactgcccaccttaagtcctccctgcctgccttcctccctccttccctccatcctgcatggccaattgcctggctgcagttgccatggataccacctgctggctccagggttagggctggctgagtcaccagcaactcaggggcagggggttgaatgcccagtagggacgttgtgggcaccgaccagaaccatcttctctgccccagctgcatggtccatgaggtgtttccccttctaagtccaaagggcagcacaggcctgtgagycccggctgactggcaggtgggaccgtgcagcatgcacgggactgaattctcatgtgacggagctccaaagtccacctggctacacggccaggctctgcagcagaggacgggaggcctgggaaaggcacttcctctccccgagcttccaggcacacagagagtgctcaggatagcgatgcctgcatcactgcaatggtgatggccgggtgacccttctgggctccacttccccagtagtgtctaataaagaccctgggtgactctgaccttgtgacgttggtcagactccagtggaaacgt

SEQ ID NO: 117701 - DNA, 601 bp, Human
gctgcttgttgatccgatgaccctgggcaggtgacctcgtctccctaaccctggtttcctgttcagcaaattggacacagtgaagacgcccaagcccagggccacaggaggcatgtgggggaggggggtgcagggcgagcccaagggcagcccaggattcagggagagccctcggggaagaagcatggctgcaaagatcaggagacaggaggccttggcgccttcgggaggcttcattgtgacggagggtggggcaggatgggagaccgcaggcacttcccggctgcagagggcctggctgcagagagccctcgtgcccatctgtccccccgggaagggccgctggttgcagaggtcttaggcctctgcctgtctatcgccttccctccctgggcctcagtttctctacctccacactgggggaagttggtctctgagcccctccaaactgggcattggcagagttgaattcagaggcgctcacatttggagacacgatgtctaaaattccagccagtgaaggttccatggggttgcaggtaggagagggactggggctgggcccctgccccacagcatccttctccacctgcaggtgggc

SEQ ID NO: 117702 - DNA, 601 bp, Human
tccctgtggaatggggtccacccaggaaagaaggttctgtttccagaggaagtgagcctgggtctctggacagacaaaacttagctcttgccaaaagtggcttgtttgccggcatattggcatgtctaactgcgcccaatgcccttgtcattcaggttggggaaagtgaggcccaggggaagaaatactttgctcacagtcacctggtgggtgagagcacagctttgaggggctgcaaagagcccagggtgtatccatctcactgtaggtagcacagcggggcaatcagagctggagctgrgcgtatagacccctgggctaccacctgggggatttaaaagctgaatgtgattcagataagcacctgcagctgggctttggcaagattccagggtctggtgagccgaatgaagggagtgagggctgaggccaggatctgggcagcaggccagagtccaggcagcaggaaacatggcagtgtctagacaggggctgtcagaccccgaggtcagggcactggccacagggacggagctggaagttcctgagcacgggcttctctgcctcccgcctctcagctgcctcaggatggccaaggcat

SEQ ID NO: 117703 - DNA, 601 bp, Human
ccattcttccattcattcaacagaatcagagaactccaattgagtctggtgccttgattgtgaatctaggcatgtggcaggcagacccctgtcccatacagggcatttatgatgaacagtgtcatcaggacccctgctcacatgtgctcactccccatggagaagcccttgccacttgtgccccttcatttgggagagtgagcaggggacatagcagggatgatgtgcaaggccaccagcccacctgcagggtcagagctgatcccctctgtggggtgcttctgcagggttgccagggtarttagcatgttaaaatgaacacgggagggagtggatgccccagtcccaagtcacctactggccacaggcctggaactagaatgtccctccttggttctgtgcctcccgagtgctggagagcagaggggttgtctgagcagtagtccaggaaggggagaaagagccctgagtgttgaagattcgagtgcgctttcagcagcgcaggagcaggctttgtgcacggcttcagcttttgtcctttattctagatgagcagttctcaaaccttgtggtcttgggaatcctctacactctaatttac

SEQ ID NO: 117704 - DNA, 601 bp, Human
tttctatgcctttttatttcattttttaaaaggatttttttcaaaataattatagacacaggaagttgcaaaagcagtaccaagaatttctcgactcttaaaaattattgaaggccttggctgggtgcggtggctcacgcttgtaatcctagcactttgggaggctgaagtgggcagatctcttgaggtcaggagtttgagaccagcctggccaaccagcctagtttctttagtagagaaaccccacatgcctgtagtcccagccactcgggaggctgaggcaggagaatcacttgaaccyggaaggcagaggttacagtgagccaagattgcacctctgcactccagtctggatgacagagagtccatctcaaaaaaaaaaaaattactgaaggccttagagagcttttgtggattacatctgttgatatttatcacattagaaataaaagctgaaatgttttaaatgaacagttcatgttaacataagtaacattacacttatgaaaaataactattttctcaaacaaaaaattttagttaagaatcttattggcttccatttttgcaaatctctgtaatgtctggcttgacagaaaac

SEQ ID NO: 117705 - DNA, 601 bp, Human
gtgagccaagattgcacctctgcactccagtctggatgacagagagtccatctcaaaaaaaaaaaaattactgaaggccttagagagcttttgtggattacatctgttgatatttatcacattagaaataaaagctgaaatgttttaaatgaacagttcatgttaacataagtaacattacacttatgaaaaataactattttctcaaacaaaaaattttagttaagaatcttattggcttccatttttgcaaatctctgtaatgtctggcttgacagaaaacagatggactcttgtagcrgttttctgcattcacttgttttttcgtttgtttgtttgtttttcttttttagcctcccagggcttcctcgctatgtgatgccttgttttattgaagtttatgaagaaaactgggcaacacagtgagatcccatctctacaaaaaataaaaaacttagccgggcgtggtagcacatgcccgtagtcccagctactcaagaggctgaggtgggaggattgcttgaacccaggaggctgaggctgcagtgagctaggatcacaccactgcactccagtctggatgacagagaaagaccctgtc

SEQ ID NO: 117706 - DNA, 601 bp, Human
ttggcttccatttttgcaaatctctgtaatgtctggcttgacagaaaacagatggactcttgtagcagttttctgcattcacttgttttttcgtttgtttgtttgtttttcttttttagcctcccagggcttcctcgctatgtgatgccttgttttattgaagtttatgaagaaaactgggcaacacagtgagatcccatctctacaaaaaataaaaaacttagccgggcgtggtagcacatgcccgtagtcccagctactcaagaggctgaggtgggaggattgcttgaacccaggaggytgaggctgcagtgagctaggatcacaccactgcactccagtctggatgacagagaaagaccctgtctcaaaaaaacaaaaaaaaagttttcactcagtgtctccctgaaaagtcattgggaacccctgggggtctacatttcaagaaccattcctctggatcggggtttctcagtcttggccttgttcccgtgtggctggccgtcctgtgcacgggaggattttagcagtatccccatagcctttacccactagatgccagaattccaccccccacctggtagttgtggcaaccaaaaat

SEQ ID NO: 117707 - DNA, 601 bp, Human
ctacctcctgggcacctctcttgccaggccctgcatcgcccgcaaacaagtggaaatcgcccagcgggagggggccaagtatgtgtcccacggcgccacaggaaaggtgaggcacctgggaagggccgggcagagggagatggaggcggaggggtgtgggaaggagatgagcacccctcgagcggtttcctggtgtgcctccggggcagacttggtgcaaggcagctacatggctttgtttagaccccaatgagaggggtaacagctcgcccctgcgctctgtgcactgtggcacctgaaygcccattctgagtcctcacctccaccttctgctgtgggagcgatgtcaccccatttggcagacttgctgctgaggcctggggacattgtccaaggtcgcattggccaaggtcactgcgtgagtcccccaggggacacgcaggaaagtgttgaaaaccctgagttggcagagtagggttcaaaggcagctctgctgctggcttgccgtgtgtcctcagccagggcccttctccccttcctgaacctcagtttcttcatttgcaagatggggctcatgccatgtcttagtttcccagggcga

SEQ ID NO: 117708 - DNA, 601 bp, Human
agctaagatgatgatggaggagacgcggttgatttgagggtggcctgggagacagccacccaccaggatggcacctgtcatgtctttgaaagtccaagtgttcatttcttcaccggagcactggttcagcaagcttgcactgggtatctgctgggagttgggtgcttgctggcattggcacagtgctaacttcttgggctcattgcgtaccttcagagagcccatttcctggcaagagaagagaaaatggatgtgtgatgaggaatgggagtggggccaggggtctgtgccagggaactgygggagcagcaggcaggggctgaggatgagtctagaggagtgaataatggcatggaagagtgtgagaggcagagggaacagcctgtggaaaggcttagagccaagaggccctgaaggacagtctgtctggggctgtggagcaggagctattgctgtgagggaggcaatagggccaggactgggctgaggccatgctgggaggtttggcttcatcctgagggcaactgattagtgggtggaaggaggtctcaggttggatggaggtggccagtgactaccccagcgagatgctggggaagag

SEQ ID NO: 117709 - DNA, 601 bp, Human
actgattagtgggtggaaggaggtctcaggttggatggaggtggccagtgactaccccagcgagatgctggggaagagacaggggagagcttctcacagactgcggccttggtttttactgtcactccagctgtggatgatgggatggtaggaaaccaggcaaggaggtttgggcgggcctgagctgttgggcaggaccgtgtgtatgctgccatctgtgcaaaggtggtggcagaggaggagaacccagaggatcaggactgggcgacacagcgagactctgtcccaaacaaaaaaaaaagctcccgacccatctgccttaatggaaagagctggatcgtgagcttcctatcccagaaggcatacaagccgagggcaggggatcagaattctgggaggggtcctgccctcaggtctttccaacggtaccattaaggttcagtagggcggcattcaggtctggtggagtgcatgggtgggtgggtgagtatgggtgggtcggctctggctcaggcagttcccgggtccatgcggagacccccaccccggaccagcccacatttagcctgcaacagcctcccgcagccgtgtgcgcccctcc

SEQ ID NO: 117710 - DNA, 601 bp, Human
agggcggcattcaggtctggtggagtgcatgggtgggtgggtgagtatgggtgggtcggctctggctcaggcagttcccgggtccatgcggagacccccaccccggaccagcccacatttagcctgcaacagcctcccgcagccgtgtgcgcccctcctccatgtggccaccagagggcgccagaggcttgggtttgaggccttgggggccaacaaaggcgggaggaggtggcggcaccaccggggtcctctgttccccatcctggacctgcagggcgtggttctgaggagaacgcccccscaagctagtgctatggccgctcgggacttgggggcgtccctgcattcacactcagaagacccaacagggacggactccggggatgccagggagtaggtgctacctggcacagccacctctttcctggggttgacaggcaaggcgtacttctgcgcctcagtgtccctttatgacagtacccaggaaacccccaacagcctctggagacaatttccgagaactgggggtgtgagtggagaaccaggaaggctgggagcgaggggaatccaaggccttggaggtgctggtccagccttcagg

SEQ ID NO: 117711 - DNA, 601 bp, Human
tggcggcaccaccggggtcctctgttccccatcctggacctgcagggcgtggttctgaggagaacgcccccgcaagctagtgctatggccgctcgggacttgggggcgtccctgcattcacactcagaagacccaacagggacggactccggggatgccagggagtaggtgctacctggcacagccacctctttcctggggttgacaggcaaggcgtacttctgcgcctcagtgtccctttatgacagtacccaggaaacccccaacagcctctggagacaatttccgagaactgggggtrtgagtggagaaccaggaaggctgggagcgaggggaatccaaggccttggaggtgctggtccagccttcaggcatttaccccctgagtaaccacccagcaccaccatcccatgagtatccacccagcactgccccgggcgccatcacgggggacgggccaggtggaggctttcgggtctttgggctcagggaaggtgacagtgaaatgttggggggacaacggattggcctgggatgtgagggggaagggcatcctgtttgctggaaccgcctgagcccagccctgaaggcagaggcggag

SEQ ID NO: 117712 - DNA, 601 bp, Human
gggagtaggtgctacctggcacagccacctctttcctggggttgacaggcaaggcgtacttctgcgcctcagtgtccctttatgacagtacccaggaaacccccaacagcctctggagacaatttccgagaactgggggtgtgagtggagaaccaggaaggctgggagcgaggggaatccaaggccttggaggtgctggtccagccttcaggcatttaccccctgagtaaccacccagcaccaccatcccatgagtatccacccagcactgccccgggcgccatcacgggggacgggccargtggaggctttcgggtctttgggctcagggaaggtgacagtgaaatgttggggggacaacggattggcctgggatgtgagggggaagggcatcctgtttgctggaaccgcctgagcccagccctgaaggcagaggcggaggcagcctcccttcccagcaccccgtccagacagcacctggtgcagaaattgagccgcactctcccctcccatgccctgctgccagccccacccctgcccacccagagagctgcaccgaagctggggtggcccttgcggggctcctctctccccctagttt

SEQ ID NO: 117713 - DNA, 601 bp, Human
cttctgcgcctcagtgtccctttatgacagtacccaggaaacccccaacagcctctggagacaatttccgagaactgggggtgtgagtggagaaccaggaaggctgggagcgaggggaatccaaggccttggaggtgctggtccagccttcaggcatttaccccctgagtaaccacccagcaccaccatcccatgagtatccacccagcactgccccgggcgccatcacgggggacgggccaggtggaggctttcgggtctttgggctcagggaaggtgacagtgaaatgttggggggacmacggattggcctgggatgtgagggggaagggcatcctgtttgctggaaccgcctgagcccagccctgaaggcagaggcggaggcagcctcccttcccagcaccccgtccagacagcacctggtgcagaaattgagccgcactctcccctcccatgccctgctgccagccccacccctgcccacccagagagctgcaccgaagctggggtggcccttgcggggctcctctctccccctagttttggaagaggggcctggaaatatgattctgagactctggccggggagcgagagttttgt

SEQ ID NO: 117714 - DNA, 601 bp, Human
ccaggaacggggccggctgggggtcagcaggcaaatgtggccgcccccacctcagtgtcctcatccgtaagatgggactaatagaacctgcctcctggggctgctcaaaggattcagtgagttaattatgcatggagctcagctgggaagcctgagtgtgaaccgttaggatgagcgagtttgctgtgtggccctgggcaagtggctgcacctctctgagcttcactttcctcacccataaaatatggctaaaaatccccctggccctgggggcctctctgagtgacagcacatagtaggygctcactaaaggggctgcatggagggtgagtgaggccagcccaaggcctgtgccgcacacacagctcccagctctgcagagaggctgaaccctggattctgtgccacctgacgagagtctggaaaatagcatgtaattcccaccgctgcctggctgcgcccatgcagttttcacagtaggcaaaaggtccctctgtcatttccacagcgcttaagtctccctctgggctgccgagcccacggggaagcaggagacgtgcgcggccattttctctctggggacagagctgggctggcggat

SEQ ID NO: 117715 - DNA, 601 bp, Human
acatataaatacatatgttttatatatatatatatatatatatattttttttttctttttctggagactcgctctgtcacccaggctggagtgcagtggcacaatctcactgcaacctctgcctcccaagttcaagcaattctccctgactcagctcctgaataactgggactataggcatgcgccaccacacctggggtttcagcattttggccaggctggtcttgaactcctgacctcgtgatctgcccgccttgggctcccaaagtgctgggattacaggcgtgagccactgcacccrgctgtagtagccatattaaaaaatagaaaaatgaaacaagtgacatgattttaataacatgttttaccgaaaccgatatatccaaaatgttatcattcctcctataatcaatgtaaaaaaataattattaatgtttacattcttttttcttctgtgttgagtctgcaagacccagaatgtgctgcatgcaggcatgtctcgctagctggctggatttcaggtgctctgaatggccacccgtggcttgtggccacctgtgggcagcacaggccgggactgagctcttttgaggccgctttg

SEQ ID NO: 117716 - DNA, 601 bp, Human
caccctcacaacagcatcctctctggggacatgctggagacccccatgggcccctcccaggagaggccagctctgcagcttacaggccaggggaagcccacagctcggccctcccggctctgaccccttgtcctatgtccaggtcattgctccctggaggatgcctgaattctacaaccggttcaagggccgcaatgacctgatggagtacgcaaaggtatggccgagtctccccaccacccccaacctttccctatagcccccttcccgggcacgtccctgctgggggctgtctgagccmgtggcctaggccgggactgaccccatgtgatgggggattgaacttccaccccagctgcctacacacgtggcctctgtcccctgggctgaccccacagaggtgtggtcatctgccagcccgttgccagggcggagccgctctgaggccatttcccagtcccccgagccagaggacacagggctcactctctctcctgctccctgggaggcggagaccagagccctgcttgccacctccgcagtgtgtgtgtcttggtgtgtgtcacttggggggatggctgggggatgtgatggccggccg

SEQ ID NO: 117717 - DNA, 601 bp, Human
acgtggcctctgtcccctgggctgaccccacagaggtgtggtcatctgccagcccgttgccagggcggagccgctctgaggccatttcccagtcccccgagccagaggacacagggctcactctctctcctgctccctgggaggcggagaccagagccctgcttgccacctccgcagtgtgtgtgtcttggtgtgtgtcacttggggggatggctgggggatgtgatggccggccggggggatgtgatcgggagctgttctcccaattccctggatactaattgcccctagcgctttcccygggaacaggtaggcgctccaagggacagtcgcagacaaagccttttatggcaccagccctttttgaagtacaagttgcaataaaacatattagaagttttgcatcaagatccttagccgctccccagggcacctttctttttagcgactcgatggcagcccttgacaaacagcctcaatcaatcaggccggggaaaagcaactcagcgcacacaccagaaaattgctcaggtttttaaatagcagtcgccaaggctggctgtgagctctcgctgcagccaaggtgccgcgtggtagggga

SEQ ID NO: 117718 - DNA, 601 bp, Human
ggagaaggtgctgagctcagcttccatcccaaataaccttttgagccggaaaagtttgccagggaaagatgagcatggccccctcggccacctaccctctcctggagatgggtttcatcagaaatgactgtggggaatctgagcacgttctagaaggaggcagaggcagtgtttctgcacccaggaaatgtcagaatgactgagcagtgatgaggcctcctccaaaattctgagccaggcaggatctgagatggatgacacaaaaatcaatggggctttcaaaaatctctgctttcaagaygcttcggtagccaaggcaaaaaggcgccagaggactcataaaaaacatgcatttgcttcgctggccatcctctcccaacccatcgtccaacggaaaaacactcagaaccaccccatccttgtcactgtcaccataatttaaaaaaaaattttttttagagacagtgtctcactctgtcacccaggttggagtgcagtggcacaatcctagctcattgcagcctcaacctcctgggctcatctgaccctcctacctcagcctcctgagtagctggaactacaaacatgccctagtacatct

SEQ ID NO: 117719 - DNA, 601 bp, Human
ggccacctaccctctcctggagatgggtttcatcagaaatgactgtggggaatctgagcacgttctagaaggaggcagaggcagtgtttctgcacccaggaaatgtcagaatgactgagcagtgatgaggcctcctccaaaattctgagccaggcaggatctgagatggatgacacaaaaatcaatggggctttcaaaaatctctgctttcaagatgcttcggtagccaaggcaaaaaggcgccagaggactcataaaaaacatgcatttgcttcgctggccatcctctcccaacccatcrtccaacggaaaaacactcagaaccaccccatccttgtcactgtcaccataatttaaaaaaaaattttttttagagacagtgtctcactctgtcacccaggttggagtgcagtggcacaatcctagctcattgcagcctcaacctcctgggctcatctgaccctcctacctcagcctcctgagtagctggaactacaaacatgccctagtacatctggctaatttttgttttttatatatttatttatttatttttttacagacagggtctcaccatgttgcccaggctggtcttgaactc

SEQ ID NO: 117720 - DNA, 601 bp, Human
cgccagaggactcataaaaaacatgcatttgcttcgctggccatcctctcccaacccatcgtccaacggaaaaacactcagaaccaccccatccttgtcactgtcaccataatttaaaaaaaaattttttttagagacagtgtctcactctgtcacccaggttggagtgcagtggcacaatcctagctcattgcagcctcaacctcctgggctcatctgaccctcctacctcagcctcctgagtagctggaactacaaacatgccctagtacatctggctaatttttgttttttatatatktatttatttatttttttacagacagggtctcaccatgttgcccaggctggtcttgaactcctgaactcaagtaatccaccctccttggcctccccaaagtattgggattgcaggtgtgagccaccacacccagctttggctaatttttaaatttttttttgtagagacagggtcttgctatactgcccagcctggctataattattatttttaaagccagactacaaggtgggagctagaaacaggatggtctcacgttgtctacatgttggagatcgttttgttttttctcctcaatta

SEQ ID NO: 117721 - DNA, 601 bp, Human
ggcacctgcgtgcttgctcagtgcttcaggggtccttgagatgtagactcaaagtcttctggaaggaacctccaaggtcagcattgcagacacacggtcctgcagtttctctggggcatgtccagcaatagggtccccccagggaggtgaccgtgaccaacactaggaggtagccagggtcttgtctgaatgggggccagagtttggggctctctgaaaaagcagggcccctgggacggacctcacgcgtccttccagccgccttacctccacctgtgctgtctctttcctgcagcaacaygggattcccatcccggtcactcccaagaacccgtggagcatggatgagaacctcatgcacatcaggtaaatcccaccctccacccatccttggtcctcccgggctcattccaaaggacggccacgcgctgccccaggacgtcctggtgaccctcacaccagtggtccctgccctcggggagctgagaggcctcaggcaggacagaggtcgaagcgcccggctcatgcactgccctcattgcagttctgctgagtgttgttggggagatagatcatggggacccggcctcatcaggagtat

SEQ ID NO: 117722 - DNA, 601 bp, Human
tgaccaacactaggaggtagccagggtcttgtctgaatgggggccagagtttggggctctctgaaaaagcagggcccctgggacggacctcacgcgtccttccagccgccttacctccacctgtgctgtctctttcctgcagcaacacgggattcccatcccggtcactcccaagaacccgtggagcatggatgagaacctcatgcacatcaggtaaatcccaccctccacccatccttggtcctcccgggctcattccaaaggacggccacgcgctgccccaggacgtcctggtgacccycacaccagtggtccctgccctcggggagctgagaggcctcaggcaggacagaggtcgaagcgcccggctcatgcactgccctcattgcagttctgctgagtgttgttggggagatagatcatggggacccggcctcatcaggagtatcaaggagggcttcttagaggaggtggcattcaaggatggagaagaggcccagatgtggcacaggggaagagtgtttaaggcagaggcagaggcccccccaaccacgtgcagagccccggggcagtccccagaagacaggtaaaggccccagct

SEQ ID NO: 117723 - DNA, 601 bp, Human
tgaaatttcacgggggccagccgtggggctggggccgagccctgcctgtgttccccgacccccgcactggcccccctctgcccaccatctcctcgctgcatttgaagacctccccccgcccttcctcttctaattgcctctgggatgaacaggggaaggaaatatctcagggcagcatagagagagagtgtgattgtgagacaataaagaagtaattaggcagatgagacacttgggggagggcccagcctgtgcccaccagctcccaggctgtgctgctggagttttggttgtggggggyggggggaggcatggctgagagccctaggccccatttgtctggatccgtgttgcacacccgccaccaccggccaccctgatccggtcccaagcttcccgggcgggctggactgggccctcagctctgtttgaagtttcgggtttctctcccgggggtagggggcttctttgtgtctacccctgcccactgtgggaggtgggggaggcagggccaaatctatcatgggaagagaaaaatctctttgtccctgagggaatgtgtcttagttcccgggcccagccccacaccccggggaggctg

SEQ ID NO: 117724 - DNA, 601 bp, Human
tcttcagggaaagttctgggttcttgttcctgccccacaaatgggcactgatgcagggatacagctggccctgagtcacatcgtaccttggaggtgggggtggaggatccaccacagtccctgtcttagaaggatcaattgtcctggtttgcccaggactaagaggtttcttgggacaaaggactttcagtgctaaaaccaggagaaatcagggcacttggtcactctaacacagagccacaggcaaatgaccacaggtgagcttccaaggcacttatgtagccccatcccatgcagaatraggaggaggctgggccgagcatgtacccccagagtgaatttcagctgccctttccacctgcagagcatgttcccgtttgtaccaggccttccctgacattttcctgtgtgttttcatgtccaattaaaaaatatatatatactacttaaattgtaagatggccaagggcaggtatcattttccccattttacagatgaggaaactgaggctggaggaagtgaagcttccccaaggccccccagcctgagctcttgatcctggcacggggtaatgcccatcactctaaaatacaatgtgta

SEQ ID NO: 117725 - DNA, 601 bp, Human
aggaaactgaggctggaggaagtgaagcttccccaaggccccccagcctgagctcttgatcctggcacggggtaatgcccatcactctaaaatacaatgtgtatttggcgaggacctcgcggggctcctgtcctgagtgccagggaacaagtcccacgtggtctctgcctgcacagaactcacagttgtagctccagtccctcccgctcagcctcaatttcttcatctgttgatggggtaagagcgcttgaccttcttaccaaatggggctgctgagaactcagactgcagatgggaagcratacgtgaatgtgtgcaaggtgttttttttttttttttttttggtgggggggtgggggacggaatcttgctctctcacccaggctggagtgcagtggtgcaatctcggctcactgcaacctccgcctcccaggttcaagcaattctcctgcctcagcctcctgagtagctgggactacaggcgcatgccgccatacccggataatttcttttgtattttagtagagatggggtttcaccgcgttgcccaggctggtgtcgaactcctgagctcaggcagtccacccacctcagcctccca

SEQ ID NO: 117726 - DNA, 601 bp, Human
ccagcctgagctcttgatcctggcacggggtaatgcccatcactctaaaatacaatgtgtatttggcgaggacctcgcggggctcctgtcctgagtgccagggaacaagtcccacgtggtctctgcctgcacagaactcacagttgtagctccagtccctcccgctcagcctcaatttcttcatctgttgatggggtaagagcgcttgaccttcttaccaaatggggctgctgagaactcagactgcagatgggaagcgatacgtgaatgtgtgcaaggtgttttttttttttttttttttggtgggggggtgggggacggaatcttgctctctcacccaggctggagtgcagtggtgcaatctcggctcactgcaacctccgcctcccaggttcaagcaattctcctgcctcagcctcctgagtagctgggactacaggcgcatgccgccatacccggataatttcttttgtattttagtagagatggggtttcaccgcgttgcccaggctggtgtcgaactcctgagctcaggcagtccacccacctcagcctcccaaagtgctaggattacaggtgtgagccactgtgcccagccgtc

SEQ ID NO: 117727 - DNA, 601 bp, Human
ccactcttgctcccctcggcagtggaggctgtcctgatcgctccctccttctcactgctgtcaacaagaagcgtttgctgacctggcctgagtgcctgggtgcctgagcttgggagagggcatctcttggcctggaggaaggatggagaagcgaggcatgcccgcctgggctcagagggagggctcagagggcgggctcagagggcctgaaggggtaccttttcaggaggctggagtgatcagggaggcttcctggaggaggtggtgctgggcacaggggcacccaaggaccaggcggggrgctggcccattcgtccacaaagtggctgcccacactggagctgggatgagagggagagaggctcgtggagaggcctggcccggctctggcgctcggctcttaccccggctaccacagaaaggaggatagggtggggaagcctcaggccggtggggaggcagagctgcagatccccctctcccccttgctggtgtgaccttgacagccagcttcaccatgctgggccttgggtgcactcatcaaaaaacggaccacaggcatgatgctcacaggtgcccggcatggtatgtggaatggggt

SEQ ID NO: 117728 - DNA, 601 bp, Human
cctggcctgagtgcctgggtgcctgagcttgggagagggcatctcttggcctggaggaaggatggagaagcgaggcatgcccgcctgggctcagagggagggctcagagggcgggctcagagggcctgaaggggtaccttttcaggaggctggagtgatcagggaggcttcctggaggaggtggtgctgggcacaggggcacccaaggaccaggcggggggctggcccattcgtccacaaagtggctgcccacactggagctgggatgagagggagagaggctcgtggagaggcctggccyggctctggcgctcggctcttaccccggctaccacagaaaggaggatagggtggggaagcctcaggccggtggggaggcagagctgcagatccccctctcccccttgctggtgtgaccttgacagccagcttcaccatgctgggccttgggtgcactcatcaaaaaacggaccacaggcatgatgctcacaggtgcccggcatggtatgtggaatggggtgtcggaggctaagtgctttaataatctgcctcttctgggcctttcccaagagcttggccaagccagcgactgtcttccttg

SEQ ID NO: 117729 - DNA, 601 bp, Human
gaggaccagggcagctccgcaggctgagctggagaagaaacgtgacctattgtcatgatttggggactgtctggaagaagaaaaaaagaccggaggaaccctcccctggctagtgcccattcactctctagttaatttatttgaagttttaatctaattattaactattttaaaggctaagaggctttctccagcagcagcaccaacaatgtcacctcttctcccgggcaggccccatctaaggccccagcgaaggccgataataggaccggggagggagagaaagggagagaggagaggtggggggtggtgagaggggcttaaggttcattattgggcagacttacatttaatagcaatttacaaccaagttataaaacccctggaaatgggggttaagaatggcgaggctgacagcgccttgagtgaagcccctccaagcggcgcctggctaataaagcctcgaaagccgctattgaggcctgattggcacccgatggctcgctccatggtaatgagccgggcagatgggtgggggattagccgccaactttgaacagcttttctttgtcactgtttcagctctcttgttagccccaat

SEQ ID NO: 117730 - DNA, 601 bp, Human
gcagatgggtgggggattagccgccaactttgaacagcttttctttgtcactgtttcagctctcttgttagccccaatacatttattgctcatttcacaccgctcgagaaagtgccccttgctattcaaagtcaaccccgaacccacccactgcccccccccaaccccttccctcctgccaccccggacccagctcctcggattcagggacgctgccgacacctcgcctgctggagcgggcaccgtgtcacccccatcaatcagatggctgcgtgtgggtctggggtacagggtcggggcrcggggtccgcctgacagacgtggcagggggctgtgtgtgtgtgtgtgtgtgtgtgagcgagtatgtgtgtgcttgagcccagccacacctcggccaggcggcccccgggtgactggtgggacagaaggtgctcccggcgtaagacaatggtggagcgtgaaattcaattagttcagggcctggttccaatttcacagcccctaaatgcaaaaggggcaaagagaatgggagggtgggggagagcgtttttattgcattttctctttcattctggggggctttctcgccccttctctccct

SEQ ID NO: 117731 - DNA, 601 bp, Human
gcctaatgtgtggcctaagctgtgcccaccctgggacagcccagctgggtgggtgactctgagccttgcggtagcgcccgaacctaatggaccagttcttcccacaggggcaagcatggcgtgggccgtattgacatcgtggagaaccgcttcattggaatgaagtcccgaggtgagtctgctcagcctccctcagggcctgcctcggggcccagcaaacccagagatccctgagaccctgtcccctttggacgctactacccccatgctccgtgggcgaccttgggcacgtcctttcacsacaccccgtgagaccgcagtttccctcctgccaagtggggatcgtgggccctttgcccctgactttcagggtgttatgagaagagctgtccaagggctgggagaggcccaggagggcctggggagtctccgaggagcagggaggccagggccaggcctggaggtcaggctgtcttgtgtctggggtgggcaggccgggtgtggaggcagaccgtgcaggcccgatttcgtggtcattaaggccgcatggaggccgccggccaggcagggcgaaaatcctgccaggggtgggcgctgtggc

SEQ ID NO: 117732 - DNA, 601 bp, Human
taagctgtgcccaccctgggacagcccagctgggtgggtgactctgagccttgcggtagcgcccgaacctaatggaccagttcttcccacaggggcaagcatggcgtgggccgtattgacatcgtggagaaccgcttcattggaatgaagtcccgaggtgagtctgctcagcctccctcagggcctgcctcggggcccagcaaacccagagatccctgagaccctgtcccctttggacgctactacccccatgctccgtgggcgaccttgggcacgtcctttcaccacaccccgtgagacygcagtttccctcctgccaagtggggatcgtgggccctttgcccctgactttcagggtgttatgagaagagctgtccaagggctgggagaggcccaggagggcctggggagtctccgaggagcagggaggccagggccaggcctggaggtcaggctgtcttgtgtctggggtgggcaggccgggtgtggaggcagaccgtgcaggcccgatttcgtggtcattaaggccgcatggaggccgccggccaggcagggcgaaaatcctgccaggggtgggcgctgtggctgcacaggcactggg

SEQ ID NO: 117733 - DNA, 601 bp, Human
ccctgagaccctgtcccctttggacgctactacccccatgctccgtgggcgaccttgggcacgtcctttcaccacaccccgtgagaccgcagtttccctcctgccaagtggggatcgtgggccctttgcccctgactttcagggtgttatgagaagagctgtccaagggctgggagaggcccaggagggcctggggagtctccgaggagcagggaggccagggccaggcctggaggtcaggctgtcttgtgtctggggtgggcaggccgggtgtggaggcagaccgtgcaggcccgatttmgtggtcattaaggccgcatggaggccgccggccaggcagggcgaaaatcctgccaggggtgggcgctgtggctgcacaggcactgggagccggccagggcctaaggacctgtcccagcatcaggcacggctcactggcccttttctccagggatggggctgtgccacagttggggctgtgccgcagttgaggctgagcttcagtgtgacatgcctgccacctcggctggcctctagcctgcctagcctcgtatccgcctgtggctgggcccaggagcagggcagttggtccccaagcagg

SEQ ID NO: 117734 - DNA, 601 bp, Human
caaccttggacttgtcatctatcgctaggcctcagtttccccaagtgtaatgcggtaggcgctgggagttgcatcactctggctctgacctgtctgcgtttccctggaaaggcatggcagcatggaccggggcggggacgggcttgcctcgaaagacatgggagcgcggaaggggaggcgggctcgcctctttcttgtggctttagctccttgcttgctgttattcaggagaaacaacctaattgaagctctggggaggccttgagaacaatgttactaattagctgctcctttttatcckggcttacctttgtctcttacctatattaacatgtgattagatgcccctttgtcgcagcctgcccttgggagccagcgcggtgtgcaccctccagggagagctgggagggaccttgaggagccacagaccagcaccccatttacagatgcggaagccagggctggggaggggtgggatagagggcttgcttcaagtcccaggcactttagtggcaggaccaggactgccatctgggcccagagtggcatggagtggagggctaacagcttagactggagttggacagatctgggttcaaac

SEQ ID NO: 117735 - DNA, 601 bp, Human
ggttccagtattgcacctgtcttatcataataagggcctgccacaggcatgcccttgccatgcctgtggcaggcatcaccagtcaatgctggcattatcctgttgactccagaggtatctcagggctgcttgcaggcactaccaaatgatcaggattggcatacgtgatgaaagtgtattgccttccctattggaaagataaggactggcctgaagtcactgtgaaatggcatcctgtggggtggggcgagtcaagcagagttgagcaaaaatgaactgaaggaggtggttagtgatgaaracctggaatgcactattctgaatgtggaatggtagctgacagcattccacggaggctggacctttttcccagaatgggggcctcatccccgtagaaggtcaaagccatgagatcaacagtctgttccaatccccgtggctccttaccacccacctggggaaagcttcctggagcccagccttcactctgccctggtactttgtgtgtgctgttggaggctctccccaaaagcacagaatttagtcagtgtcgtacagggaagaaaatcgggattctgacggcaagaacttgctgtgtgat

SEQ ID NO: 117736 - DNA, 601 bp, Human
gtgtattgccttccctattggaaagataaggactggcctgaagtcactgtgaaatggcatcctgtggggtggggcgagtcaagcagagttgagcaaaaatgaactgaaggaggtggttagtgatgaaaacctggaatgcactattctgaatgtggaatggtagctgacagcattccacggaggctggacctttttcccagaatgggggcctcatccccgtagaaggtcaaagccatgagatcaacagtctgttccaatccccgtggctccttaccacccacctggggaaagcttcctggakcccagccttcactctgccctggtactttgtgtgtgctgttggaggctctccccaaaagcacagaatttagtcagtgtcgtacagggaagaaaatcgggattctgacggcaagaacttgctgtgtgatcttaggcaagtttctccctctggaactccaattgtcaaggggccagatgaggaggtcgtatcatctccctctgaatgtcctcactcacctattttcttgctttgggttggggagagaagacaaagttgctaggtaattttagggtggtgtcttgtttttatttctctactcca

SEQ ID NO: 117737 - DNA, 601 bp, Human
gatgctgtggcctcgaatgttctcgagacaagactgtcagtaagtagggcacacctggaggacgctctgaacacttacctttgaggtaggtcccaaaggaagttggaatgtcagagcagcaggaacttgcagccttcttgttttccagatgggttgcctgggtctaagagagggggctgagaccggccaaagtcacacagcaaagccaagctgggcaccttctgtaaaggccaagctgggcactttctgtaaagcatggttgtaggactcctggtgcccagctccagccctgcaaatgtartttggactgccctacagttggccgagctgaggacagaaaagcagggaggcgggcctgggtgtctaggagttgaaaatgaggagggctcctgctaccggcctacccaggatggcgccattacgactctgtggccagtgtaaggatgggctttgcaagtttctggaattttccaaaatgtacccaaactaatcactagaaggcctgtttccaacccgatatgtatccagttctagcatgtgccaggatggaggaccagcaggactttgtcagtgtcgtgctcttgggaaattgctttatttc

SEQ ID NO: 117738 - DNA, 601 bp, Human
gcaggaacttgcagccttcttgttttccagatgggttgcctgggtctaagagagggggctgagaccggccaaagtcacacagcaaagccaagctgggcaccttctgtaaaggccaagctgggcactttctgtaaagcatggttgtaggactcctggtgcccagctccagccctgcaaatgtaatttggactgccctacagttggccgagctgaggacagaaaagcagggaggcgggcctgggtgtctaggagttgaaaatgaggagggctcctgctaccggcctacccaggatggcgccaytacgactctgtggccagtgtaaggatgggctttgcaagtttctggaattttccaaaatgtacccaaactaatcactagaaggcctgtttccaacccgatatgtatccagttctagcatgtgccaggatggaggaccagcaggactttgtcagtgtcgtgctcttgggaaattgctttatttctggtaataaggtttctaggctgattgaaaatttgctcctcgaactttatcgttatatctgccattttggagacagagatttcctgtttctgcacacactggtctttctggacacactg

SEQ ID NO: 117739 - DNA, 601 bp, Human
ccttggcgtagtagctaggaccacgggcacatgccaccacgcccagctaatttttttaattttttggtagagatggggtctcactatattgcccaggctggtcttggactcagctcaagcaatcctccctccttggcctcccaaagttctgggattacaggtgtgagcccccgcatacctggcctgtgctaagttctatgtccctgttctccaggctgtctataatgacttttctcagtcattcctctgtttctgctgccatcagcctttttaccccttcctggtttgtggctctgagctrctctgcagaaaatgatgacagacccatttgaactgttttacaagagtcacggtgaggcctgaggaactcccgagggatttgagggcttggatctctgcataaacttggagagaggccgtttcctaatcagaggtcacaactagattcagacggtggacgtgccgaaggctgcagcccccaccaatgaagcgggatgggctctttcacagcacacgatactcatatttgcacctggttgctctgaggggctttcacaagcatgtcacctgacaccagtatatcaggggtttacagatgaga

SEQ ID NO: 117740 - DNA, 601 bp, Human
ccacgggcacatgccaccacgcccagctaatttttttaattttttggtagagatggggtctcactatattgcccaggctggtcttggactcagctcaagcaatcctccctccttggcctcccaaagttctgggattacaggtgtgagcccccgcatacctggcctgtgctaagttctatgtccctgttctccaggctgtctataatgacttttctcagtcattcctctgtttctgctgccatcagcctttttaccccttcctggtttgtggctctgagctgctctgcagaaaatgatgacrgacccatttgaactgttttacaagagtcacggtgaggcctgaggaactcccgagggatttgagggcttggatctctgcataaacttggagagaggccgtttcctaatcagaggtcacaactagattcagacggtggacgtgccgaaggctgcagcccccaccaatgaagcgggatgggctctttcacagcacacgatactcatatttgcacctggttgctctgaggggctttcacaagcatgtcacctgacaccagtatatcaggggtttacagatgagagaaccaagcccccagagagg

SEQ ID NO: 117741 - DNA, 601 bp, Human
gcaatcctccctccttggcctcccaaagttctgggattacaggtgtgagcccccgcatacctggcctgtgctaagttctatgtccctgttctccaggctgtctataatgacttttctcagtcattcctctgtttctgctgccatcagcctttttaccccttcctggtttgtggctctgagctgctctgcagaaaatgatgacagacccatttgaactgttttacaagagtcacggtgaggcctgaggaactcccgagggatttgagggcttggatctctgcataaacttggagagaggccrtttcctaatcagaggtcacaactagattcagacggtggacgtgccgaaggctgcagcccccaccaatgaagcgggatgggctctttcacagcacacgatactcatatttgcacctggttgctctgaggggctttcacaagcatgtcacctgacaccagtatatcaggggtttacagatgagagaaccaagcccccagagaggttcccttctgcccaggaacacggagccatggtgagaaccaagcttttcctccacagcaacagcctggacttgggctttttctctcacgctctggttag

SEQ ID NO: 117742 - DNA, 601 bp, Human
ggtgtgagcccccgcatacctggcctgtgctaagttctatgtccctgttctccaggctgtctataatgacttttctcagtcattcctctgtttctgctgccatcagcctttttaccccttcctggtttgtggctctgagctgctctgcagaaaatgatgacagacccatttgaactgttttacaagagtcacggtgaggcctgaggaactcccgagggatttgagggcttggatctctgcataaacttggagagaggccgtttcctaatcagaggtcacaactagattcagacggtggacrtgccgaaggctgcagcccccaccaatgaagcgggatgggctctttcacagcacacgatactcatatttgcacctggttgctctgaggggctttcacaagcatgtcacctgacaccagtatatcaggggtttacagatgagagaaccaagcccccagagaggttcccttctgcccaggaacacggagccatggtgagaaccaagcttttcctccacagcaacagcctggacttgggctttttctctcacgctctggttagcagttgatcactttgccaaaggcccttcgaggccacctgga

SEQ ID NO: 117743 - DNA, 601 bp, Human
agcacacgatactcatatttgcacctggttgctctgaggggctttcacaagcatgtcacctgacaccagtatatcaggggtttacagatgagagaaccaagcccccagagaggttcccttctgcccaggaacacggagccatggtgagaaccaagcttttcctccacagcaacagcctggacttgggctttttctctcacgctctggttagcagttgatcactttgccaaaggcccttcgaggccacctggagctgagatgggagaccccggggccgggcccattccccctccagttggctgggtggtattaggcaagccacccccctccccaggcctcaggttctcatttgtaaaactggtgtgtgggactagatttaaggtgagtccagagtttgcagaggggcctctgttcctcccagcacaacctctgccatctcttctatatgctgggcttctgccgcaggctgtttgaatattaggttggcagctaacagtcgggagaacacggtaccggattgatcctaatgcaagctctgacatttccgtgattctaagacttaaagatcaaagactggaggagttctccaaggaggaaactt

SEQ ID NO: 117744 - DNA, 601 bp, Human
tgaggggctttcacaagcatgtcacctgacaccagtatatcaggggtttacagatgagagaaccaagcccccagagaggttcccttctgcccaggaacacggagccatggtgagaaccaagcttttcctccacagcaacagcctggacttgggctttttctctcacgctctggttagcagttgatcactttgccaaaggcccttcgaggccacctggagctgagatgggagaccccggggccgggcccattccccctccagttggctgggtggtattaggcaagccacccccctccccagscctcaggttctcatttgtaaaactggtgtgtgggactagatttaaggtgagtccagagtttgcagaggggcctctgttcctcccagcacaacctctgccatctcttctatatgctgggcttctgccgcaggctgtttgaatattaggttggcagctaacagtcgggagaacacggtaccggattgatcctaatgcaagctctgacatttccgtgattctaagacttaaagatcaaagactggaggagttctccaaggaggaaacttctggttagtgcacgagggctcagcagactcagcc

SEQ ID NO: 117745 - DNA, 601 bp, Human
cagaggggcctctgttcctcccagcacaacctctgccatctcttctatatgctgggcttctgccgcaggctgtttgaatattaggttggcagctaacagtcgggagaacacggtaccggattgatcctaatgcaagctctgacatttccgtgattctaagacttaaagatcaaagactggaggagttctccaaggaggaaacttctggttagtgcacgagggctcagcagactcagcctccccagatccccggtaggcttcagagtcaaaaccaatatccttcatggttttttttttttttaatttaaaactgtggtaaaatacatgtaacataaaatgaaccattttaaaatgcgtaagcgtgccgctcaacggcattaggtcctttcccagggctgtgccactgtgactaccgtccacctccagaacattttctttttgcaaagctgagactctggccccatgaaacactccccattttccctaccccggcccctggcagccaccatttctggctgtatgattttgatgactcgagggacctcgcatgagtggaacatacagtgtttgtttttgtgcctggcctttgtcacttagcgtc

SEQ ID NO: 117746 - DNA, 601 bp, Human
cagctaacagtcgggagaacacggtaccggattgatcctaatgcaagctctgacatttccgtgattctaagacttaaagatcaaagactggaggagttctccaaggaggaaacttctggttagtgcacgagggctcagcagactcagcctccccagatccccggtaggcttcagagtcaaaaccaatatccttcatggttttttttttttttaatttaaaactgtggtaaaatacatgtaacataaaatgaaccattttaaaatgcgtaagcgtgccgctcaacggcattaggtcctttcscagggctgtgccactgtgactaccgtccacctccagaacattttctttttgcaaagctgagactctggccccatgaaacactccccattttccctaccccggcccctggcagccaccatttctggctgtatgattttgatgactcgagggacctcgcatgagtggaacatacagtgtttgtttttgtgcctggcctttgtcacttagcgtcacggccttatgttgatgctgtggcatgtgtcaggatttccttcctttttttttttttagacagagtcttgctttgtcacccaggctgga

SEQ ID NO: 117747 - DNA, 601 bp, Human
taagcgtgccgctcaacggcattaggtcctttcccagggctgtgccactgtgactaccgtccacctccagaacattttctttttgcaaagctgagactctggccccatgaaacactccccattttccctaccccggcccctggcagccaccatttctggctgtatgattttgatgactcgagggacctcgcatgagtggaacatacagtgtttgtttttgtgcctggcctttgtcacttagcgtcacggccttatgttgatgctgtggcatgtgtcaggatttccttcctttttttttttttagacagagtcttgctttgtcacccaggctggagtgcagtggtgtgaaatcagctcactgcaacctctgcctcccaggctccagtgatcctcctgcctcagcctcccaagtagctggggctacaggcatgtaccaccatgcccggctaaatttttttgttatttttagtagagacggggtttcaccatgttggccaggctggtcttgaactcctgacctgaggtgatccacctgcctcggcctcccaaagtgctagaattattacagtcatgagccactgtgcccggcccccttccttct

SEQ ID NO: 117748 - DNA, 601 bp, Human
agttcccagctccacctagagcaagtcccttctcctcttgagctcagtttccccatctgcacggtgcggtcagcctaggtgattgcccaagccctctgccaccccagtggcctctggagagacctggccgcaggggccccatgggctgaaggtggcatgtgtgtacacatgtgtacatgtatgtgcacagctgtccccctcccctggctccctggtggaagggaagaagggatatttggggctctgggctctaccgtagtcgctttaattacaggctttcaacctcgggccggtgggcacrcatggggagggaggggttgctgctccgaaaccctgtcattttctagcgtctgagggccccttcaaagggggcatctagacattttctccacaagccgcagagtggactgtcgtggccccagcatgaacataatgacagatgcattttgcagcaagctgggagtgaatgggtccggccggcttgtctcctgtcagacgactcattattattattttttttttttttgtcatttgctgacagtttgggtttcatgcgtttctctcttttttctccttttccccctgcctggaaaaatggcta

SEQ ID NO: 117749 - DNA, 601 bp, Human
gtggaagggaagaagggatatttggggctctgggctctaccgtagtcgctttaattacaggctttcaacctcgggccggtgggcacgcatggggagggaggggttgctgctccgaaaccctgtcattttctagcgtctgagggccccttcaaagggggcatctagacattttctccacaagccgcagagtggactgtcgtggccccagcatgaacataatgacagatgcattttgcagcaagctgggagtgaatgggtccggccggcttgtctcctgtcagacgactcattattattattwtttttttttttgtcatttgctgacagtttgggtttcatgcgtttctctcttttttctccttttccccctgcctggaaaaatggctaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtgcgtaagactctatggctgccccctctaaccgcctcacaagggatcccaaagtactatcaggctctcgggcctggccct

SEQ ID NO: 117750 - DNA, 601 bp, Human
agcgattctcctgcctgagcctgctgagtgactgggattacaggcatgcgccaccatgcctggctagtttttgtatttttagtagagatggggtttcaccatgttggccaggctggtctcgaactcctgatctcaggtgatccgcccgtcttggcctcccaaagtgctaggattacaggcatgagccactctgtctggccagtttttacatttttaaatggttgggaggaaaaaaaattttttaatgctatttcatgacaaattatataaaattcaagtgttgccgggcacggtggctcaygccaggtgaggtggctgtttctgcattgtctgtggctcccctggagcggcaaggggaggttgagccatttgagagagaccataggacccaaagagcctaaaatattgactctctggcccttcccacccacctccataacatacacatagccctgatttggggcgttacattaaacagctgccctgagctgtgggaggacaggctgctgcctgaggccgatcctcacatcttcgggggcctggacgtcaggggacctgtgcaaagttagtattagttaatcgaatagctacctgggctaag

SEQ ID NO: 117751 - DNA, 601 bp, Human
ctcacgccaggtgaggtggctgtttctgcattgtctgtggctcccctggagcggcaaggggaggttgagccatttgagagagaccataggacccaaagagcctaaaatattgactctctggcccttcccacccacctccataacatacacatagccctgatttggggcgttacattaaacagctgccctgagctgtgggaggacaggctgctgcctgaggccgatcctcacatcttcgggggcctggacgtcaggggacctgtgcaaagttagtattagttaatcgaatagctacctgggytaagctctcctcccctcgcctctccccctccactcccagattttgtttccttttaagcctcctaatcactgtaactcatctcaggatttcgagagggctcgatggttattggctggcgttatttctccctgccattgttccttgcagctttgaagccaagtttctgcccccgttcccagggacagacaggtgcttaaataccattgtctcctgcaggctttccagcccggcgggattgcgaccccgaaaggaggattttagttacaaagtgagagagtcattaagacgtggcggaggaga

SEQ ID NO: 117752 - DNA, 601 bp, Human
actggctgggttgagtccctgctctgacagccagcgacaagccctctacatcccaaactgaggtacaatgattaggagacttaaaaggaaacaaaatctcagagtggaggcgagggagagtaggggcttcttctgggtagttatcactaatattaactttgccctggtccgctgacatgcagggccccacaaacatcaagatcggcctcgggcagcaggctgacccccacagctcagagggcctgtttgatgcgattttccccatgagggatacagacatggtatagaccagggctttgcytgatcatgttacttaacttccctaggcctcagttttcccatctgaagagtgggaataacagttctacctgtctggtgggtgaggactaaaagtatgagtatttgtaaagcacctggaacaatgtctggcagacgagtgcttattccagtgcgtgaaataactgcgagcgcccggcgtggtttcccagtgtggaggcgcggcacttggagtcttgcctctggctgggttaatggtcttgagcagggctgtctcttccttgagcctcagtttcccctcctgtcaaataaagggcaccaggct

SEQ ID NO: 117753 - DNA, 601 bp, Human
caccactatgctcccgtggaacttacaggctagctgggagaaaggcatggatcaaaccattaccagaatgtagaattagacaaggtggcagcgggctgtgaggaatgcaggatagtctggctgggtataataactgggattggctaggaggggtggtgcatgcctgtaatttcagctactcaggaggccgaggtgggaagattgcttgagcccaggagttcaagaccagcctaggcaacatagaaagaccttgtctcaaaaaaatatatatacacacacacatacatatatatatatatayacacatacatatacacacacacacacacacacacacacacacacacatatatatataaaataattggggttgtgaagaagctcctttgctattcaaacaatagcagaaggagttaacaggtgaatggggggaggggtggaagggcaaaagtggccagggggaaggagctgaagctagatcttaaagggaagggcaagatcagatctgtgcatttagagggtcctcctggctgctctggagaacggatttgagtaggtgggaggtggaagggcacctgtggaaatgcggtagcttggacca

SEQ ID NO: 117754 - DNA, 601 bp, Human
gattgaaatgacttggatgtggagggagatggagggtccagaatcaccctggtgtctggggtcgtgagcagctgggtgcagtccctgggttgaggaaatgctcttgaggaaggatcatgcatttggatttaggtgtcatgagtatgggtttcttttgagatagctgggaaaaactaactggaaggccgccggacacttgggtctagagttgaggagaacccaggctgaagaccctggagcatcataggcattttgatgttctctgaagcgctgggccaagagagactgcctaggggaaagygtggagtgagacaagaagggaactagccaggcaagatggtgcacacctgtaatcccaactctttgggaggccaaggcaggaggatcgcttgaggccaggagttcaagaccagcctgggcaacatagtgagacctcatctctactaaaaataaaaaaattagctaagcgtggtggcatgtgctcgtggtcccaactacttgggaggctgaggtgggagcgtctcttgagtctgtgagatcaagggcgcattgagccatgatcatgccactgcactccagcctgggcaacacagcaaaaccc

SEQ ID NO: 117755 - DNA, 601 bp, Human
ccgctcacttcaaaccacaattttaaaaagaggttttttagttcctgagaaacccctcttggaactcccagcagcctcgtgggacaagtttgtccctggatgtgggccctctttgcaggggctgccagggcagctgggaagttcccaccttggggaacgggatggggagagtttgttgtgacttgtgagagatggaggtgaagggacagatggacacagaggtggggggattctgtgtcctacgttctccctgggctgagtataggggccagtggggctgaggctcggtttctaaaacaargtctgttgaagggatctgaggaggttggtggtctagtttggtctagctcttcctaagcactgactgcacagaaaggggtggccagcaaaagtctggtatctcctcctcttccagggaatgcaagctcctagtggcttcagtgcctgagccctggaggggccgtggaggtgtagaggagggaggaagggacatcaaggaggtacaggagcatgggagtgactctgcagagagttccacgcacccaccggcttcaaggcctggtgaaggtcagggcccgggtcctgaacaaatcactggggc

SEQ ID NO: 117756 - DNA, 601 bp, Human
acaaaccccactttcctgtccatctgcccatagcatcctcagaagcatgctttgatagccgacagtaacagagggtcctaggcattggggtcctaggttcctgtgtcccaccgggtgcctctgatacttgccctcccctcccgctaagccacagggactccactatgagctcctttgcagggcaggttaaacaaggaaatagcatagaggtggagagaagcctttgttttctgtcaccatacctgagctgtaggtctagctggaagccatcctagccacgtggatctccatggcccaggarggtggtgcacgtcatctgaagtcactcagacctttgatcctctgtgagtcaccagtaagagtgtcagctgtacctgcctcacagatgcagtgaaggttcaatatgagcctgtggaaatcaagcatgcggctcaggcttagaccctggcatgcaggaagagccaggggcagtgccagcagcaagcacactcagcccagggccggtgtgctcaagggcaaacagggtcgtttgtcaccagcagctaacatagactaagctgctctgggacactctcctaggatgtctcatttaattcttaca

SEQ ID NO: 117757 - DNA, 601 bp, Human
gtaagagtgtcagctgtacctgcctcacagatgcagtgaaggttcaatatgagcctgtggaaatcaagcatgcggctcaggcttagaccctggcatgcaggaagagccaggggcagtgccagcagcaagcacactcagcccagggccggtgtgctcaagggcaaacagggtcgtttgtcaccagcagctaacatagactaagctgctctgggacactctcctaggatgtctcatttaattcttacacaaaatttgcaactccccgggaacaggctgagtggttaagtaactttccaagggycacacagctaggaggtggtggagctgagtccggagggcctgtcctgctgtgggttctccatcaccagctcccttctcatggggattggagtctagaagaagatgcaagtcagtctcctcttgctaacaacatgccctgggcacagagccatcattttctcccagagccagtctcttgtccctggaggcacctcatgccccgagagatgttgaagcccgcccatctgcccagggtcctctcccttcccctccgtcacctccacctcccctgcctcctgcgccctctgtttgtattttatga

SEQ ID NO: 117758 - DNA, 601 bp, Human
catgatgtccgctttacagatgaggacaacaagacttggaaggaaagtgactcaccccagattatggagtaaattagtggcagagttgagactcagtcctggggctctacttaatccaaagccatttctggcctgtcacacagtatggatgcacattatatagaaacaggaactaaaatccaaatcaaacatgtggtgaagagttgggggcatgaccgaagctgagagtaacagtcaaggctaaagaataatggccctcagctggtcagtccagctacctgtgaccagcaagtcacttacmagtcaaaccaggtcgaggaacttggaacatgggggtcagcaagcacttcccccaagagatgactcatttttctccactgagagaggcccctaaaggcctcaccttggcagcacctctttgttactctaggtggggtgcagggaggtagaggggagactgcaacaggtcccagctgaagttcatgaagggtacaaaatccacatatcacagatcatcagtctcactcacaggcaaggcccttacccagagcctaaaactctcagcttggaaataagcctaactcatctgattagtttctta

SEQ ID NO: 117759 - DNA, 601 bp, Human
cagggagaacaggtatcatgatgtccgctttacagatgaggacaacaagacttggaaggaaagtgactcaccccagattatggagtaaattagtggcagagttgagactcagtcctggggctctacttaatccaaagccatttctggcctgtcacacagtatggatgcacattatatagaaacaggaactaaaatccaaatcaaacatgtggtgaagagttgggggcatgaccgaagctgagagtaacagtcaaggctaaagaataatggccctcagctggtcagtccagctacctgtgascagcaagtcacttacaagtcaaaccaggtcgaggaacttggaacatgggggtcagcaagcacttcccccaagagatgactcatttttctccactgagagaggcccctaaaggcctcaccttggcagcacctctttgttactctaggtggggtgcagggaggtagaggggagactgcaacaggtcccagctgaagttcatgaagggtacaaaatccacatatcacagatcatcagtctcactcacaggcaaggcccttacccagagcctaaaactctcagcttggaaataagcctaactca

SEQ ID NO: 117760 - DNA, 601 bp, Human
aggtcgctgggcaagtgactgagtgcaggagcaggtccagccgccgcctgttctgctctcctgactcaatggccccaagacccaagatttcccacggcacaccccccttgccccataagcttgcccccacccttacaggccctgccaaaaagcaggacacttgccaggggaggctcaggccacccctccccgagatccccacagtactgaccacaggcaagctgacccggtgcacctgtctcaggaatgccagggaccttctcacactgtctctccacctaaatgaaagcttcctgagggygggcaaaagcagtaacatcacaggtaaagctcactcttccaggggaagcgatggcgtgggccccatgaccacctgcagctggataagacagttgctgaagtagccccaagcccagggtcttgcctctgcggcctcacctctacaacctgcaccccaaacatacctccttgtggtgaggggcatacacacatcagccttcccctggagcctgtcagggcacgcatgtcccattcagtggaaggttccagaatacatgctcccatccaaaacccaacctctgctggaacagctgagagagaa

SEQ ID NO: 117761 - DNA, 601 bp, Human
gcaaccctcaggtgaatcactaggcagagagtttttcccagggctgacggccagaggaggcccatcctctacacaaaattaggcagccacgaagccataaaagccaggaggtcagagacccttgaggggctcccagtggggagaggaaccagtggcagcctcgggaagccccgagcgcagcaggagaggtcgctgggcaagtgactgagtgcaggagcaggtccagccgccgcctgttctgctctcctgactcaatggccccaagacccaagatttcccacggcacaccccccttgccccrtaagcttgcccccacccttacaggccctgccaaaaagcaggacacttgccaggggaggctcaggccacccctccccgagatccccacagtactgaccacaggcaagctgacccggtgcacctgtctcaggaatgccagggaccttctcacactgtctctccacctaaatgaaagcttcctgagggcgggcaaaagcagtaacatcacaggtaaagctcactcttccaggggaagcgatggcgtgggccccatgaccacctgcagctggataagacagttgctgaagtagccccaagccca

SEQ ID NO: 117762 - DNA, 601 bp, Human
acaggcaggcccccagatacccaccagtcacacgacacagccacaagaggccatgcacacccaaaagcattgcctcacctctgcctctcagccccttccccctatgtcacagatgggttcactgagaccaagagaggcctctgtacacagtcactcgagagagaggaggcagggccaagacagaaagccaggcccctgagccccggctgtgtcttgctgcactctctgcctcgtgccggcccccagagggcttgcagtggatcaaggttggttgggtgagtctcaggggaggacccgtggscctggcaccatgactcagctgatgagtggactgatcaacatgcccgccttccccactgccccaacctgcccgccacagccttcattcctgctgctgagcggacctcgggcaggtgccaggactcttgggtgtgtgtgcggagaacatcatacagccccagccctggcccaacgtcacccaggcacctctgtccactccagctcccacaaggagctcgaatccacccctcaagcagcctgccctgccctccactggccttgcccatcccaccgatgaccccttgggcaaccaactctcctt

SEQ ID NO: 117763 - DNA, 601 bp, Human
tttacagatgagaaaattgaggcaaaggagctatgtcatctgtcccaaggcacacagccactgaagccagcagtcttgctctggcagtcatgccatgaaccacccatcacagtgaagcccacagggctctctcactctcaggaagacaacagccatcatttccactggtggcaccctgcagtctggcccagctttgtcggcatccatagaaaacccagctccttctccaggacagccatcagtctgaagttctggggacaggccaccgtgccccattgctaggggtcctgcccagcaggcmtgagcccctgccagggtgccccaatgtctggctttgcctggcctcctctcccatctgccagcccagcccataccttctcaggtcaggaggcaacccagcccgtaccttctcaggtcaggaggcagcccctggcagaggctcgggtggaagagagcaaagtctagcctgctagtgaaggctcatgtttctgagaagggcaaaagccatgtttgcaggccctgttaacgtcagcagcactggggtcagaccagcaggccattcacacagagtgactccacgctcaggctgggtcagactgca

SEQ ID NO: 117764 - DNA, 601 bp, Human
gaaattctctttgctcttcctggagtcacagatgtacacggtttctcctcccacgtacagaacaatgggctagcctgggaacctgcctctcagataaagaacaattcagattgagtaagcactgaggctgctgagaagcccagagacacgggaaggcagagtgtccctgaaggagtcccaggggagggtggggctggtcccttctggtttgggggatgggagacagaattttctgtgacggctctctctgaagagggagaagccacctgggaagccaggtggatcctccagattactggcrgggccccaggtcaagtggcttgccctccctctgatgggctggcagatctgcacagcctccaacccccagcacagagctcctagccctctcagcctctgcacacggtgggtgttgagatggctgaaagggagactgtggacacagctccagtctgaaaagctcagcatgaccctaggaaagggaagtagccacatgccttgcccagagctcagggactaccaggggagttggtgggcagggggtgtggtggaagaagagtctaagcctctgatctggactggagattacttgaagaataga

SEQ ID NO: 117765 - DNA, 601 bp, Human
actgccttccgaacgcctcagtgccctgcagtgtggatctgtggctgccttccctctgtggggagccctgtgaccctttccttcagcctggactgaaaacggcctaagcactgagcaggcaggtcatatccgagcacccaggagcaagggtctctgggaaagggctggaatccgccatgcggctcccgtgctggggacctgggcagctttcagcctctctctagacctgttctccacctagacgccagaaggggcttggtggataacgctaaagtgctttacggctgacaggctggcccgscggctttagcacctggtgctgctctgggaactagacaggggttctgtcccccaagactctccaaatgccccctcctcagggacccacagcactgatcaccagagggtggcccagggaaaatgaccaggtccaacatggggatagtctggtgacagtctggcctctgtccctaaattacggggtggtgccagaaacaccttgcctcaggttgtccatctgtacaacggaggtttggccaaaatggtgggactcgtgggagtaggcagcagggcagggccacaggccaggagacactgggct

SEQ ID NO: 117766 - DNA, 601 bp, Human
tcccactgccttccgaacgcctcagtgccctgcagtgtggatctgtggctgccttccctctgtggggagccctgtgaccctttccttcagcctggactgaaaacggcctaagcactgagcaggcaggtcatatccgagcacccaggagcaagggtctctgggaaagggctggaatccgccatgcggctcccgtgctggggacctgggcagctttcagcctctctctagacctgttctccacctagacgccagaaggggcttggtggataacgctaaagtgctttacggctgacaggctggcccggcggctttagcacctggtgctgctctgggaactagacaggggttctgtcccccaagactctccaaatgccccctcctcagggacccacagcactgatcaccagagggtggcccagggaaaatgaccaggtccaacatggggatagtctggtgacagtctggcctctgtccctaaattacggggtggtgccagaaacaccttgcctcaggttgtccatctgtacaacggaggtttggccaaaatggtgggactcgtgggagtaggcagcagggcagggccacaggccaggagacactg

SEQ ID NO: 117767 - DNA, 601 bp, Human
caagctctagtggccaaaggaccagggaaagctcagcaatgtcctctacatttccgacacgtccactcgcatagatagcacaccacggtggcagcccagcctccctcccccaggagctgaaggcccactgaacatccagaagcacctacatgactgggaagtgtctacctgaagctgggctgaggctccttcgtgcctggggctgagcccactggcttcccaccagccggcccggctggacccagcagggctgagcagaagacagctgctggagctgacaggcaggtgggctccggggacraaggctgggcctggaaggcagcacaggctgcagggcctggtcctgcttttccaggggtaccagtgggagggcacgggagaaaaagctgcaacaccctctcccagtcccactgccttccgaacgcctcagtgccctgcagtgtggatctgtggctgccttccctctgtggggagccctgtgaccctttccttcagcctggactgaaaacggcctaagcactgagcaggcaggtcatatccgagcacccaggagcaagggtctctgggaaagggctggaatccgccatgcggctcccgtgct

SEQ ID NO: 117768 - DNA, 601 bp, Human
cagaggctgaagtacagagggcttccctaaggggactactaaggccaggccttgaagcccccaaaccaactcaggagaggataagacaacgctcaccccaggcactaacttgggcagcgcagggggcctctgattcgcagtcattcgtggtggagcaggaaagggaagctgatctgtcagctgtacctgccccgtgtggccacgaaatccccggcttctgtgggagcccagtcactgaatcaacaaaccccaacaaaccagggataaagagctgccccttatcaaaggagctaggtcaccrcctttgacaagcaacctggaccaggggccatggcactggctctggggccagtggacaggagagacccagacctgttccagaagcccaggctgcgaggtcatgaggcaggagggcccatggtcatggcaggctggacacccaccctccccatcccgagattccacacaatggcaaatgtcctcaggaggcttgaaacagggtcacagttgtttagaaatcttctttacccccttggtttctcagtcagatctacacatacaaggaaaacaggctgactctcccctcccctagacttcagga

SEQ ID NO: 117769 - DNA, 601 bp, Human
tggccaacatggtgaaaccccgtctctactaaaaatacaaaattagctgggcgtggcggtgtgcacctgtactcccagctacttgggaggctgaggcaggagaatcacttgaacccaggaggtggaggttgcagtgagccaagatcacgccaggagcttttggagaaaagagggaagaaacagtctggtcctggcccggcagagctcccagctcctcagaacatatggccaggtgtccggctccagggggatttaaaaagggggagcttcagaggctgaagtacagagggcttccctaagrggactactaaggccaggccttgaagcccccaaaccaactcaggagaggataagacaacgctcaccccaggcactaacttgggcagcgcagggggcctctgattcgcagtcattcgtggtggagcaggaaagggaagctgatctgtcagctgtacctgccccgtgtggccacgaaatccccggcttctgtgggagcccagtcactgaatcaacaaaccccaacaaaccagggataaagagctgccccttatcaaaggagctaggtcaccacctttgacaagcaacctggaccaggggccat

SEQ ID NO: 117770 - DNA, 601 bp, Human
gggatggggagtcatcatcaccggctgccagccattacaaagagcacatctgaagtctgtgggcagagagctggcagagaagcttccagaaggcagcctcaagccaactgccagctttcgctcccgtaacagaggtaaagagggccactctccttggcaacctccgtctcagcagagccccttgtcctggccagccctggggctaaggggcagctgcgctgcagctcctctgcaagacagctcagaagtgccttggctgcctcagaagccaggatgtccagtgggcatctcagacaggttsgacggggggcagcgggcccagtcgctaacccgagaggttgcccatctaccccccgccatcagcctgaggccaccaggtcagaaggcctttggtttccagcccgcaccctgaatcactgacattggtcacctgctgcttgaagtgagtgatgggtaaaacacaaaccccttaaaaagcattactactaggcgcggtggctcccgcctgtgatcccagcacttcgggaggccgaggtaggcggatcacctgaggtcaggaattccaaaccagcctggccaacatggtgaaaccccgtctcta

SEQ ID NO: 117771 - DNA, 601 bp, Human
ttaaggaaaacctgtctaaggctcctcagtgggatggagtttcactgagctggagtcgctgagcctgccccagtggtgacgctacccagggaccagcccacatttgagaggtggagaggaaatggcgtagaccagaacgggacctgtgccaccagggatggggagtcatcatcaccggctgccagccattacaaagagcacatctgaagtctgtgggcagagagctggcagagaagcttccagaaggcagcctcaagccaactgccagctttcgctcccgtaacagaggtaaagagggccwctctccttggcaacctccgtctcagcagagccccttgtcctggccagccctggggctaaggggcagctgcgctgcagctcctctgcaagacagctcagaagtgccttggctgcctcagaagccaggatgtccagtgggcatctcagacaggttggacggggggcagcgggcccagtcgctaacccgagaggttgcccatctaccccccgccatcagcctgaggccaccaggtcagaaggcctttggtttccagcccgcaccctgaatcactgacattggtcacctgctgcttgaagtgag

SEQ ID NO: 117772 - DNA, 601 bp, Human
ggctgagatcactgtctctagcagataaggactagagactctgaaaggtgagggacttgcccaaggccgcccagacactacaactccccgtgcagcagcactgctctcctcacctgccatccccttctctctccccagccctaccagttgacccaatcagttttaaggaaaacctgtctaaggctcctcagtgggatggagtttcactgagctggagtcgctgagcctgccccagtggtgacgctacccagggaccagcccacatttgagaggtggagaggaaatggcgtagaccagaacrggacctgtgccaccagggatggggagtcatcatcaccggctgccagccattacaaagagcacatctgaagtctgtgggcagagagctggcagagaagcttccagaaggcagcctcaagccaactgccagctttcgctcccgtaacagaggtaaagagggccactctccttggcaacctccgtctcagcagagccccttgtcctggccagccctggggctaaggggcagctgcgctgcagctcctctgcaagacagctcagaagtgccttggctgcctcagaagccaggatgtccagtggg

SEQ ID NO: 117773 - DNA, 601 bp, Human
acactttccacccattcctctttcttccctacaactcccctgcagatgaggcagcggggctgagatcactgtctctagcagataaggactagagactctgaaaggtgagggacttgcccaaggccgcccagacactacaactccccgtgcagcagcactgctctcctcacctgccatccccttctctctccccagccctaccagttgacccaatcagttttaaggaaaacctgtctaaggctcctcagtgggatggagtttcactgagctggagtcgctgagcctgccccagtggtgacgmtacccagggaccagcccacatttgagaggtggagaggaaatggcgtagaccagaacgggacctgtgccaccagggatggggagtcatcatcaccggctgccagccattacaaagagcacatctgaagtctgtgggcagagagctggcagagaagcttccagaaggcagcctcaagccaactgccagctttcgctcccgtaacagaggtaaagagggccactctccttggcaacctccgtctcagcagagccccttgtcctggccagccctggggctaaggggcagctgcgctgcagctcc

SEQ ID NO: 117774 - DNA, 601 bp, Human
cccaggtgtggataccgaggacggcacaaggggcaggggcagggctgggcacaaggaactgtctgttctgaggcaggtctgcccacacagggcaaccccaggcctggccctgatacaccttcccacacttggcccagttcctgtctatagtaaagactgggtgcaggccctttggtcagagtatcatcctccttggggaaggaaggacagggtgtccatcaggctggggacatataaggctaatctggaaggggccctgcactgacaagcctccaagaagtgggctgtgggcctgggacgsgccctgctggcaaacagcagtcccaggaatgctgcccgcctgcccagctccaagaggcaaaggggccagagggcaaacatatacacatctctccagttcctgaggccggggctgactggcaggaccgggggcgggggcggggaggcaggatcacgccacacacagtgagcaggcctgtgcagaaccctggtcggcagggagggcagaaagtcaggactgcctctgcccttcacactggccccaagacctcaggtaaggaagagagaacccagcagccaggtggcgagaagtgtggctttg

SEQ ID NO: 117775 - DNA, 601 bp, Human
gccttctcatgtggctccaggaccctcagctctgggcagcactttggtccccaggccccatcccctgatgctacaacacagcctggtactgggtgcagggctgcaggggcacaacagagtaggcagggccctcaccctgagaagctcagtctggtgagggagctccagacctctcagaagggcagacagggagctgttattgggaacagaggctgtggtccccatgggaccccatcagcccaccctacactgtgaaccagctcttgggggccatcagccagggagctttggggccaaagaytgccgacccagccccactgagaggctttcaaaaacccccaagaacaatctcaggacaacctggatgcagaggcagcctccaggcatgctggcccccaggtgtggataccgaggacggcacaaggggcaggggcagggctgggcacaaggaactgtctgttctgaggcaggtctgcccacacagggcaaccccaggcctggccctgatacaccttcccacacttggcccagttcctgtctatagtaaagactgggtgcaggccctttggtcagagtatcatcctccttggggaaggaagga

SEQ ID NO: 117776 - DNA, 601 bp, Human; identical to SEQ ID NO: 26323

SEQ ID NO: 117777 - DNA, 601 bp, Human; identical to SEQ ID NO: 26324

SEQ ID NO: 117778 - DNA, 601 bp, Human; identical to SEQ ID NO: 26325

SEQ ID NO: 117779 - DNA, 601 bp, Human; identical to SEQ ID NO: 26326

SEQ ID NO: 117780 - DNA, 601 bp, Human; identical to SEQ ID NO: 26327

SEQ ID NO: 117781 - DNA, 601 bp, Human
taatcttctaaaggaagaacagaccccccagaataagattacagttgttggggttggtgctgttggcatggcctgtgccatcagtatcttaatgaaggtaagtgagagtctaccacactggaagcccataccttgaccccatcctctacccccactcctacccctagaactgtattattacatttcatgtaacagtatttagatttatgcactcattcggataactttctgtgaaacaaacttttgaaatatgataatacaccaaaagtgtatctgaaattaaaaagaatcaaaggttgtyaggctggagacccagttcctaaaattcattattctgtattaacatgcatggattgactaccaatgaaaaggaagggtccatgattttaaatgagccaaaattcttttaaagtgatttttgaattgaaaatgacaattcaaaaattgtcatttattggtaaaattatatgggaaatcataagttctcccactcaaatctcattgcccctgtgccttggatagcaattttgttatcaattatggagctaaaatttaattagaaaaaagaaattgtgagtaaagcactccttattacactatt

SEQ ID NO: 117782 - DNA, 601 bp, Human
ccaggctggtcttttttttttttttttttttttttttctgagaaggagtctcgccgtgtcgcccaggctagagtgcagtggcgtgaactccgctcactgctagctctgcctcccgggttcataccattctcctgtctcagcctcccaagtagctgggactacaggcacccaccaccacgcctggctaaatgtttgtattttttagtagagacggggtttcaccatgttagccaggatggtctcgatctcctgacctcgtgatccgcctaccttggcctcccaaagtgctgggattacaagygtgagccaccgtgcctggcctggccaggctgtcttgaactcctgacctcaagtgatgtgcccgcctcggcctcccaaagtgttgggattacagatgtgagtcactatgcccggccagaacatttcttactaatttcaagtcttgatgctggtcaatatcacctagttaaatgaataacaacctaaaattggtgtgtaggatggaatttgagagagtagacagagcagttttatataattggaagttattctagcaactgccagtccagtgttctgcttccacatctgcagtggtggaact

SEQ ID NO: 117783 - DNA, 601 bp, Human
ctcggcctcccaaagtgttgggattacagatgtgagtcactatgcccggccagaacatttcttactaatttcaagtcttgatgctggtcaatatcacctagttaaatgaataacaacctaaaattggtgtgtaggatggaatttgagagagtagacagagcagttttatataattggaagttattctagcaactgccagtccagtgttctgcttccacatctgcagtggtggaactcctatagagctcgcttcagtggggagacagggctggagagagggtcagtgctatctatgtagggwgtaatctgtaagtcagcttttgaaatggggtgccctctactttgaatatctcgatactgtactaataaagtaacagaactctcctatgccagaaatatagaaatttttcatgctcttctaaaaatctagaagtggcaattttccatttaactaaagatttgatgtcttttaggacttggcagatgaacttgctcttgttgatgtcatcgaagacaaattgaagggagagatgatggatctccaacatggcagccttttccttagaacaccaaagattgtctctggcaaaggttgatttca

SEQ ID NO: 117784 - DNA, 601 bp, Human
caagtcttgatgctggtcaatatcacctagttaaatgaataacaacctaaaattggtgtgtaggatggaatttgagagagtagacagagcagttttatataattggaagttattctagcaactgccagtccagtgttctgcttccacatctgcagtggtggaactcctatagagctcgcttcagtggggagacagggctggagagagggtcagtgctatctatgtagggtgtaatctgtaagtcagcttttgaaatggggtgccctctactttgaatatctcgatactgtactaataaagkaacagaactctcctatgccagaaatatagaaatttttcatgctcttctaaaaatctagaagtggcaattttccatttaactaaagatttgatgtcttttaggacttggcagatgaacttgctcttgttgatgtcatcgaagacaaattgaagggagagatgatggatctccaacatggcagccttttccttagaacaccaaagattgtctctggcaaaggttgatttcaacaagtttatattataatccatgcttgacttaaattctttttccagatggtctccatttgttgcttagggt

SEQ ID NO: 117785 - DNA, 601 bp, Human
gtggcaattttccatttaactaaagatttgatgtcttttaggacttggcagatgaacttgctcttgttgatgtcatcgaagacaaattgaagggagagatgatggatctccaacatggcagccttttccttagaacaccaaagattgtctctggcaaaggttgatttcaacaagtttatattataatccatgcttgacttaaattctttttccagatggtctccatttgttgcttagggtagagtgcagttgcacaattatggctcaccacagcctcgaaccctgggctcaagcaatcctycttccacttcattaccccctccccctcacaaagaaactgggactatagggtatgctaccatgcccggctaatttttttactttttgtagagatggggacccactgtgttgcccaggcctgtcttgaaccactgggctcaagtgatcctccctccttagccttccgaagtactgggattgcaggtgtgaaccactgtgcccggctttagacttaaatgttttatcaggcttgaaatcctagctctttaaagattttgttttaaatgccgggtgcaagagcctgggaacaatttcacttagg

SEQ ID NO: 117786 - DNA, 601 bp, Human
gtctccatttgttgcttagggtagagtgcagttgcacaattatggctcaccacagcctcgaaccctgggctcaagcaatcctccttccacttcattaccccctccccctcacaaagaaactgggactatagggtatgctaccatgcccggctaatttttttactttttgtagagatggggacccactgtgttgcccaggcctgtcttgaaccactgggctcaagtgatcctccctccttagccttccgaagtactgggattgcaggtgtgaaccactgtgcccggctttagacttaaatgytttatcaggcttgaaatcctagctctttaaagattttgttttaaatgccgggtgcaagagcctgggaacaatttcacttaggtgcctgtgaatatcaaagtttcaatttctggcaaatggtttaaaatagaaatccaatttgtccatgctatgcaaaccatctgaattagaatgtaatgagtaaagcttaaaccttaggtctgtatttaaccacattgtgttacttacttgcccccacatcctttcacacacgaagttgagaatagggtaaataaatgagcctgttcagctaatactctt

SEQ ID NO: 117787 - DNA, 601 bp, Human
cctccctccttagccttccgaagtactgggattgcaggtgtgaaccactgtgcccggctttagacttaaatgttttatcaggcttgaaatcctagctctttaaagattttgttttaaatgccgggtgcaagagcctgggaacaatttcacttaggtgcctgtgaatatcaaagtttcaatttctggcaaatggtttaaaatagaaatccaatttgtccatgctatgcaaaccatctgaattagaatgtaatgagtaaagcttaaaccttaggtctgtatttaaccacattgtgttacttamttgcccccacatcctttcacacacgaagttgagaatagggtaaataaatgagcctgttcagctaatactcttggcttgaccctttcacacttaacagcaccagccaagaaacctgaatgtgagcccaaatagtgtctattttgatacctgaaaatcactggccaccttgctgatgggcaactcccttcatcactggtttaactctcttgtgccatagggtatctagaagcaaaatatgtttgttaagtgtaaagctgtctctgcttaaaaacaagtccccctaccaccaccaccacacac

SEQ ID NO: 117788 - DNA, 601 bp, Human
aattagaatgtaatgagtaaagcttaaaccttaggtctgtatttaaccacattgtgttacttacttgcccccacatcctttcacacacgaagttgagaatagggtaaataaatgagcctgttcagctaatactcttggcttgaccctttcacacttaacagcaccagccaagaaacctgaatgtgagcccaaatagtgtctattttgatacctgaaaatcactggccaccttgctgatgggcaactcccttcatcactggtttaactctcttgtgccatagggtatctagaagcaaaatatgtttgttaagtgtaaagctgtctctgcttaaaaacaagtccccctaccaccaccaccacacacacacacacacacacacacacacacacacacacagaaattgcctgttcctgggctgataggacaccagttaagtagaaacaggagtatggaagagtgtgaacgttgagcttggggatcaaaaatttgaggatatgtaagaaattaataggagaatcaaataataaacttgatttcctccagctctccctaattgtagttacataaagttacaacttgactaaaactacaaggaagatg

SEQ ID NO: 117789 - DNA, 601 bp, Human
tgtgagcccaaatagtgtctattttgatacctgaaaatcactggccaccttgctgatgggcaactcccttcatcactggtttaactctcttgtgccatagggtatctagaagcaaaatatgtttgttaagtgtaaagctgtctctgcttaaaaacaagtccccctaccaccaccaccacacacacacacacacacacacacacacacacacacacagaaattgcctgttcctgggctgataggacaccagttaagtagaaacaggagtatggaagagtgtgaacgttgagcttggggatcaaaaatttgaggatatgtaagaaattaataggagaatcaaataataaacttgatttcctccagctctccctaattgtagttacataaagttacaacttgactaaaactacaaggaagatgttgacatgctcttcctccatttaagaagccataatgataaaactctaagaacaagaaaggtttgtggagcatttatggaacaaatttttgctgcctaggtaaaatttattctaaaggccttaatctggtcattattccccttttctctagactataatgtaactgcaaactccaagctggt

SEQ ID NO: 117790 - DNA, 601 bp, Human
gccaccgtgcctggtgattcatttatttttcatgtttcatttcccttctaaggagatttgtgtgtgtgtgttttttgttttttaataattttaaaacattaaagggaatacaatgcctttaaatgtagttggagcttaaaattacctgcccaagatcttggataagggataagtttgtgaataattgttattctctttttttttttttttttttttgagacagtctcactttgtagctcaggctggagtgcagtggttcgatcttggctcactgcaacctctgcctcctgggttcaagcarttctcctgcctcagcctcccaagagctgggattacaggcacgtgccaccatgctcggctaatttttgaagttttagtagaaaggggtttcaccatgttgcccaggctggtctcaaattcctgagctcaggtgatccatctgcctcagcctcccaaagtattaggattacaggcgtgagccaccgtgcccgggcccataattgtctcttagttgataaacagtttattttcataaaactgttactatactttttttttgagagcatgtctcactctgtcgcccaagctggagggcaatggg

SEQ ID NO: 117791 - DNA, 601 bp, Human
ctcaaattcctgagctcaggtgatccatctgcctcagcctcccaaagtattaggattacaggcgtgagccaccgtgcccgggcccataattgtctcttagttgataaacagtttattttcataaaactgttactatactttttttttgagagcatgtctcactctgtcgcccaagctggagggcaatgggatgatcatggcagctttgacctactaggctcaggtgatccttcttcctcagcctcttaagtagctaggactacaggcgtgcaccaatatgcctggctagtttgttaaaagtttttttgtagagatggggttttgctatgttgcccaggctggtcttgaactgctggcctcaggcagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcata

SEQ ID NO: 117792 - DNA, 601 bp, Human
gttgataaacagtttattttcataaaactgttactatactttttttttgagagcatgtctcactctgtcgcccaagctggagggcaatgggatgatcatggcagctttgacctactaggctcaggtgatccttcttcctcagcctcttaagtagctaggactacaggcgtgcaccaatatgcctggctagtttgttaaaagtttttttgtagagatggggttttgctatgttgcccaggctggtcttgaactgctggcctcaggcagtcctcccacctcagcctcccaaagtgttgggatwacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagata

SEQ ID NO: 117793 - DNA, 601 bp, Human
tttgacctactaggctcaggtgatccttcttcctcagcctcttaagtagctaggactacaggcgtgcaccaatatgcctggctagtttgttaaaagtttttttgtagagatggggttttgctatgttgcccaggctggtcttgaactgctggcctcaggcagtcctcccacctcagcctcccaaagtgttgggataacaggtgtgagttgtcatgcccagccaaaactactttttgaataattaatggacttgatatacatagtgtagaggcttaaaaatattaacaaaattattggttasccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagcggttgcaatctggattcagcccgattccgttacctaatgggggaaaggctgggagttcacccattaagctgt

SEQ ID NO: 117794 - DNA, 601 bp, Human
actttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagyggttgcaatctggattcagcccgattccgttacctaatgggggaaaggctgggagttcacccattaagctgtcatgggtgggtccttggggaacatggagattccagtggtaagcataagttattttctttttgtttttgaaaagattatataaaaagtcgatgggcattatattattcaattagagcctaatcaaatatccattcagtaggatggaatggtttcccgaaatctagcattttgtataattatatgttaagaattgttaagattgttgccattttatatggcattttatgg

SEQ ID NO: 117795 - DNA, 601 bp, Human
gtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagcggttgcaatctggattcagcccgattccgttacctratgggggaaaggctgggagttcacccattaagctgtcatgggtgggtccttggggaacatggagattccagtggtaagcataagttattttctttttgtttttgaaaagattatataaaaagtcgatgggcattatattattcaattagagcctaatcaaatatccattcagtaggatggaatggtttcccgaaatctagcattttgtataattatatgttaagaattgttaagattgttgccattttatatggcattttatggcgagggggacgggaaatgaaatttctcttcttacca

SEQ ID NO: 117796 - DNA, 601 bp, Human
cctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtggtaagcataagttattttctttttgttttwgaaaagattatataaaaagtcgatgggcattatattattcaattagagcctaatcaaatatccattcagtaggatggaatggtttcccgaaatctagcattttgtataattatatgttaagaattgttaagattgttgccattttatatggcattttatggcgagggggacgggaaatgaaatttctcttcttaccatggatatcttaagactgtagttcttaggatgtcttcagtcatttaatatcacagctgtttatacctgacttgtactgcctggccctgaaaagatgagcaaatc

SEQ ID NO: 117797 - DNA, 601 bp, Human
taagattgttgccattttatatggcattttatggcgagggggacgggaaatgaaatttctcttcttaccatggatatcttaagactgtagttcttaggatgtcttcagtcatttaatatcacagctgtttatacctgacttgtactgcctggccctgaaaagatgagcaaatccaaatgcacaaaagttatattatcacagttgaaaaatgttatgattaggttctgtatgctaagaaaaccccccttatgttctcatactatctttatatttcaaatatacatgggttaaacatttcaaytggctagagaaacaggttagaatacagttaaaattcttagttttacataatgtaagtaaatgaaaatctaatctaaaagtgagtaatgactacattagtagtcttgaccatctaccaaaattgagtattcttcctccgaagataagagaattaggaaaatgaatcacaattactaatctgttggtacatgaaaataaatgtagtctgtactatttcttttagtgcctgtatggagtggaatgaatgttgctggtgtctctctgaagactctgcacccagatttagggactgataaagata

SEQ ID NO: 117798 - DNA, 601 bp, Human
aaaaaaaaagaatcataatctttagttcataacatattcttgtgattggtcaagcaaggccctcttgtttgtatttgtttaattaaataaaacctgtgaacccaccacccagctcaagaaagaaacacaatatctgtcaaataacattgttgaatcagaatttagtattctgctggtgtttggaaataagtggattctgtgctctttcccccagctatccctctgtccccctcacgctcccacttgagataatcctgagttaaggatgctatgttatcttggatttctttttaaaattcawtattatatttttaagaattatccaattttttttacaagtagctatagtttattttttgatagctgtgtaatattccattgtatcagtataccatgatttatccattcttctgttggaggacattggaaagattgtcatgtttttgctgttactaacagtactgttaatgaatatccctgtacataatatcctagcatacatgtgtgcaagggttattcttggtataatgcaacattgtggcattatttactgtaaaatgtgtattaatgaaaactttgtttttctttctttctcccaccc

SEQ ID NO: 117799 - DNA, 601 bp, Human
ataacattgttgaatcagaatttagtattctgctggtgtttggaaataagtggattctgtgctctttcccccagctatccctctgtccccctcacgctcccacttgagataatcctgagttaaggatgctatgttatcttggatttctttttaaaattcaatattatatttttaagaattatccaattttttttacaagtagctatagtttattttttgatagctgtgtaatattccattgtatcagtataccatgatttatccattcttctgttggaggacattggaaagattgtcatgkttttgctgttactaacagtactgttaatgaatatccctgtacataatatcctagcatacatgtgtgcaagggttattcttggtataatgcaacattgtggcattatttactgtaaaatgtgtattaatgaaaactttgtttttctttctttctcccaccctgctttttctgcctttacctatggtttcctatcatacagtgcttatgaggtgatcaaactcaaaggctacacatcctgggctattggactctctgtagcagatttggcagagagtataatgaagaatcttaggcgggtgc

SEQ ID NO: 117800 - DNA, 601 bp, Human
caaaggctacacatcctgggctattggactctctgtagcagatttggcagagagtataatgaagaatcttaggcgggtgcacccagtttccaccatgattaaggtaggtctatgtagtgatacgctgcatttgaatgctttttgctggctttttaaaaaagattcttctgagaaagattaatacaagtcttccattactgacttaagtgaaataaattaatgtacccacagcttaccttttttgaaagaaatggttgagctttaggattaatgtccattaggcctgttcaacacatagatrcttgataatttgactacaaaaaagtcttgttcaattatgctgaggtaggtggaagactataaaagaaataaactatttctccattggggaaaatagaaattatattcaagttagcattatgttactatttttaatgactttcttttatactattaattaaatcataactgaacacctggaaaggaatttctacttatcaaagttttttatttttttgagacagtctccctctgtcacccaggctgcagtgcagtggccgatctcggctcaccgcaacctctgcctcccaggtttaagcga

SEQ ID NO: 117801 - DNA, 601 bp, Human; identical to SEQ ID NO: 117790

SEQ ID NO: 117802 - DNA, 601 bp, Human; identical to SEQ ID NO: 117791

SEQ ID NO: 117803 - DNA, 601 bp, Human; identical to SEQ ID NO: 117792

SEQ ID NO: 117804 - DNA, 601 bp, Human; identical to SEQ ID NO: 117793

SEQ ID NO: 117805 - DNA, 601 bp, Human; identical to SEQ ID NO: 117794

SEQ ID NO: 117806 - DNA, 601 bp, Human; identical to SEQ ID NO: 117795

SEQ ID NO: 117807 - DNA, 601 bp, Human; identical to SEQ ID NO: 117796

SEQ ID NO: 117808 - DNA, 601 bp, Human; identical to SEQ ID NO: 117797

SEQ ID NO: 117809 - DNA, 601 bp, Human; identical to SEQ ID NO: 117798

SEQ ID NO: 117810 - DNA, 601 bp, Human; identical to SEQ ID NO: 117799

SEQ ID NO: 117811 - DNA, 601 bp, Human; identical to SEQ ID NO: 117800

SEQ ID NO: 117812 - DNA, 601 bp, Human
gccccaccaccccacttaacttctatcctagaggccactccttggaacacagtttgaaaaccactgaactggacttaggtaattaagccaaagttgccaaccttaagattttttaaaagacaaaaccagagcagttgagatggagaggtcacaaccgcagggaaggtaacctctagtagcaggccttggacttagagaaggactaaactctggagagaactttgtacctgttagcaggcttaagtccctcattcagaaaggagaaaaaagagatggtctgctatcctcactcagccgacatttttttttttttttgagacggagttttgctcttgttgcccaggctggagtgcaatggcgcgatctctgctcactgcaacctccatctaccgggttcaagggcttctcctgcctcagcctccccagcggctgggatcacaggcgcacgccaccatgcctggctaatttttgtatttttggtagagacggggtttcaccatgttgaccaggccattcagccgacttgtagcagtgcaacagattggtaagtttgagtctctcttaggtgatataaaatacacattgcagtacaaatgtgaaa

SEQ ID NO: 117813 - DNA, 601 bp, Human
taacttctatcctagaggccactccttggaacacagtttgaaaaccactgaactggacttaggtaattaagccaaagttgccaaccttaagattttttaaaagacaaaaccagagcagttgagatggagaggtcacaaccgcagggaaggtaacctctagtagcaggccttggacttagagaaggactaaactctggagagaactttgtacctgttagcaggcttaagtccctcattcagaaaggagaaaaaagagatggtctgctatcctcactcagccgacatttttttttttttttgrgacggagttttgctcttgttgcccaggctggagtgcaatggcgcgatctctgctcactgcaacctccatctaccgggttcaagggcttctcctgcctcagcctccccagcggctgggatcacaggcgcacgccaccatgcctggctaatttttgtatttttggtagagacggggtttcaccatgttgaccaggccattcagccgacttgtagcagtgcaacagattggtaagtttgagtctctcttaggtgatataaaatacacattgcagtacaaatgtgaaaaaaaatcaaagcaaat

SEQ ID NO: 117814 - DNA, 601 bp, Human
atgttcggtaatttatctcagatttattttttaaatttccccataaatgaattttgatataaatggttttatatgttatatataagaggttatggctgggcgtggtggctcacgcctgtaatcccagcactttgggaggctgaggcaggcagatcacccgaggtcaggagtttgagaccagcctggccaacatggcgaaaccccatctctaccaaatgtagaaaaattagcgaggtgtggtggtgcgtgcctgtaatcccacctatttgggaggctgaggcaagggaatcgcttgaatccsggaggtggaggttgcagtaagccgaaatgaggccactgcactccagcctgggtgacagaacaagactccttctcaaaaaaaaaaaaggttatgtttttcccagttgctgtagtcagttctgtctcatgatgtattctccactttgcagtttctgtcttcatgcatttttttaccttctcaactcataaaggtctttgtattattttccaatactaacactttatttgtgcctgtaagtccagttaattggagacttgctctatcagctgtccttgctcactgcttttcttccaactgctg

SEQ ID NO: 117815 - DNA, 601 bp, Human
cttccaactgctgacatacttaaaattatcctacttaagtaggataatgaagtatcaacatacttaaaattatttgccaacttccccgtcagatcctcccctcatctttcttagattttaattcatttttcttaaaacatatgtttcctaatttgtatggtttgcagtccagtttcatattctacagagtgggctttttaaaatatgttctctaactcccaacctcaagtgatccacctgcctcaaaacctcatctctactaaaaaaaaaatagaaaaattagctgggcgtggtggcagaygcctataatcccagctacttgggaggttctggcagaagaattgcatagttatatgtttattgtaaagaatactagaaaatgaatgttaaaataaactattgaaaatagaaaacactgttttcaaattctcacactagcacccctaacactttcctgggttacctttataaacatttggtttgatagagaagaaactcttgggaagacttttttttttaataactgctctagtataaaatacataattattatagatcagaaaagagaacatttaaatcatctgtatttttatcacccata

SEQ ID NO: 117816 - DNA, 601 bp, Human
ttccccgtcagatcctcccctcatctttcttagattttaattcatttttcttaaaacatatgtttcctaatttgtatggtttgcagtccagtttcatattctacagagtgggctttttaaaatatgttctctaactcccaacctcaagtgatccacctgcctcaaaacctcatctctactaaaaaaaaaatagaaaaattagctgggcgtggtggcagatgcctataatcccagctacttgggaggttctggcagaagaattgcatagttatatgtttattgtaaagaatactagaaaatkaatgttaaaataaactattgaaaatagaaaacactgttttcaaattctcacactagcacccctaacactttcctgggttacctttataaacatttggtttgatagagaagaaactcttgggaagacttttttttttaataactgctctagtataaaatacataattattatagatcagaaaagagaacatttaaatcatctgtatttttatcacccatagataatcattattaaatttggtatctatcccttcattcgcatatattttcagagtaacatagtgaaatttcaaagacagac

SEQ ID NO: 117817 - DNA, 601 bp, Human
ttttaaatttaagaatatggggcaggccgggtgtagtggctcacgcctgtaatcgcagcactttgggagactgaggcgggggatcactaggtcagttcgagagcagcctgataacatggtgaaaccccatctctactaaacatacaaaaattagccagccatggtggcatgtgcctctaacccctagttactgaggaggctgaggcaggagaatcacttgaactggggaggcggaggttgcagtaagccaagatcgggccactgcactccagcctgggtgacagagggagactccatctcaaaaaaaaaaaaaaaaaagaatatggggccaggcactgtggctaacgcctgtaatcccagcactttgggaggccgaggcaggtggatcacctgaggtcaggagtacaagaccagcttggccaacatggcgaaaccccgtctctactaaaaaatacaaaaattagccgggcgtggtggcaggaacctgtaatcccagctacttggggggctgaggcagggagagtttcctggaactgggaggaggaggttgcagtgagccaagatcacgccactgcactccagcctgggtgacagagcaaga

SEQ ID NO: 117818 - DNA, 601 bp, Human
aaaaaaaagaatatggggccaggcactgtggctaacgcctgtaatcccagcactttgggaggccgaggcaggtggatcacctgaggtcaggagtacaagaccagcttggccaacatggcgaaaccccgtctctactaaaaaatacaaaaattagccgggcgtggtggcaggaacctgtaatcccagctacttggggggctgaggcagggagagtttcctggaactgggaggaggaggttgcagtgagccaagatcacgccactgcactccagcctgggtgacagagcaagactccatctcaaaaaaaaaaaaaaaaattttatggaatcatgccaggcatggtggctcacacctgtaatcccagcactttgggaggctgaggcgggcggatcacttgcgtccaggagttcaagaccagcctggctaacacggcgaaactccatctctactaaaaatacaaaaaattagccaggcatggtggcacatgcctgtagtcccggctactctggaggctgaggcaggagaatcgcttgaacccgggaggcggaggttgcagtgagccgagatcgcgccaccgcactcctgcctgggtgacagtgag

SEQ ID NO: 117819 - DNA, 601 bp, Human
ttctcagtggtgagtaaaaatcacaaaataatggacttgaatgtattttatgattacatttgtaaggtgggtacagataaggtaagcacaattaaaaatgaggaaaattgatgttagggttgtgacatggaattttttaaatccctttttaattaaaagcagtcatctaatcgggctttattccagcgtttgcaaatgcctacataatgcagactatctccacctgcatgactcagcagtacctcacattcatcatgtccggaactgaattccttatcttcactttcaaatctgctcttcsttctcattaatttctgaaaatggtaccactgtgctcatgtcagtaaggctcagaaatggggtatgggcaagcaaccatgacgcttccttcagcactttaacaatgtctgttcattctgctgcttcagtggtcctccttgtcccttcctctccagtctctcctgctgctcacagattaatttctaaaatacaaatcactcccctattcaaaagtcttcagaagttttctgttgtttgccacatggggtggccttctccactatatgcctccatcttaaccatccaacctcatatcctactg

SEQ ID NO: 117820 - DNA, 601 bp, Human
attatgttcaaatagaagttctcaattattttggagaactaatggcagatccagtatttcattgttcccattttatttgtttagagacacaggtctcactcagtcacccaggttggagtacggtgtggtgattatagctcactgccgcctcaaactcctgggctcaagcaattctccccctttggcctcccaaagtaattagacctattttttgtacagacggggtctcactttgttgacaaggctgatctcaaactcttgggctcaagtgatacctcctgccttggcctcccaaattgcggggggttacaggtgtaagccacatcacttggcctgttttcattagttttaaccctcagaaaaatgttgcggtaaagcttcacttatttgcccagggcaaacgtaattgttaaattatattttggccattcctctggggatgaaaactaaagtcataacttcaccagaaatggcatatatgtggcattggtgccacaactttccccatcctggcccatggcagacagcaccatcagtcagcagtttttctcactgagtccagacagccacactcaagcctggaggatttgggttgggcatt

SEQ ID NO: 117821 - DNA, 601 bp, Human
ttttttcttcatcttttttttctctcttagcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgtaagtcagctatactaagttctgatgtatttgtatgtcatagttgctagtaattttgtaaagagattatataaatctttattttatatcaaaaaatcaacyatgtagaaataattacaaaatggggtcactgaatatatactgttttataacctgaccttttcacttaataacagaacaggtacaggtttacatataatatgtaaatctacctgacatatagatctccacacactttaagagttgcataatactccactaaatgaatatacaatcatgtatttaaccagccctctgtggttggacacttaggaagtttccagaatttttttattgcagtgtttgcactaatatcatttcaaggttgtatgtgtaggatacatttctgcaaagaatttcctg

SEQ ID NO: 117822 - DNA, 601 bp, Human
acctcatggcagaaagaattgcttgggcacctgaaggcaaagatagatttacaatcagccatatgtatgcagatattaaatgtaagtcagctatactaagttctgatgtatttgtatgtcatagttgctagtaattttgtaaagagattatataaatctttattttatatcaaaaaatcaactatgtagaaataattacaaaatggggtcactgaatatatactgttttataacctgaccttttcacttaataacagaacaggtacaggtttacatataatatgtaaatctacctgacatrtagatctccacacactttaagagttgcataatactccactaaatgaatatacaatcatgtatttaaccagccctctgtggttggacacttaggaagtttccagaatttttttattgcagtgtttgcactaatatcatttcaaggttgtatgtgtaggatacatttctgcaaagaatttcctgtttaatagttgatgtgtttttttgtgttattgttggtagggacagagtcttgctgtgttgcccaggccggtctcaaactcctggcctcaagcaacactcctgcctcatcctctcaaag

SEQ ID NO: 117823 - DNA, 601 bp, Human
gtatttgtatgtcatagttgctagtaattttgtaaagagattatataaatctttattttatatcaaaaaatcaactatgtagaaataattacaaaatggggtcactgaatatatactgttttataacctgaccttttcacttaataacagaacaggtacaggtttacatataatatgtaaatctacctgacatatagatctccacacactttaagagttgcataatactccactaaatgaatatacaatcatgtatttaaccagccctctgtggttggacacttaggaagtttccagaatktttttattgcagtgtttgcactaatatcatttcaaggttgtatgtgtaggatacatttctgcaaagaatttcctgtttaatagttgatgtgtttttttgtgttattgttggtagggacagagtcttgctgtgttgcccaggccggtctcaaactcctggcctcaagcaacactcctgcctcatcctctcaaagttctgggattatgttataggcatgcaccaccatgcttggccaggtttatgcatttaaaatgctgatagatgatgccagattttccttcactaaaattgtaccagtta

SEQ ID NO: 117824 - DNA, 601 bp, Human
cactttaagagttgcataatactccactaaatgaatatacaatcatgtatttaaccagccctctgtggttggacacttaggaagtttccagaatttttttattgcagtgtttgcactaatatcatttcaaggttgtatgtgtaggatacatttctgcaaagaatttcctgtttaatagttgatgtgtttttttgtgttattgttggtagggacagagtcttgctgtgttgcccaggccggtctcaaactcctggcctcaagcaacactcctgcctcatcctctcaaagttctgggattatrttataggcatgcaccaccatgcttggccaggtttatgcatttaaaatgctgatagatgatgccagattttccttcactaaaattgtaccagttaggcaagttgtctgatctttgcttatgtggccatcttctgttgagaagactcaaccttatagtgaatgtaggtggtggaatctctttttataaatttcaggcatgggctaggtgcaatggctcacacctgtaatcccagaagtttgagaggccaaggcgagtggatcacctgagatcagaagtttgagaccagcctgctcaacatgg

SEQ ID NO: 117825 - DNA, 601 bp, Human
tgggattatgttataggcatgcaccaccatgcttggccaggtttatgcatttaaaatgctgatagatgatgccagattttccttcactaaaattgtaccagttaggcaagttgtctgatctttgcttatgtggccatcttctgttgagaagactcaaccttatagtgaatgtaggtggtggaatctctttttataaatttcaggcatgggctaggtgcaatggctcacacctgtaatcccagaagtttgagaggccaaggcgagtggatcacctgagatcagaagtttgagaccagcctgstcaacatggtggaaccccatttctactaaaaatacaaaaattaagggccgggcgcggtggctcacgcctgtaatcccagcactttgggaggccgaggtgggcggatcacaaggtcaggagatcgagaccatcctggctaacacaatgaaaccccatctctactaaacatacaaaaaaattctctgggcatggtggcgggcgcctgtagtcccagctcctcgggagcctgaggcaggagaatggcgtgaactcaagaggcggagcttgcagtgagccaagatcgcgccactgcactccagt

SEQ ID NO: 117826 - DNA, 601 bp, Human
tgcatacccaaaactagatttgcaccagaacagtttcaagttgaatatttgaaggaatgcccacatctgaaagaagcaattgaaattgatttagttcttatcatagctgacaaagttacagaaaattttaaagaatgatacagtgaaaacctacgtaatatgccccacctagatattagttattattttgccatatttgctttattatttgtgtgtgcacttttattgcttgtaataccattatcacactgaaaacattttaataaaaaatagccattgttacatttccattggttgtctyagtaatgtttatagttgtggtttttggtttatttttttatttttttattttaaaaaaaacggtatccaatctaggttcctgtagttgtcatttctttagtccctttcagggtatagccttgtcaaatatcaaacattctgaatatttctgattgtctcctcaaggttttaatttattcctgtatacctgtattttttataagctaaaagtcagatctaaaggcttgaatatattcagcttaaacattttgtgcaagagtaataacatacatagtgacattcacttcctgttccatcacct

SEQ ID NO: 117827 - DNA, 601 bp, Human
aaagaaatgccatgggccgcattttgcagtcttttggatcatgataggtcattttttattaatgataatgttgatttggggcagtttgtttaaaatacattcaggaagctttaaagaggtctgccctgccctagttgaatggtaacaaaagcccattaatatctggaggtagtagcagtgggtgagaagtgctgcatgacaagagtaccaaagaaggaagcagagtgttagtgagtttgatgagcatgctctggttgtatgggatcatttaagaagagtgcattctacaaaagcatcagtrttggaatagggcagttaaagcccaaaggaatcctgaatcatcttgggagaagtaacttactgtatggttattcccacagtgtgagtgtcatcatctaactgccctcatgcttctttttaggccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactgg

SEQ ID NO: 117828 - DNA, 601 bp, Human
taaaatacattcaggaagctttaaagaggtctgccctgccctagttgaatggtaacaaaagcccattaatatctggaggtagtagcagtgggtgagaagtgctgcatgacaagagtaccaaagaaggaagcagagtgttagtgagtttgatgagcatgctctggttgtatgggatcatttaagaagagtgcattctacaaaagcatcagtattggaatagggcagttaaagcccaaaggaatcctgaatcatcttgggagaagtaacttactgtatggttattcccacagtgtgagtgtcrtcatctaactgccctcatgcttctttttaggccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacaggtgggaggaaaagaatagccttttgaaagagatactgggttctctatagtctcctagtatgctaatagcttgttagc

SEQ ID NO: 117829 - DNA, 601 bp, Human
ttcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacaggtgggaggaaaagaatagccttttgaaagagatactgggttctctatagtctcctagtatgctaatagcttgttagctatccccacgttttttcggttttggttttggttttttgttgttgtcgtttttgtttttgttttgtttgtttgtttgttttggtggtggtggttttttgtttgtttgtttttggatttttttgagacggagtttcgctctgtcgcctaggctggagtgcagtggcacaatcttggctcgctgcaacctccacctcccaggttcaagcaattctcctgtctcagcctcccgagtagctgggactacaggcatgtgccaccatgcccggctaatttttgtaattttaatagagacagggtttcaccatgttggtcaggctggtctcgaacttcctgaccgccagtgatccacccacctcagcctccc

SEQ ID NO: 117830 - DNA, 601 bp, Human
ccttctagatttctgaagaaaataaaaattcaaaccccaatatgtgtcttaagaccattattccttttgtaaaacttagcatttccttaaaggaaagtaatggaaaattgagtatccatggtattcttcactattattgaactattattattatgtttgtttgtttgtttgtttttaaaagacagggtctcactctgtcacccagactggagtgcagtggcacagtgatagctccctgcagcctcaaactcctgggcttaagcgatcctcctgcttcagcctctcaagtagctgggactaraggtgtgcaccaccttgcctggctaaattttcttatttttatagggcggggggcagctctttttgtatttcccaggctggtctcaaatccctggcctcaagagttcctcccatcttagcctcccaaagctctgggattacaagtatgagctatcacactcagccctcttccaaaatgtttttaaaatacatataattttttttaaatttatatttctttttaccagttatgttttcttggcctttggacttgaccctagcatgctggtagtcaaatggaatttgaaaatgactctttcag

SEQ ID NO: 117831 - DNA, 601 bp, Human
gttacttgaagtgatttatcggaagtgctttgaaatagcgttgtttgccattaaaattgcctagaagaaatgaaattcctgtgtgagttgctaaaaccttttaaaaataaatttctagctccctcatccgcagttctctagtaataataaaggcttaatgtgatgagttcagctttatgctctagctaacatttaatctaaagaaatatggataaattaataaataaggaagataacaaacatttgttgattgcttactatctgccaaaccttaagcactctcatgacccttataccatgmcaaccccaatgtttcagcaagtaggccatcatgtatgacctacctacctcagcatcatgaccccagacctacagatttatctacttgcagagaaagagatggttcctgttgtgatcaaggataattttatcactgcctctgtcttctaggccagaacttgtcttcctcagttattccctttactctgagttttcattttcttgctcttatttttcttctttttctgtctctttttttttttttttttttttttgagaaagagtttcactctgttgcccaggctggagtgcagtggcgcaa

SEQ ID NO: 117832 - DNA, 601 bp, Human
ttactctgagttttcattttcttgctcttatttttcttctttttctgtctctttttttttttttttttttttttgagaaagagtttcactctgttgcccaggctggagtgcagtggcgcaatcttggctcactgcaacctctgcctcccaagttaaagccattctcctgcctcagcctcccaagtagctggaattacaggcacgtgccaccacacccagttaatttttgtatttttagtagagacagggttttgccacgttggccaggctggtctcaaactccttacctcaggtgatctgyccaccttggcctcccaaagtgctgggattacagtcatgagccaccacgcccagccagtgtattttcaatttatactttgatcatacagtgagtttttcaggacatcaccctttcagaagtgaagaagaatctatacaaacatggccctctttaattatcctgagaaaataaagcttagtggcgcttagacttacaacttagtatgaaaggaagacttttttagtgctttttttttctttaaaataaacatgatggcatattgtacatgtacatttgtaactttatcttctgtttagtatc

SEQ ID NO: 117833 - DNA, 601 bp, Human
caaagtgcagggattacagatgtgagccactgtgcccggcccaagcccagtttttttgtttttgtttttgttttccttagtgaggctaatagtacttgccttataggatttctatgagttaaaagagcctagtgcgtaataagtagtaggtaataggcattattgttgttatctgtatttttagatgcctgcatagtattccattggtatgggtatatcaacatttatataaccaatctttttactacaaatattggttgatgccatttttcatttggtgttccttctttccttctcaatyttctggttatagtaactatcacaggctatgatctatggcctcctgaatgcattctctctattccattgctttactagatatggggaacaggggagggagtaaaaataaaaataaaaacattcttgttacataatgatgaatcctgaataaccatagtctgtctttgactgcagagctctagctgcctacttgacatctcctctcaggtatttcaaagacatctcaacttcacatgtaaaatggaatctttgattcccatcctcataaacgtatctccatgggtattccctctcttagtaa

SEQ ID NO: 117834 - DNA, 601 bp, Human
taatagtacttgccttataggatttctatgagttaaaagagcctagtgcgtaataagtagtaggtaataggcattattgttgttatctgtatttttagatgcctgcatagtattccattggtatgggtatatcaacatttatataaccaatctttttactacaaatattggttgatgccatttttcatttggtgttccttctttccttctcaatcttctggttatagtaactatcacaggctatgatctatggcctcctgaatgcattctctctattccattgctttactagatatggggwacaggggagggagtaaaaataaaaataaaaacattcttgttacataatgatgaatcctgaataaccatagtctgtctttgactgcagagctctagctgcctacttgacatctcctctcaggtatttcaaagacatctcaacttcacatgtaaaatggaatctttgattcccatcctcataaacgtatctccatgggtattccctctcttagtaaaaagcattacaatttgctcaagccaaaaacctgggagtcggcgagtctccttgattcttcctcttcttttttatgacgggctcact

SEQ ID NO: 117835 - DNA, 601 bp, Human
tccctatatttcccaggctggtctgaactcctgggctcaagctatttttccacctcggcctcctaaagtgctgagattacaggcgtgaaccattgcagccagccatgttttcctcctgttatgtccagcattcagtgtatcaacaagcctcgtacaatacacctctcatctgtgggatctacacaaacgcttacaccctttcatgtttacggtatcatcatctttggcctgtttgcttgccttagccttctaacctttatttttgctatcttgtcttttatagtttattctcccctagcartaataattataatataggccgggcgtggtggctcgtgcctgtgatcgagcactttgggacgccaaggtgggtggatcacctgaggtcaggagtttgagaccagcctggccaacatggtgaaaccccatctccactaaaaatacaaaaattagccgggcctggcggcacatgcctgtaattccagctacccaggaggctgaggcaggagagtcgctggaaccggggaggcagaggctgcagtgagctaagattgcaccactgcactcctgcctgagtgacagagtgagactgtctcaaaaa

SEQ ID NO: 117836 - DNA, 601 bp, Human
aaaaaggattataatataaatcagatcctaataatcccctatgtgaatctcttcattatcttctcattgagcttagaataaaatcaaaactcctacaagactgctagatttggctcctgcatacttctcagttggggccacttctactcattcatgctttagacataatgaccattcacttccatgccacgctttttctacctcagggcctatgcacttaactgatcttctacctgcttgttccctaaccagcttctgcctatctttagatacctgttctaatgtcatttctcgccaggtrgggtggctcatgcctttaatcctagcactttgggaggctgaggtgggaggatcgtttgagtccattgtgagaccacatctctaaactttttttttttttaatttaaaaattagctgggcatagtggtatacacttgcagtcccagctactcgggaggctaaggtaggaggatcacttgagcccaggaggtcaaggctgcagtgaactgcgattgcaccactgcactccagcctgggcaacagagcgagaacctgtctcaaaaaaaaataaaaatataaatttaaaaattaaaaattaaaa

SEQ ID NO: 117837 - DNA, 557 bp, Human
ctcttctccagtaggattgattagtaattctctccagcccagcttcccactaactagtatttaagctcctatggcatggggtcttaatcaattttgtatctacatggtctagcaagtagcgtgcactcaatacatgttttaaaatataatctcattttattctcttttatcctactttatagagcttggaaaagtttatcttgcctagattaacgttagaaaaagaatttgactctttatctttctgaatccatagtcagtgtttttctcactatattctattctttttatttactttttyttttttttttttttttttgagacagtctcactctgtcacccaggctggagtgcagtggtgcaatctcagctcactgccacctctgcctcctgggttcaagtgattctcctgcctcactcagcctccccaacagctgggattacaggtgtgtgccaccatacctggctaatttttgtatttttgatagagatgaggtttcaccatgttggccgggctagttttgaactcctgacctcaggtgactcgcccaccttgg

SEQ ID NO: 117838 - DNA, 601 bp, Human
ttgtgtgaatttttacaatacagatgcttctcgacttaaatggggctacatcccaataaactcataagttgcaaatactgtaaatcaaaaatgcattgaatacacctaatgtatggaacaccatagtttagcctatcctactttaaatgtgttccgaacacttagattagcctgtagttgggcagcattacctactataaagtgtattttctaataaaatgttgaatatctcatgtaactcattgaatactgaaagtgaaaaacaatgtatgggtactcaaaatatggtttctctactgamtgtgaatcactttgacaccatcataaagttgaaaaattccaagtcaaaccattgtaagtcaggggctatcagtattcagtggtaaatgctggctctaactattcttccaagtcagtggttgactgctgtttattctataaagggttacaatttatagattctctcacttgtagaatgagagattcagaattaatagcagacagagtccctaccttgatggagctttcatttaagtgtgaaagtcaggtgacctaacaaggccttggcataagtttaggatttggattgttatgggagctt

SEQ ID NO: 117839 - DNA, 601 bp, Human
ctgtttattctataaagggttacaatttatagattctctcacttgtagaatgagagattcagaattaatagcagacagagtccctaccttgatggagctttcatttaagtgtgaaagtcaggtgacctaacaaggccttggcataagtttaggatttggattgttatgggagcttgggtagggacatgtcataggtaaggcaacagcaggggtagagataagcttgacatatgtcaaaaatcatgaagacatcagtaatccttgaagttggctgaaaggtatagagttgagaaagtagttaaaaaaaaaaagtcaggctgagtctaggtaaggatgtgtttctctgaggtcagatttgttcctgtaccataaagggactatttagaatcttaaagctggagcaatttaaaacgttaagttttcagattgaggtcagatttgtgacttcatgtgaggtcagatttgttcctgtaccataaagggactatttagaatcttaaagctggagcaatttaaaacgttaagttttcagattgacgttttttgaggtatagttaataacctgaatgttctgattctagtcttggtagtcaataagagt

SEQ ID NO: 117840 - DNA, 601 bp, Human
aaaaatcaagaggtagcaagaaaaggtgtttggcatattcaagaggcatctgaagataagatgataatgaaaaaaaataagttgatgaattttgtgatttttacttccatatacttttattgggaaaatctcccaggtttccaaattctgtctggacattattctctgaatattctgcatgactcaggcttaaaatatgtaaaacagctcatcattgttctttgtttctcttcgtacttcagttgatcagcaatttgtcagttctgccttcaataatacttcttgattctatcacccttayttaggcaaacctgattgattttccataatgctactgcaagttgtctttctaaaatcacttattttggccgggcacagtggctcacgcctgtaatcccaatactttgggaggccgaggtgggtggatcacgtgaggtcagaagttcgagaccagcctgaccaacatggtgaaacccgtctgtactaaaaatttaaaaattaactgggcgtggtggcacacacctgtaatcccagctactcaagacgctgaggcaggagaatcacttgaacctggaaggcagaggttacagtgagctgacac

SEQ ID NO: 117841 - DNA, 601 bp, Human
acttattttggccgggcacagtggctcacgcctgtaatcccaatactttgggaggccgaggtgggtggatcacgtgaggtcagaagttcgagaccagcctgaccaacatggtgaaacccgtctgtactaaaaatttaaaaattaactgggcgtggtggcacacacctgtaatcccagctactcaagacgctgaggcaggagaatcacttgaacctggaaggcagaggttacagtgagctgacaccgcgccattgcactccagcctgggcgacaagagcgaagctccatctcaaatagatarataaatatttaaatatttaaaaataaaaacatgtattttatcactgcggcttgaaaaccttcactgcctcccttcactgcagtagtctgagtgcctttgtctggcctgcaaaactctttatagtctggccccagcccactactcgagtctcatcttcagcgatagtctccgctactcccttccacacatggccaagggttccagcctaacacactaagctgtccagaatcttttgatcacattatctccttcatgcttcctgtgcttcggcttatgctctttctctttagaattccctta

SEQ ID NO: 117842 - DNA, 601 bp, Human
gtagtctgagtgcctttgtctggcctgcaaaactctttatagtctggccccagcccactactcgagtctcatcttcagcgatagtctccgctactcccttccacacatggccaagggttccagcctaacacactaagctgtccagaatcttttgatcacattatctccttcatgcttcctgtgcttcggcttatgctctttctctttagaattcccttagccctgtttctcccccaaggaactaataattactcaagactcagctccagtttcattgcctctggaaagtaatccttaactwgtgcaaagaagaatttgttttttccttttctccgtttttatgagcactgaggcactgagtgtatacctatattacgttatttatcacacatcaagacttacttttttactttttattttgaaatctcagattttacagaaagtgacagaaaaatatgttttccaacccattttgagagaaggttacaggcataatttccctttacccctaaatatttcgatgtatattttcaaaaaactaagacattctcttaaataacagtacaattatagaattagtaagttaacattgatgatgtgt

SEQ ID NO: 117843 - DNA, 601 bp, Human
gtttttgtttttgagatggggtctcactctgtcacccaggctgaagtgcagtggcatgatctcggcccactgcaacctccacctccctggctcaagcgatcctcccacctcagccccccaagtagctgaaaccacaggcactcaccaccatgcctggcaaagtttttgtatttttggtagagacagggttttgccatgttgcccaggctggtctttaactcctgagctcaagcaatccactcgcctcggcctcccaaagtgctgagattacaggccgtttttttctttttccttttttttwaaatttttttaatttttctttattttttttttatttttattttgtgagacggagtcttgctctgttgcccaggctggagtgcagtggcatgatccccactcactgcaagctccgcctcccaggttcacgccattctcctgcctcagcctctggagtagctgggactataggcgcccgccaccacgcctggctaatttttttgtatttttagtagcaacggggtttcaccgtgttagccaggatggtctcgatctcctgacctcgtgatccacccgcctcagcctcccaaagtgctgggat

SEQ ID NO: 117844 - DNA, 601 bp, Human
ctcaagcgatcctcccacctcagccccccaagtagctgaaaccacaggcactcaccaccatgcctggcaaagtttttgtatttttggtagagacagggttttgccatgttgcccaggctggtctttaactcctgagctcaagcaatccactcgcctcggcctcccaaagtgctgagattacaggccgtttttttctttttccttttttttaaaatttttttaatttttctttattttttttttatttttattttgtgagacggagtcttgctctgttgcccaggctggagtgcagtggcaygatccccactcactgcaagctccgcctcccaggttcacgccattctcctgcctcagcctctggagtagctgggactataggcgcccgccaccacgcctggctaatttttttgtatttttagtagcaacggggtttcaccgtgttagccaggatggtctcgatctcctgacctcgtgatccacccgcctcagcctcccaaagtgctgggattacaggcgtgagccaccacgcccagccttttttctttttattaaccaaggtacaacttaacatacagtaaaataaataaataaatttact

SEQ ID NO: 117845 - DNA, 601 bp, Human
acctgggattatttgaccaattctttcaatgtagactatagttgtccagtatctggcccttgggcccgagtagacccacataacttttgtcttgggggtggtggtgtttgtttgatttagaggtgaggtttctgtcacccagactggagtgcagtagcactatcatagcttactgcaaccttgaactcctgggctcaggcgatgctcccacctcagcctcctgagtcactaggattataattgtaagccaccatgcccagctctccccatgtaatttttttacactgtagtcaatctttgtttttttttttttttttttgcagtcagggtcttgctttgttgcccaggctggagtgcagtgacaccatctcagctcactgcagcctcaacttccccaggctcaaatgatcttctcatctcagcctcccaagtagctaggactacaggcatgcaccaccatgcccaactaatttttttgtattttttgtagagacagggtttcaccatattgcccaggctggtatctgacaaaaggaaaataggaataaagtgagctccaatgtccccttcactcatggttgtcccatactgtacttttaca

SEQ ID NO: 117846 - DNA, 601 bp, Human
tttctgccctcaaggaaaatagttcactttgaccactgtaaatgatgtagtatttaaacaaaaggaaaagcacttcattgtctgctctaaaactaaaatgttaagaaagagaggtggcaaaaaaaaaaaagggaggaaaaccagttttaatgcatcttcatttttttcaggttctctcaagtagtgctgccagtagtaccatcacagcactgtcacctggaggggcacttatgcagggaggaacacagcaagccataaaccgtatgtgccgggccatcttctactactttctgcctaaatmagctttaaaaagcaagctgggaggagtgctgaacttttattggtttttccttggaataatcctgggatttctattttgtagatttgtttttatacattcagattctgaaacacatctagacaagatcttaggtttcagaaccgtcttactattacaaatagtggtacattgctagtttctctaatatcatagtaaaagctcctttcttctcccctacctcttagaataaaggggaaacctgaaagtttctttgaaatcccaagagcttttaaattttatgatctctcagccacaaaatta

SEQ ID NO: 117847 - DNA, 601 bp, Human
tgtcacctggaggggcacttatgcagggaggaacacagcaagccataaaccgtatgtgccgggccatcttctactactttctgcctaaatcagctttaaaaagcaagctgggaggagtgctgaacttttattggtttttccttggaataatcctgggatttctattttgtagatttgtttttatacattcagattctgaaacacatctagacaagatcttaggtttcagaaccgtcttactattacaaatagtggtacattgctagtttctctaatatcatagtaaaagctcctttcttcycccctacctcttagaataaaggggaaacctgaaagtttctttgaaatcccaagagcttttaaattttatgatctctcagccacaaaattactaacttatctgaaaatagcacatcctggtttggcattgacaaagagtacacattcaaatttattctctgagtggtcatttttttcgagactgtatatgttaaaatagctcttaacctatgggccttgttcttcttttgcagagatggtgccaaatgatattcaatctgaattgaaacacttatatgtagctgttggagaacttctacga

SEQ ID NO: 117848 - DNA, 601 bp, Human
gacaacaaatatagcactagctttttaacactaaaaccgctttaaccaattaaaggacagttgacaaatgaaaaatgtaacattaatagtaatactataaattgctttcataaactatgattaagtaaaagataaagacctcattaagcacaataggcaaacactttacaagcaactcactaaagaatggagtggcctaggaagattaaggggaaatgctcacacttaccagtatgcagataaattacagctacagtaaaagaacattttggccaagcacggtggctcacacctgtaatcycaacactttggcggggctgaggcgggagaattgtttgagcccaggagttggagaccagcctggacaacatagcaagactctgtctccaaaaaatacataaataaattttttaaaagaatatttttttcacctactaatttgcagaagaacaaaaatcttaaaatgatcaatgttgaccaagtagccaagagtcctttcttccactgctagtgtttttttagatgcttttacttcagcattcaaatgaaacttcaaatgaaattcaacatttagaaatttaggaaataattaggaatgcaa

SEQ ID NO: 117849 - DNA, 601 bp, Human
cttgggcaacatggcagaactccgtctctacaaaaattatgaaaagtagctcaggtgatcacctgagcctagagaggtcaaagctgcagtgagccatgatgttgccactgcactccagcctgggtgacagaatgagaccctgtctctaaatgaatgaataaatgaatgagtgactatttaaatgagttgggattttttgttgtttttgttttttgagatggagtctcactctgtcggcaggctggagtgcagtggtgtgatctcagttcactgcagcctccacctcctgggttcaaccaattttcctgcctcagcctcctgagtagctgggactacaggcgtgtgccaccacgcccagctaatttttgtatttttagcggagacggggtttcaccatgttagccaggatggtctcaatctcttgtccttgtgttccgcccacctcggcctcccaaagtgctgggattacaggcgtgagccaccacgtctggccaaatgagtatttatgactgaaagatattcacattgaagggttaacaatgtgatataattggtatatttttattttatttttacatttaaaaaaattctacaagaaaag

SEQ ID NO: 117850 - DNA, 601 bp, Human
gtgcagtggtgtgatctcagttcactgcagcctccacctcctgggttcaaccaattttcctgcctcagcctcctgagtagctgggactacaggcgtgtgccaccacgcccagctaatttttgtatttttagcggagacggggtttcaccatgttagccaggatggtctcaatctcttgtccttgtgttccgcccacctcggcctcccaaagtgctgggattacaggcgtgagccaccacgtctggccaaatgagtatttatgactgaaagatattcacattgaagggttaacaatgtgatrtaattggtatatttttattttatttttacatttaaaaaaattctacaagaaaagtaactttcatatgtagaagattgtttttctgttggtctctacagcttgagatttctctgtaatttattgtttctcatcttttttaggtagtgaaaatgaaaagtaatttggaacgattccaagttacgaagctctgtccattccaagaaaagattcggagacagtatttaagcacaaatgtaaggcagcaatctgatttttgcctgatcttctttctctttgtagtaaaatgatgaaattgatttt

SEQ ID NO: 117851 - DNA, 601 bp, Human
ggggttgcggtgagccgaggtcatgccaccgcactccagcctgggtgacacagtgagactctgtctcaaaaagttttacaatctatgtgtatgttctgaaaaatacatattactaatttattaatttggaaaaactgagtagcaagcacaaacctagcagcgtaaggaaagatagaattgccactactcatagtaagcaaaactgttcctgggttctatttggcatcagcttccctgattgtttacagtggggaaagtcagtggatgaggtattgagaagtgtcactttatgcccagcatktttagcattgtatttaaaacaaggttagagcaaccacatcagatcatttgtatgtgcagttatacaagccctcccagaggtaccttggaaagaatagtacagtcacgtgttgcttaaccacagggatgtgttctaaacaattcattgacagacagttttgttgtatgaacctcacagagtgtacttaaaacctagctatatagcctactatacttctaggctatatggtgtagcctgttgctcctaggctacaaacctgtacagcatagtactgtactaaatactgtaaacagttttaac

SEQ ID NO: 117852 - DNA, 601 bp, Human
ctgtacactactgcagagtttactaacactgtacacttagactacattaaatttacaatatagctttttttcttcaataataaattagccttagcttactataacatttttaccttataaacttttaaatatttttaaagtttttcattctttggaataacacttaacctaaaacacccattgtatagctgtacaaaagtattttctttgtattcttattctataagcctttctctctctctttctctctctctctccctctctccgtatagatatatatattttttctttttcttttttytttttttttttttgagatggagtctagttctgtcgcccaggctggagtgcaatggcatgatcacagctcattgcaacctctgcctcctgggttcaagcgattctcccgcctcagcctcccgagtagctgggattacaggcacccaccaccacgcccagctaatttttgtatttttagtagagaccgggtttcactgtgtcggccaggttggtctcgaactcctgacctcgtgatccacccacctcggcctcacaaagtgctgggattacaggcgtgagccaccacgcctggtgccttttt

SEQ ID NO: 117853 - DNA, 601 bp, Human
tggagttggaaaaaccctaaaaatagcaaactgtttcacaaaattatgcagaattaactgcaggagcttttgaaaatcaaagattcttgggtctcatcccaggcctgttgaatcagaatcttcaggagaataaggcatttttccagtgttctgccaagatgtatatacggggctgggcacagcagctcacgcctgtaatcccagcactttgagaggctgaggcaggaagattgcttgagcccaggagttcgagaccagcctgggcagcatagcaagagtccatctccactattaaaaaaaraaaaaaaaaaaaaacctggccgggcatggtggctcaggcctgtaatcccagcactttgggaggctgaggtgggtgaatcacttgaggccaggagttcaagaccagcctggccaacatggtgaaatcccatctctactaaaaatacaaaaattagccaggtgtggtggctcatggttgtaatcctagctactcgggagtctgagacatgagaactgcttggacctgtgaggtggaggctgcagtgagccaaaatcacaccatagcactccagcctgggtgacagagcaagactctgtctca

SEQ ID NO: 117854 - DNA, 601 bp, Human
ctcccggctcttgcgaacagtcaggctcctagctctgcctggctttggaggatgtcgggggccagtgcctgcgtgcactcccactctccggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcrttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccgcgccgccccagctcggctcctgtttgatgaaggagtgaggcggcggcggcgggggtggcggcggagccggtggcggcgcggggccgcccaacgacccgtaagccgaagcgcccgggggcgcaaagtccagcaccggcgcccactgcgccgcg

SEQ ID NO: 117855 - DNA, 601 bp, Human
ccccagaacctgcgtggccgccgcctgagcgaagcccagtgaagatccacttctgtattaccatacgcgggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagckctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctccggcctcctccccagccgccgcttccgctatcctcacggcccttgggaagcagctgggtaagagctgc

SEQ ID NO: 117856 - DNA, 601 bp, Human
ggtgggcgggcatcggcgcgggatgagaaaccaacctgatacttatcgtgtgccgagttccctccttgtatcctgactaagcacagcgaataaccctgtccttgttctaaccccaggtcttgaagaaatactgtcccagctgagccccgcgtttacaagatgaagaggcgccccagatgcgctgaaagaaaggccaaagctcgtgcctccttccactgcctgcggtagaacctggtcccgcatagcttggactcggataagtcaagttctcttccatccccagaacctgcgtggccgccgcctgagcgaagcccagtgaagatccacttctgtattaccatacgcgggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcg

SEQ ID NO: 117857 - DNA, 601 bp, Human
actacaggggctccgcaggttcgggtccgcgccgcccaggcgaaagagaggtgggcgggcatcggcgcgggatgagaaaccaacctgatacttatcgtgtgccgagttccctccttgtatcctgactaagcacagcgaataaccctgtccttgttctaaccccaggtcttgaagaaatactgtcccagctgagccccgcgtttacaagatgaagaggcgccccagatgcgctgaaagaaaggccaaagctcgtgcctccttccactgcctgcggtagaacctggtcccgcatagcttggamtcggataagtcaagttctcttccatccccagaacctgcgtggccgccgcctgagcgaagcccagtgaagatccacttctgtattaccatacgcgggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaa

SEQ ID NO: 117858 - DNA, 601 bp, Human
acccttgcccactccaggatagcagccggagcgcttctcacatccaagctgcccaatgagcctcaagggctgggtaagatggacccatctgttttcactgcaagacaaaacttaaacctggagatggtgcttccaggctatatgacttgaatctagggccctctctccattgggctttttctccagggtggagaagaaggatacattcacctactagtcctggtccccttttaactttttctccatggcagccacgcctgtatattacagaagaatccagatattttccagaagtgtaatrcctgctggctgcaaaacccacagtcccaccccccacgacatgtgataagatcccaggcaccagacctgccctgaaaagggctggacaagggacccaaacgaagcgacagaacccaggtttcaaaaatcccctagaagtactaaaaagataatggcgtagtagtattttgtgccccaggggcatggattcgatggtttctcaaccgcctccaaatagcacacatgcagacagtgctctcggattcattgtttctcagtcacagatgtttagatgggttgccgagttccatatttaaagccc

SEQ ID NO: 117859 - DNA, 601 bp, Human
accccacatctgccctcacaaacccgtcaacccccacacatggactaagagtttggtgcccctcccgcaggccagaagaaatccatctcaacggtggggccaagatccctggaaaaggagtagaaacaccctagcatggtctgggttcaaatcccacctctgccacctaatctcatagaacctggatttcctcatccaaaacaaggggcctctccaggattagctggtgagcttcttgcaaaggttctcgaggccattgtcttaattaatattcagaacccagtgcctgaccaagtaggcrattgatgtttgctaaattaatgtttacaagattaggatgcaagatataatatttaagaatttaaaatatgaacatgcttgtgaagttttgggcggttgtgagtgggtaccaacaattgcccctgcctgtgcaccatggctagactgccctagggatccagagacggccttgattcctctcccctggggtttggccttggcgctctgatggccatttccacatttttgagagttgatgcccttgcctctcacagcccaagtcttgggccaggccctgcattcctggggaagcagcaggaac

SEQ ID NO: 117860 - DNA, 601 bp, Human
ctgtgccctcctcccccgccggcggctgcagagaagccgggaaccgcctggcctggccgggccgtgagagctgaggggtgaaatggacagcaggctcagccaggaaggtgctcagaaggctgaaaacgatgactgcagctgcactgtgattggggaaaacctgtcccccaacaaaataccctctcctgtgtgaccggaagagggagcctttggccctcgggcgtcgcaggcctccgcacctgaccctagggtggcctgatgatcccaggcctaatcatgcgttagggttctgcgagcctgsggggctgcgggatcagtggactagcaggcaacctcttttttttttttttttttccgagacggagtttcgctctgtcgcccaggctgcagtgcagtggcgcgatctcagctcacttcaacctcagcctcccgggttcaaacgattcttgtgcctcagcctcccgagtagctgggattataggcgcccgtcaccaagcccggccaatttttttttttgtattttcagtagagacagggtttcaccgtgttggccaggctggtctcaaactcctgacctcaggtgatccaaccgcctcgagcc

SEQ ID NO: 117861 - DNA, 601 bp, Human
gctaagaggcgagacgcgctctgtgccctcctcccccgccggcggctgcagagaagccgggaaccgcctggcctggccgggccgtgagagctgaggggtgaaatggacagcaggctcagccaggaaggtgctcagaaggctgaaaacgatgactgcagctgcactgtgattggggaaaacctgtcccccaacaaaataccctctcctgtgtgaccggaagagggagcctttggccctcgggcgtcgcaggcctccgcacctgaccctagggtggcctgatgatcccaggcctaatcatgcsttagggttctgcgagcctgcggggctgcgggatcagtggactagcaggcaacctcttttttttttttttttttccgagacggagtttcgctctgtcgcccaggctgcagtgcagtggcgcgatctcagctcacttcaacctcagcctcccgggttcaaacgattcttgtgcctcagcctcccgagtagctgggattataggcgcccgtcaccaagcccggccaatttttttttttgtattttcagtagagacagggtttcaccgtgttggccaggctggtctcaaactcctgacctcagg

SEQ ID NO: 117862 - DNA, 601 bp, Human
gtcccggcccgggaggggagcgcaaccttgaccgtgcgctaagaggcgagacgcgctctgtgccctcctcccccgccggcggctgcagagaagccgggaaccgcctggcctggccgggccgtgagagctgaggggtgaaatggacagcaggctcagccaggaaggtgctcagaaggctgaaaacgatgactgcagctgcactgtgattggggaaaacctgtcccccaacaaaataccctctcctgtgtgaccggaagagggagcctttggccctcgggcgtcgcaggcctccgcacctgaycctagggtggcctgatgatcccaggcctaatcatgcgttagggttctgcgagcctgcggggctgcgggatcagtggactagcaggcaacctcttttttttttttttttttccgagacggagtttcgctctgtcgcccaggctgcagtgcagtggcgcgatctcagctcacttcaacctcagcctcccgggttcaaacgattcttgtgcctcagcctcccgagtagctgggattataggcgcccgtcaccaagcccggccaatttttttttttgtattttcagtagagacagggtttcacc

SEQ ID NO: 117863 - DNA, 601 bp, Human
actcgggcccaaggatgcccgtggcccgcgagccctcctaggcctcctcccagaccggacacgcagacctcggcgggcaaagaccggcctcaaaccctctccttcaggtccccccgggaggggcagtggtgaaagcgcctgcggagcggagggaggtctcttttaattagaagcttatcggacacgggtttgattagagcgcgctgtccctgggcccagcgcttggcctggcgcggagagtgcgggggcaggggccaggggaggtaaagctgccggctggaaggagcagcgtgttcaaagsctccttgtacaggccttggagggagagaatcgagtggccaaggtagcgcctttcccacggttagtcccggcccgggaggggagcgcaaccttgaccgtgcgctaagaggcgagacgcgctctgtgccctcctcccccgccggcggctgcagagaagccgggaaccgcctggcctggccgggccgtgagagctgaggggtgaaatggacagcaggctcagccaggaaggtgctcagaaggctgaaaacgatgactgcagctgcactgtgattggggaaaacctgtcccccaacaaaatacc

SEQ ID NO: 117864 - DNA, 601 bp, Human
atggctaaggagagctgctcctatgggatcctggcagggccaccccagcagcctcagatcctcctggcccaggactgccctgggtctccaaacttcacaaaattctcaggagtaaattgggtcaaacagcacccattctcccactcttgcactatttgaccaaagtgcctccaaagacttaagcaggactcagccgatgagcaggacccagggcatcgttacctccattttcgaaacacacacggacgctcatgcacacacaccaccaccccccgcccagaaaaaaaaaaaaagaaaaagaaaaaaaaaaagcttctctggggcaacagaggcatgagcctggagggtggtgtggcagagtgcaagggagggaaggagggggcaaatcctaactcccggatagtacaggtccaggcttaagtctcacacactgctcagcaccacacactggggatttgagaagccactagcttttatcatatgacctcgagggcctccatttctctcctgctaagtgggcaaagataacccccggccccgttagctctcctgcatgggcgagcacgtttgggcttccacagacttccttttgaaacctgag

SEQ ID NO: 117865 - DNA, 601 bp, Human
agtccagacacaatggctaaggagagctgctcctatgggatcctggcagggccaccccagcagcctcagatcctcctggcccaggactgccctgggtctccaaacttcacaaaattctcaggagtaaattgggtcaaacagcacccattctcccactcttgcactatttgaccaaagtgcctccaaagacttaagcaggactcagccgatgagcaggacccagggcatcgttacctccattttcgaaacacacacggacgctcatgcacacacaccaccaccccccgcccagaaaaaaaagaaaagaaaaagaaaaaaaaaaagcttctctggggcaacagaggcatgagcctggagggtggtgtggcagagtgcaagggagggaaggagggggcaaatcctaactcccggatagtacaggtccaggcttaagtctcacacactgctcagcaccacacactggggatttgagaagccactagcttttatcatatgacctcgagggcctccatttctctcctgctaagtgggcaaagataacccccggccccgttagctctcctgcatgggcgagcacgtttgggcttccacagacttcctt

SEQ ID NO: 117866 - DNA, 601 bp, Human
gaccctgcgctctcctcctcctcccccctatgggacccaccttgcgcccaggggtccgaccctgaccactgctgtaggagccaacttcctcactccccaggctggacaaccaatttcctttagagtgtgcctgacactgtatctccctttccctccatggtagtgcttcggtcctttgcctcagtttccccctagggaaatcctagcattcccccccccccccaaagtgagaaaaagagcgtggagcctcagttggaaaacatagtcttttataatttttgttattaaattgctttaaacwtataccccacaagcttctggaaagctgttgctgcctctggggaaaaggatccttcggctaaagatacgtcattggccccggaacccaaggatggggtctcattcctctacaagttccggagtctgtggcctgaagtccagacacaatggctaaggagagctgctcctatgggatcctggcagggccaccccagcagcctcagatcctcctggcccaggactgccctgggtctccaaacttcacaaaattctcaggagtaaattgggtcaaacagcacccattctcccactcttgcactat

SEQ ID NO: 117867 - DNA, 601 bp, Human
atctgtctggggctacccgacctgacaccatgacacccaagggaaagctggtgagggggaaaacaagggccccttccagttgggccttcagatggcgaccctgcgctctcctcctcctcccccctatgggacccaccttgcgcccaggggtccgaccctgaccactgctgtaggagccaacttcctcactccccaggctggacaaccaatttcctttagagtgtgcctgacactgtatctccctttccctccatggtagtgcttcggtcctttgcctcagtttccccctagggaaatcctrgcattcccccccccccccaaagtgagaaaaagagcgtggagcctcagttggaaaacatagtcttttataatttttgttattaaattgctttaaacttataccccacaagcttctggaaagctgttgctgcctctggggaaaaggatccttcggctaaagatacgtcattggccccggaacccaaggatggggtctcattcctctacaagttccggagtctgtggcctgaagtccagacacaatggctaaggagagctgctcctatgggatcctggcagggccaccccagcagcctcagat

SEQ ID NO: 117868 - DNA, 601 bp, Human
gcgttgactccgagctgtaaatcaggggcccgcgcaccaactttcattaattactcggagccagttaaatggcctggtcttaaaaatgggaagagtaattaccgagtaatgttatctgtctggggctacccgacctgacaccatgacacccaagggaaagctggtgagggggaaaacaagggccccttccagttgggccttcagatggcgaccctgcgctctcctcctcctcccccctatgggacccaccttgcgcccaggggtccgaccctgaccactgctgtaggagccaacttcctcrctccccaggctggacaaccaatttcctttagagtgtgcctgacactgtatctccctttccctccatggtagtgcttcggtcctttgcctcagtttccccctagggaaatcctagcattcccccccccccccaaagtgagaaaaagagcgtggagcctcagttggaaaacatagtcttttataatttttgttattaaattgctttaaacttataccccacaagcttctggaaagctgttgctgcctctggggaaaaggatccttcggctaaagatacgtcattggccccggaacccaagga

SEQ ID NO: 117869 - DNA, 601 bp, Human
tacctgctgtagggcgtcctcagcagcaaagcctggctgccggtgcagctgtcggtgggggtgtggcagccatagaccgggggcggcaccgagtactgctgctcacctgcagagagaaccgaagacagctgagcgagtgcgccccaagggctcggggtgcgaggctgcgggcaggggttgggggagacacgagatcctgagcctggggcactggggcctggatgagcggcgtgcagagcgaggccgtccagaatgcaagaagctaagcctctcactttgcattcccctagcagtcgctgckctgtgcaccaaaaaggccctccggacattcatagacttagttggatggcgatgtccctaacgtacttgggatggagggagacccagtcttgtcctttaaatacagtgccattggggtaatgatttctaaggtccttttagatgtcctcctttgcctaatttgctgtgggttaggaattcctgggggagaggaggatagcacggaagaaggggagaaggactccacttggttccgctcgcttacccagcgagccctgctggcccatgggatcctcatgcttgaatgagtggttggggaact

SEQ ID NO: 117870 - DNA, 601 bp, Human
taatatttagtcccgatgaaggtaaattcctcccagtaaagaccttctaaaaataataacttctcgagcgccgctccttcttcagctcgaaagagtaattgtcctcatttttatacaacataagaacaactcagagaccagggagatcagctttaatttcctctaagtagtagagtggagtcgaggcgtctcgtgcctccaagaccctgcatgcccgcagtcagggctgcccggctggggcgttcccaagtccgccggctcatgcgtcccctccggggtcccaaggacccagacgcagagyccagcgccttcctacctgctgtagggcgtcctcagcagcaaagcctggctgccggtgcagctgtcggtgggggtgtggcagccatagaccgggggcggcaccgagtactgctgctcacctgcagagagaaccgaagacagctgagcgagtgcgccccaagggctcggggtgcgaggctgcgggcaggggttgggggagacacgagatcctgagcctggggcactggggcctggatgagcggcgtgcagagcgaggccgtccagaatgcaagaagctaagcctctcactttgcattcccct

SEQ ID NO: 117871 - DNA, 601 bp, Human
ccccggccgggggcccaccccagagcgtagcaggggcgctgggaacgacgtccacaaagcgctgccacgggtcgaaaccctggagggttgaggtggggagaaggctgtggccaaggctgtggccgaaggtacgcgccttcgaggtagtctggccggtgtggccattggatgggtttgaggtctcagaaccgagtgggagtggactccgtgtttaatatttagtcccgatgaaggtaaattcctcccagtaaagaccttctaaaaataataacttctcgagcgccgctccttcttcagctcsaaagagtaattgtcctcatttttatacaacataagaacaactcagagaccagggagatcagctttaatttcctctaagtagtagagtggagtcgaggcgtctcgtgcctccaagaccctgcatgcccgcagtcagggctgcccggctggggcgttcccaagtccgccggctcatgcgtcccctccggggtcccaaggacccagacgcagagcccagcgccttcctacctgctgtagggcgtcctcagcagcaaagcctggctgccggtgcagctgtcggtgggggtgtggcagccataga

SEQ ID NO: 117872 - DNA, 601 bp, Human
ggccccgctgccagttttgctagggaaggagattcacctcagagaataggtgcgaatcctgcccccattccaaagactttacccaccgaagggaggcgctgaggtggcaggcttggggcagcatgccgcgcctgtggtgcagaacaggaatgatttctagctagggacgcagaaaaagaaggatggggaggtgcgaccattggtgttcttgcccaccgcctgcctccacccgcccaaaaaaagtgtgatgaggaatccaagtttcgaatagataaaccggatgttccgggggaaaaaaagraaaaaaaaaggtttccccagtccgcgcgcctcaggcgttagaaatagaaggggcgcatccctgcacctctctagaaactcccgggaaggagaaccttagatgcgagagccaggccagccccgggctcactctcgtaaaggcagcaagggcctggggctgcgcctcgctccggatcgaggactcccgcccctcctccacctgcgggactggacagtcccccaggcgcggccactcccccacccaatctcccagggcaggcgcttttccttccttcatgacctcactacctccttcccttga

SEQ ID NO: 117873 - DNA, 601 bp, Human
ggcaggagcagctacacaagaagaatggcaatggccccgctgccagttttgctagggaaggagattcacctcagagaataggtgcgaatcctgcccccattccaaagactttacccaccgaagggaggcgctgaggtggcaggcttggggcagcatgccgcgcctgtggtgcagaacaggaatgatttctagctagggacgcagaaaaagaaggatggggaggtgcgaccattggtgttcttgcccaccgcctgcctccacccgcccaaaaaaagtgtgatgaggaatccaagtttcgaatagataaaccggatgttccgggggaaaaaaaggaaaaaaaaaggtttccccagtccgcgcgcctcaggcgttagaaatagaaggggcgcatccctgcacctctctagaaactcccgggaaggagaaccttagatgcgagagccaggccagccccgggctcactctcgtaaaggcagcaagggcctggggctgcgcctcgctccggatcgaggactcccgcccctcctccacctgcgggactggacagtcccccaggcgcggccactcccccacccaatctcccagggcaggcgcttttcct

SEQ ID NO: 117874 - DNA, 601 bp, Human
tcctggactcctctttcaaggctgccaggtcctctgatggaccccttcctagggtcccacagggtgagtctcggcttgggagagggaagtaacggatgtgtgtgtagcttcgagtcactgaggcaccagactgcaaggtcttccagtccccaacccccaagaacacctcccatatcgacagtgcccactcccgcatcaaggtcttctctcagcctagtgtgacacaccaactgagtccacagggagctaaggaggaaggggtggaccaaggtcattacgtgggaaccattccaacagccckcctgatggctactagaataacagcaatgacaccctggcaatgggcaggagcagctacacaagaagaatggcaatggccccgctgccagttttgctagggaaggagattcacctcagagaataggtgcgaatcctgcccccattccaaagactttacccaccgaagggaggcgctgaggtggcaggcttggggcagcatgccgcgcctgtggtgcagaacaggaatgatttctagctagggacgcagaaaaagaaggatggggaggtgcgaccattggtgttcttgcccaccgcctgcctc

SEQ ID NO: 117875 - DNA, 601 bp, Human
aaccatataactgtagtaatgttggtgcacagacccaggtttaaaacattcctacacctgcccattcatctttagactgcaagggaagcacatgatctttgaaaactgaatggaaatgttaatttagagtgaatggagctttcaagatccagacagcacaaattccaagggaacaaactcttcctacaggggtcacaaattcttttttgagatgttactacttgggaaattttctgtgagagggaaaaatagtatttttattggatttgtgtaaaaataacaggaccaaagaaagttcctsaattataaagaaagaagatagaaataaacaaatacttctgaaaggtgaatttgatgaagtgcttaatacagtggccaatcagaagctggattagaaaacgtgaaaatttatgtgatgtttcctacttccctagcaaccacaaaatcagacctaagtcaaaatccaccataggcaccctggagaattgctattaaaccagtggtaatgatcgctttttcctggactcctctttcaaggctgccaggtcctctgatggaccccttcctagggtcccacagggtgagtctcggcttgggagag

SEQ ID NO: 117876 - DNA, 601 bp, Human
gagactgtctcgaaaagaaaaaaaaaaaaaaaaaagactggggaagaaaaagtttggtgagggagggggagaaaaagctgggcagtcagcctcagagggtcaaatgcaacaaggcaaacaaaatacaagcaagctttccccagaaagtcccaaactttagagagaaaaaatgaatgaaaccagggaccagtagaagcaccactgaatacctaaaatccaaaagttagggtgttaagcaattaaagtttagtcctattttttatgcttcttcaaccattacattcacaaaagcatttaaatrccctttcaaacttgtttaggagtaggaaagagggaaaccatataactgtagtaatgttggtgcacagacccaggtttaaaacattcctacacctgcccattcatctttagactgcaagggaagcacatgatctttgaaaactgaatggaaatgttaatttagagtgaatggagctttcaagatccagacagcacaaattccaagggaacaaactcttcctacaggggtcacaaattcttttttgagatgttactacttgggaaattttctgtgagagggaaaaatagtatttttattgga

SEQ ID NO: 117877 - DNA, 601 bp, Human
acttgctgtgtgactttgagcaagttactttgagactctgaacttaaactagaaattatagtacctgcctcaacgagtagtcaaaagggttaaatgggtaaactgagtgaaccatttaacgtcatgcacagcaacatatagtcagcatgcaataaattccagttattacattataaggactcatgctgtcatccaacaatgatcactgggttccgtaagggcagacacctggtttcagaaaccctagtgacctttacacaaaactccacccaccttgtatatgagaggagagggtaaggargatagagaaaaccacctcctgtcatttcccataagttgctgattgaatgtattttctattcactgttgttcatagccacaacaaatatatatgcagctgcaactcctcagaactgtcacctgagagaaaggagggaattgtgcaggggacaagggaagaactgggattttgagaatgtcctcaaagcacactccacactgtattttgcttatttaatgtcagatctgtaccattacctttctttagactgacaagggaaagtatatccaaagactgggaagaggcccagcacagcggctc

SEQ ID NO: 117878 - DNA, 601 bp, Human
gatcaaatcctgattctgattctcacttgctgtgtgactttgagcaagttactttgagactctgaacttaaactagaaattatagtacctgcctcaacgagtagtcaaaagggttaaatgggtaaactgagtgaaccatttaacgtcatgcacagcaacatatagtcagcatgcaataaattccagttattacattataaggactcatgctgtcatccaacaatgatcactgggttccgtaagggcagacacctggtttcagaaaccctagtgacctttacacaaaactccacccaccttstatatgagaggagagggtaaggaggatagagaaaaccacctcctgtcatttcccataagttgctgattgaatgtattttctattcactgttgttcatagccacaacaaatatatatgcagctgcaactcctcagaactgtcacctgagagaaaggagggaattgtgcaggggacaagggaagaactgggattttgagaatgtcctcaaagcacactccacactgtattttgcttatttaatgtcagatctgtaccattacctttctttagactgacaagggaaagtatatccaaagactg

SEQ ID NO: 117879 - DNA, 601 bp, Human
cgtggtctggtgtcactcagtgattcagagcacagctgggctgtgaagtcagagagactaaggatcaaatcctgattctgattctcacttgctgtgtgactttgagcaagttactttgagactctgaacttaaactagaaattatagtacctgcctcaacgagtagtcaaaagggttaaatgggtaaactgagtgaaccatttaacgtcatgcacagcaacatatagtcagcatgcaataaattccagttattacattataaggactcatgctgtcatccaacaatgatcactgggttccrtaagggcagacacctggtttcagaaaccctagtgacctttacacaaaactccacccaccttgtatatgagaggagagggtaaggaggatagagaaaaccacctcctgtcatttcccataagttgctgattgaatgtattttctattcactgttgttcatagccacaacaaatatatatgcagctgcaactcctcagaactgtcacctgagagaaaggagggaattgtgcaggggacaagggaagaactgggattttgagaatgtcctcaaagcacactccacactgtattttgcttattt

SEQ ID NO: 117880 - DNA, 601 bp, Human
atgagcaaaagtgatacattggcctggtgcggtggctcacgcctgtaattccagcactttgggaggcccaggcgggtggatcacaaggtcaggagtttgagaccatcctggctaacacggtgaaaccccctctctactaaaaatacaaaaaattagccaggcgtggtggcacatgcctgtagtcccagctacttgggaggctgaggcaggagaatctcttgaacccggcaggcagaggttgcagtgagccaagattgcaccattgcactccagccttgcaacagagcgagatgccatctcaaaaaaaaaaaaaaaaaaaagtgatacattgcctatacaaggggagtaatcagatagggaatcctgcgtggtctggtgtcactcagtgattcagagcacagctgggctgtgaagtcagagagactaaggatcaaatcctgattctgattctcacttgctgtgtgactttgagcaagttactttgagactctgaacttaaactagaaattatagtacctgcctcaacgagtagtcaaaagggttaaatgggtaaactgagtgaaccatttaacgtcatgcacagcaacatatagtcagcatg

SEQ ID NO: 117881 - DNA, 601 bp, Human
gaaacaatcagtgtgcatgggaatatttttcaaacgcagtgcacagaacttttcaaagtagccatgaggatcatatgtgaagtcggtatagtcaaggactggggtctccgaggaagtcagcaaaaagatgaggcaaagggactctgggaaggaaagacagcagaaaaggcccagctagctgccttttctaggtagaaattaggggggaaattgtgcctagtaaggttggaccccactactccctacactgacagaagaacttttccctggtaccttccctctgggcaagcccaaaccaggrtggtcctggaagcagtcattctttctgggtctggatggacagggagaaaggtctctgccctgcaattctttaggtgcctgggctgaacttcaccccaacagttcacacccagtggtaaagacaaaactggaggagtctggagtttgaaagacaactgctctgtgtgttagaacttcaggagaatgctcaagcctgcttctgataatggccttcagggaaaacgctgtcccaaaccactaagaactttctgttgaaagctacaggtaaaactaatggataactgacttctttcacaactgt

SEQ ID NO: 117882 - DNA, 601 bp, Human
aattttattttcttgggcatgggctgtcatctgatttctgtctatgttgaaggccaacccaagtggtagatcggcacttcccactgagttatggaacccaagatttcccagaaactctatggctgctgaggaagtttctctcatatgaaaaataatctacttgtaacaggctccactgtcaatgtcaccatttgtgaatcatcacatccagttcaaaacagactaacattgaatgattgcttccagagtcggagtggtttcacctgctaacaggcaaaagtacagcaaaaggaaatatctycatttaaattcgtagcacagttgctaaagaagaatatgcaaacctaataaaagagcaaaaggaaagggaaagggctagaatgcctaaaagaaacaatcagtgtgcatgggaatatttttcaaacgcagtgcacagaacttttcaaagtagccatgaggatcatatgtgaagtcggtatagtcaaggactggggtctccgaggaagtcagcaaaaagatgaggcaaagggactctgggaaggaaagacagcagaaaaggcccagctagctgccttttctaggtagaaattaggggggaaat

SEQ ID NO: 117883 - DNA, 601 bp, Human
cagcacaaaagttacaggaatatttggaactagatttttcctcctccctggagacgagtttaattcaagcctgtggctttgataacattgcccatcaccctggaagccgtttcagaccttccaccttctgcctatcattgcaggaaacaaatattgattttctactaagggaaaaggcagtgtacaatgtacataggtacacaagtgaaaagaggcattattaattacaattttattttcttgggcatgggctgtcatctgatttctgtctatgttgaaggccaacccaagtggtagatcrgcacttcccactgagttatggaacccaagatttcccagaaactctatggctgctgaggaagtttctctcatatgaaaaataatctacttgtaacaggctccactgtcaatgtcaccatttgtgaatcatcacatccagttcaaaacagactaacattgaatgattgcttccagagtcggagtggtttcacctgctaacaggcaaaagtacagcaaaaggaaatatcttcatttaaattcgtagcacagttgctaaagaagaatatgcaaacctaataaaagagcaaaaggaaagggaaag

SEQ ID NO: 117884 - DNA, 601 bp, Human
tgcccagcaggccataatgaataattatttcacagtcactctcttggtattgtaatttctctcaagctcaccagctaaccaaagaaaaacccactggggattccatttctattaataaacacttggtcagcacaaaagttacaggaatatttggaactagatttttcctcctccctggagacgagtttaattcaagcctgtggctttgataacattgcccatcaccctggaagccgtttcagaccttccaccttctgcctatcattgcaggaaacaaatattgattttctactaagggaaraggcagtgtacaatgtacataggtacacaagtgaaaagaggcattattaattacaattttattttcttgggcatgggctgtcatctgatttctgtctatgttgaaggccaacccaagtggtagatcggcacttcccactgagttatggaacccaagatttcccagaaactctatggctgctgaggaagtttctctcatatgaaaaataatctacttgtaacaggctccactgtcaatgtcaccatttgtgaatcatcacatccagttcaaaacagactaacattgaatgattgcttccag

SEQ ID NO: 117885 - DNA, 601 bp, Human
atgccccatgtgtcctcttcagctcactaagggcagagtgccaagatcccaatagaagccccctttgccattctagctgtcctgatagcttagcctgcaaactctcagaagaggagagaaggtggggaggatgtatgggacagaaggactttcagaaaatccccaagctactaataggtttcctgaggccagagataggatcagagcacagttttaaccacatcctgccttttgctggctggggctcctcagctgctcagtcagtgggcctggctggcacggcctttcaaatggaagtcartgacagcaatgacaataacggctgctggggaggggacaaaaatgtgaactggagctaaaaatactgggccgaagcatgctcaggctctgatctctttgggcaatcgctcaacacccagctctcatcatggaagcccatggaaagaggcagcttcgttcaaggaatatagagcctctggcaaatgaagcatctaattactcaataaccactgtaggtgccaccacctcattcccagaggagatcagataagcaggtggtttggcttacagcgaccactgtggtcacgtaggcatttcagct

SEQ ID NO: 117886 - DNA, 601 bp, Human
tttgaagatgatacagataatatactttaattactttaatttgttctaacctaccaaattttgcacagcactttcacacattctcaatactgctcacaactttgtgaggcagatgtaattctgagtccccatttattagatgagggttgaggcacagagagatgcccagtgctggcatgcctgagcccccaccctcactctgccctgcccctatgaaggcatcctgagcctcatcctctcattaccatttatataataataataataacaataatacagacaagagtctggaggtgaaagrgaatatgctcaagggagcatcatgacctactcagtctctagaaaatgacgatgctgcaagatgccccatgtgtcctcttcagctcactaagggcagagtgccaagatcccaatagaagccccctttgccattctagctgtcctgatagcttagcctgcaaactctcagaagaggagagaaggtggggaggatgtatgggacagaaggactttcagaaaatccccaagctactaataggtttcctgaggccagagataggatcagagcacagttttaaccacatcctgccttttgctggct

SEQ ID NO: 117887 - DNA, 601 bp, Human
tacaaatttggatcccggactttgcacacccaaagcacttcttgataagatagtggaatggttaacaactgtgatatcatagtaaaacacaattattaaatgaggttgaatagcctttgaagaattataaaacattcaacaagaccataataagtgtcctcaatattccttgttccagatagaaacaacccacatttatgtttttgaaaatttaatactgaacacaactcaccaactaggggaaggaggaaagcgttctaatgtcacagagagctttgccctttcttctaaaactgtactytcttcataagttctaagcacctttgaaatggttcaaacaggtataagttactgtggaaaggcaatggaatagagaaaaccttacccctttaaggtggctcctaagttcatctgattccaggtcatgcattcaagctgggatgtcatttggtataaattgtcactgttagaaaaacatctagagttagaaacacataaccacaaaataatacacaactgtttcttcaaaagcaatggagttttaacttttcttgaaagtgcaagcctccacattttccagaatgacagaatatgcaaatct

SEQ ID NO: 117888 - DNA, 601 bp, Human
acctgacacgctgcaggcacttcatgagtgttctatgctactgcccatctcttcacacttggtagaaaatgaaaagtgagctctttcaatggtgaaagcaagtcccacctgccttcttttttttattttttcatttttaggtgcaaagagtagctccttctgatgtttcctggctgtattctccctattatggttgtattatcaagtatggaaagaaaaaccctgttggtgcaatcaggtatgggcgtatctgactgtgaattgcccagatcagcatcacacaaatacaaatttggatccyggactttgcacacccaaagcacttcttgataagatagtggaatggttaacaactgtgatatcatagtaaaacacaattattaaatgaggttgaatagcctttgaagaattataaaacattcaacaagaccataataagtgtcctcaatattccttgttccagatagaaacaacccacatttatgtttttgaaaatttaatactgaacacaactcaccaactaggggaaggaggaaagcgttctaatgtcacagagagctttgccctttcttctaaaactgtactttcttcataagttcta

SEQ ID NO: 117889 - DNA, 601 bp, Human
tacttagctctcatgagagtgttgggaagataagatgaggtaacctggaaggacacctgacacgctgcaggcacttcatgagtgttctatgctactgcccatctcttcacacttggtagaaaatgaaaagtgagctctttcaatggtgaaagcaagtcccacctgccttcttttttttattttttcatttttaggtgcaaagagtagctccttctgatgtttcctggctgtattctccctattatggttgtattatcaagtatggaaagaaaaaccctgttggtgcaatcaggtatgggcrtatctgactgtgaattgcccagatcagcatcacacaaatacaaatttggatcccggactttgcacacccaaagcacttcttgataagatagtggaatggttaacaactgtgatatcatagtaaaacacaattattaaatgaggttgaatagcctttgaagaattataaaacattcaacaagaccataataagtgtcctcaatattccttgttccagatagaaacaacccacatttatgtttttgaaaatttaatactgaacacaactcaccaactaggggaaggaggaaagcgttctaat

SEQ ID NO: 117890 - DNA, 601 bp, Human
ctgtaaaccaagcagtacttagctctcatgagagtgttgggaagataagatgaggtaacctggaaggacacctgacacgctgcaggcacttcatgagtgttctatgctactgcccatctcttcacacttggtagaaaatgaaaagtgagctctttcaatggtgaaagcaagtcccacctgccttcttttttttattttttcatttttaggtgcaaagagtagctccttctgatgtttcctggctgtattctccctattatggttgtattatcaagtatggaaagaaaaaccctgttggtgyaatcaggtatgggcgtatctgactgtgaattgcccagatcagcatcacacaaatacaaatttggatcccggactttgcacacccaaagcacttcttgataagatagtggaatggttaacaactgtgatatcatagtaaaacacaattattaaatgaggttgaatagcctttgaagaattataaaacattcaacaagaccataataagtgtcctcaatattccttgttccagatagaaacaacccacatttatgtttttgaaaatttaatactgaacacaactcaccaactaggggaagga

SEQ ID NO: 117891 - DNA, 601 bp, Human
caatacacagagacatcaagctagctatcaagagtgctgaactaagtccccagtcccactggggccaatggtggggtggaaggcaccaccggaggctgcaaagagcttgggctttggaatcagatctggacttggcatcccagctctagcacttagtaggatgtgaacctgggaagtaacttaaccctctgagcttggtttacttatctgtaaaccaagcagtacttagctctcatgagagtgttgggaagataagatgaggtaacctggaaggacacctgacacgctgcaggcacttcaygagtgttctatgctactgcccatctcttcacacttggtagaaaatgaaaagtgagctctttcaatggtgaaagcaagtcccacctgccttcttttttttattttttcatttttaggtgcaaagagtagctccttctgatgtttcctggctgtattctccctattatggttgtattatcaagtatggaaagaaaaaccctgttggtgcaatcaggtatgggcgtatctgactgtgaattgcccagatcagcatcacacaaatacaaatttggatcccggactttgcacacccaaagcactt

SEQ ID NO: 117892 - DNA, 601 bp, Human
tttcctattcagctcctttcttctccagatctaaacaaacctagcatttttcctcacctccacaagatgaaaataattccttgctttaaaataaaatagttagaatcatggtatggaggtaagtctgcagagcccataaatattttttaagaggctgagaatattttcaagaagtcaaagctatcatgacaacttcgtgatggcctataaatatgcatttgctgaattgaatctcacctgaagccaatcatttttgtaagaaagaaaatgacacaaatgtacatgcatggacaggaaaggktctaaaattttgtgcaacatcattatcatcatagtttcatctaggcttttggggggagttttaatttccttctctgcgtagttgtattttctaactgttctataatttatacacattacttacataataaaaaaattcaatacattcatcaaatgcatgtccaaaaataaaaggatagaaaaggccaacagccagggaggagaaagaagaagcagaaaagtgagaagcaaaggaaagaagcttccgaatcagtccacactaagtgagagggacacagagctaagtcacgagtctccatct

SEQ ID NO: 117893 - DNA, 601 bp, Human
tgcctcggcctcccaaagtgctgggattacaggtgtgagccaccatgcctgccccattttttcctcctcttgatcattctcatcagcaaacaaacatacagatacttctatctaaagataaataactaaataaaagcagaacaatttaaaacaaaaccactccttctcccgaccttctttccccagccagctagaaccccatttttttgctcccttttgcagcagaactccatgaaagcatgatctttacctcctctccttgtctcttaaatccatctgtttcaggcttttgtctcttccrtctaatatatttagaggtaactgcaattaatagtctgataaatgtttccagaattttttctctgaagatataaatacacctcaaaatgtttttttaaacagttatctctgggtggtgagacaacagattaattttcttttcctctttataatgttttggtcccgtctgaattttttaaaaaatgataagcctgtgtgacttttataatcaaggagaaaataactgttttcattttagataaagtcgccatctaggcatacagaactacatctgttgttttaaaaatgaagagttagaaat

SEQ ID NO: 117894 - DNA, 601 bp, Human
ttttgtatttctgtagagaacagggtttcgccacgttggccaggctggtctcaaactcctgacctcaagtgatccacctgcctcggcctcccaaagtgctgggattacaggtgtgagccaccatgcctgccccattttttcctcctcttgatcattctcatcagcaaacaaacatacagatacttctatctaaagataaataactaaataaaagcagaacaatttaaaacaaaaccactccttctcccgaccttctttccccagccagctagaaccccatttttttgctcccttttgcagyagaactccatgaaagcatgatctttacctcctctccttgtctcttaaatccatctgtttcaggcttttgtctcttccgtctaatatatttagaggtaactgcaattaatagtctgataaatgtttccagaattttttctctgaagatataaatacacctcaaaatgtttttttaaacagttatctctgggtggtgagacaacagattaattttcttttcctctttataatgttttggtcccgtctgaattttttaaaaaatgataagcctgtgtgacttttataatcaaggagaaaataa

SEQ ID NO: 117895 - DNA, 601 bp, Human
atctggacttttttgagagcacctgagttataagttcttgcgaataattgaaattttaaagaatcactgtcgggtcaaataaaacacacactctagatggcaccactgcactctagcctgggtgacaagagtaagactctgtctgtaaaaaatatatatatttttaatatacatatatgttatatataatatattcataaatgtataataaaatatatgttgaatatataaatatatacagaatatatacttatacataaatatatatatttttcaatccttagaaccctaggagtcattcattaagttccatcaccttacacaaatgacaacttcctccctggcctcagcttcatgtaaaatgaaaattacagcacttcccgcatcagactgatgcaataggtcaggtaagtaaatcacagtgcttggtatgcactcaataagtgttaaactgttgcttatgtagtattatccccattttacagcaaagaatactgaggtttaaggagacattgcgttatttgcccacagtcagatggcaagtggcagagctagagtttgagtccaggtcagtgcttttcttccttccaaatgagctgga

SEQ ID NO: 117896 - DNA, 601 bp, Human
tcaaagatctggcctaataacttttccaagaattcatgctaactctgtggtttccagaatccactgggtttttttcctacttgaaaactaagacatttatctgtctcaactcttcggtcacctctcttattctccatgaatttcccggttattggataaggaggcagttatttcatgtgtttgctaaattggtcagaatatggattgactctttttaatttaaaacagagccatgaactcaaatattcctataggggccaagtaagacaagtaaaatgaaggcgaccctaaagaatgagaygatattgaactcacagggacggctaccctggccacatcaccctctgaccaacagaggcagccacgactcagctctcccagccaataactgtaaacaatgtgaacccagcattgctatacttttccattctcaaagaaaagtaggaaatctggacttttttgagagcacctgagttataagttcttgcgaataattgaaattttaaagaatcactgtcgggtcaaataaaacacacactctagatggcaccactgcactctagcctgggtgacaagagtaagactctgtctgtaaaaaata

SEQ ID NO: 117897 - DNA, 601 bp, Human
gcagtgaagaagaggctgccagggccaaagagtccatcagtaaggaactaaagggccggtaagtaggaagaggcagtgcggcccccttcccgctggggcctgtctgtgtgctcacctgaatgcctctgaagacaccgtgcgtgtgtattctgtattgggctccgcagaggatgggcgttgtgtggttatcgctctcgtaccctgtgctgtggctgcaaacacaaagaagggaaaaaggctcagtgtggctcacagtcgccatttggaaatgcttatctgcaatcaggagggaatgatggtgtttaaagctcacagaacaaaaatagttggtttttgcctccctccatggggccactttagatgcagggttctgcggagggcgaggcccctggatcctggccgccacctcgcagcccctccctcatcctccgattctcgtaggcgtgcaccgtcacggtctaggtctcgctcagacaagccgaggaagaccacagtggcagggtttcatcctcggcaagttgtttaccatctagacggcagggctgacagctgcaggtatctcaggaatgagcagaatgcctcaagcttcacgttaagtgca

SEQ ID NO: 117898 - DNA, 601 bp, Human
acttttacctttatactttactttcttcatgctccttggagacttctccctcccacaaactgttcaccatcctctgcctccctaagaagcagtatcgtgaagtaggtataaacagggggtctgaagtcaggcaagacctgtgttattagtctcggctccaatatttactagcgatgtgattctgacattattcatcacctctgggcttcagtttccccatccatgaaatggagagaataacagtacccacctcataagtgtgtattgcagatgaaatgaagggggaaaggccacaaatagwcaaggagaaaccttacatgcatattgctaagagaaagaagtcagcctgaaaatgctacatctagtatgattccaactatatgacattctgaaaaaagaccgagccgggcacagtggctcacgcctgtaatcccagcactttgggaggccgaggcgagtggatcaccaggtcaggagatcaagaccatcctggctaacactgtgaaaccccgtctctactaaaaatacaaaaaattagccaggcgtggtggtgggcacctgtagtcccagctactcgggaggctgaggcaggagaatggtg

SEQ ID NO: 117899 - DNA, 601 bp, Human
tgctgttactcaggttgcagccatggattgatgtttataagccataaatgaaacccttagtaactgtatgtgcttctgaccacccaaaacagagactctgcagggaaggcagactgaaggtctacggaggtggcagaccaaaagtgtctattgaattctccaaaacttttacctttatactttactttcttcatgctccttggagacttctccctcccacaaactgttcaccatcctctgcctccctaagaagcagtatcgtgaagtaggtataaacagggggtctgaagtcaggcaagayctgtgttattagtctcggctccaatatttactagcgatgtgattctgacattattcatcacctctgggcttcagtttccccatccatgaaatggagagaataacagtacccacctcataagtgtgtattgcagatgaaatgaagggggaaaggccacaaatagacaaggagaaaccttacatgcatattgctaagagaaagaagtcagcctgaaaatgctacatctagtatgattccaactatatgacattctgaaaaaagaccgagccgggcacagtggctcacgcctgtaatcccagc

SEQ ID NO: 117900 - DNA, 601 bp, Human
gatagggtctccctatgttgctcaggctggtctcaaactcttgagctgaagggatccttccaccttggcctcctagagtgctgggattacaggtgtgagccaccatgcctggcctaaagtgcatccatgttttgtgctaagacctggaaccacttctgaatataaccaactccttgccctgtgcattttccactctaccccatgcttatgttctagtccctatttcacattgccctgcactgaaaggtcattttcttttttggaagaataaatgctgcagtgacatacaacacaacattgwtgttaataggccatagtgtctcagggataatgaaggcataaaattaaatggtgagccagctgttggattggaatactcaatacctgtctggtctggagtgttttagaggccatggcaagtgagcctgacaaactgggcttgatgggaaagaaagcaaaggaagcattttccatttcccttaattcatcctagaagcagtgcacatgggaacaggagttgttaatctcagtaagggtcccggtgaaggattctgattgtattcgtcaggggagaggcttgatgtctccctaaaccgtcgtc

SEQ ID NO: 117901 - DNA, 601 bp, Human
ttcttggggtcagggagtcataaatgggagctgagcaagtgcctgagtggccactaaattctcctcattcctttatagatgagtaaatcaaccccaaaggcggtgagatgctgacacaagagtgcatccatgttttggttttgtttgttcttaagacaggatcttattctgttgtccaggctggagtgcagtggcacgatcggggctcctgcagcctcgacctcaccagcttaagtaatcctcccacttcagcctcctgaacagctgggacaacaggtgagagtcatcatgcccagctaatttttttttttttttttggtagagatagggtctccctatgttgctcaggctggtctcaaactcttgagctgaagggatccttccaccttggcctcctagagtgctgggattacaggtgtgagccaccatgcctggcctaaagtgcatccatgttttgtgctaagacctggaaccacttctgaatataaccaactccttgccctgtgcattttccactctaccccatgcttatgttctagtccctatttcacattgccctgcactgaaaggtcattttcttttttggaagaataaatgctgc

SEQ ID NO: 117902 - DNA, 601 bp, Human
cagtgtgtgtgttgtcagtcttccaagaataagaactggaggaaaacaaagaggcaagctccccttcctcttcttggggtcagggagtcataaatgggagctgagcaagtgcctgagtggccactaaattctcctcattcctttatagatgagtaaatcaaccccaaaggcggtgagatgctgacacaagagtgcatccatgttttggttttgtttgttcttaagacaggatcttattctgttgtccaggctggagtgcagtggcacgatcggggctcctgcagcctcgacctcaccagcytaagtaatcctcccacttcagcctcctgaacagctgggacaacaggtgagagtcatcatgcccagctaatttttttttttttttttggtagagatagggtctccctatgttgctcaggctggtctcaaactcttgagctgaagggatccttccaccttggcctcctagagtgctgggattacaggtgtgagccaccatgcctggcctaaagtgcatccatgttttgtgctaagacctggaaccacttctgaatataaccaactccttgccctgtgcattttccactctaccccatgctta

SEQ ID NO: 117903 - DNA, 601 bp, Human
tctgccttctgtgctctgcacacgtcctttgcagggcatctgttgctcccctttatcttgtggaagtgcagtgtgtgtgttgtcagtcttccaagaataagaactggaggaaaacaaagaggcaagctccccttcctcttcttggggtcagggagtcataaatgggagctgagcaagtgcctgagtggccactaaattctcctcattcctttatagatgagtaaatcaaccccaaaggcggtgagatgctgacacaagagtgcatccatgttttggttttgtttgttcttaagacaggatsttattctgttgtccaggctggagtgcagtggcacgatcggggctcctgcagcctcgacctcaccagcttaagtaatcctcccacttcagcctcctgaacagctgggacaacaggtgagagtcatcatgcccagctaatttttttttttttttttggtagagatagggtctccctatgttgctcaggctggtctcaaactcttgagctgaagggatccttccaccttggcctcctagagtgctgggattacaggtgtgagccaccatgcctggcctaaagtgcatccatgttttgtgctaa

SEQ ID NO: 117904 - DNA, 601 bp, Human
tccaactcctgaccttgggtgatccacccacttcggcctcccaaagtgctgggattacaggcgtgagcccccatgactgaccttttttttttaagtgatcactaaaaaatcaaactaacaatcaattttccccttcctgtctagttgattattactgacccaagcaggtaagtttttctttggaccatctcttctaaaatttcacaatgatcttgcccatcgacctcctaaaaccatctgatgactatattcccaggccagctcctctctccttagaaatgctaatagtattctaacaccmacacgattcctacacaggtctctttaattctgtggcactttctctctaccactctgctctgcctttctggaagacagtttactgacctctgtaataaaggatagataatcagaatgcaaaatggccccacagcctctttacaacacctggatcagacctttcaaagcagtgcttactttccatcctggaaataacctgggtccttagcagtgtgagagcctggaaaaggagctcttgaaccatgtttgcccaagactggacagcgggcacacttaccagtgtgcttcctgctgtgcatct

SEQ ID NO: 117905 - DNA, 601 bp, Human
tgtcttggaagttggatgaagaagatcaactgaagtttcctttttagtgaggaggagtggagagtcagacttgaaagcagttcacacactgtgctgcctgggacactgaacggtccccgagggagacccctcaaagcgccagctggagtttggtcatgtttctctgatgcatgttgtgatggcggactaattcatctgaccgggcaaactttttctgacaacttggccaccgacagctgaagggcttttcacctgttgacacaattgccagtcagagacacttgcaacaaagagacaggcrcaagttcaactatcaaggcccgagtgaagtcatcacaaggcacccactctgaatttcccatcattctgtccctgagctaaccaactgagctcatttcccaggcagccttgaaacagcagcacctcttggggctttaaggatcgaaatattgtaaaaagttatattcttaggtcagaaaacttggaaagtgggagataaagaatgagtcaagttgggggaaatgtctgagcaattcataattaaggggaaaaacgtttgtttcagtctctgctgatagaatgttttgtgaactgtgtaaat

SEQ ID NO: 117906 - DNA, 601 bp, Human; identical to SEQ ID NO: 117854

SEQ ID NO: 117907 - DNA, 601 bp, Human; identical to SEQ ID NO: 117855

SEQ ID NO: 117908 - DNA, 601 bp, Human; identical to SEQ ID NO: 117856

SEQ ID NO: 117909 - DNA, 601 bp, Human; identical to SEQ ID NO: 117857

SEQ ID NO: 117910 - DNA, 601 bp, Human; identical to SEQ ID NO: 117858

SEQ ID NO: 117911 - DNA, 601 bp, Human; identical to SEQ ID NO: 117859

SEQ ID NO: 117912 - DNA, 601 bp, Human; identical to SEQ ID NO: 117860

SEQ ID NO: 117913 - DNA, 601 bp, Human; identical to SEQ ID NO: 117861

SEQ ID NO: 117914 - DNA, 601 bp, Human; identical to SEQ ID NO: 117862

SEQ ID NO: 117915 - DNA, 601 bp, Human; identical to SEQ ID NO: 117863

SEQ ID NO: 117916 - DNA, 601 bp, Human; identical to SEQ ID NO: 117864

SEQ ID NO: 117917 - DNA, 601 bp, Human; identical to SEQ ID NO: 117865

SEQ ID NO: 117918 - DNA, 601 bp, Human; identical to SEQ ID NO: 117866

SEQ ID NO: 117919 - DNA, 601 bp, Human; identical to SEQ ID NO: 117867

SEQ ID NO: 117920 - DNA, 601 bp, Human; identical to SEQ ID NO: 117868

SEQ ID NO: 117921 - DNA, 601 bp, Human; identical to SEQ ID NO: 117869

SEQ ID NO: 117922 - DNA, 601 bp, Human; identical to SEQ ID NO: 117870

SEQ ID NO: 117923 - DNA, 601 bp, Human; identical to SEQ ID NO: 117871

SEQ ID NO: 117924 - DNA, 601 bp, Human; identical to SEQ ID NO: 117872

SEQ ID NO: 117925 - DNA, 601 bp, Human; identical to SEQ ID NO: 117873

SEQ ID NO: 117926 - DNA, 601 bp, Human; identical to SEQ ID NO: 117874

SEQ ID NO: 117927 - DNA, 601 bp, Human; identical to SEQ ID NO: 117875

SEQ ID NO: 117928 - DNA, 601 bp, Human; identical to SEQ ID NO: 117876

SEQ ID NO: 117929 - DNA, 601 bp, Human; identical to SEQ ID NO: 117877

SEQ ID NO: 117930 - DNA, 601 bp, Human; identical to SEQ ID NO: 117878

SEQ ID NO: 117931 - DNA, 601 bp, Human; identical to SEQ ID NO: 117879

SEQ ID NO: 117932 - DNA, 601 bp, Human; identical to SEQ ID NO: 117880

SEQ ID NO: 117933 - DNA, 601 bp, Human; identical to SEQ ID NO: 117881

SEQ ID NO: 117934 - DNA, 601 bp, Human; identical to SEQ ID NO: 117882

SEQ ID NO: 117935 - DNA, 601 bp, Human; identical to SEQ ID NO: 117883

SEQ ID NO: 117936 - DNA, 601 bp, Human; identical to SEQ ID NO: 117884

SEQ ID NO: 117937 - DNA, 601 bp, Human; identical to SEQ ID NO: 117885

SEQ ID NO: 117938 - DNA, 601 bp, Human; identical to SEQ ID NO: 117886

SEQ ID NO: 117939 - DNA, 601 bp, Human; identical to SEQ ID NO: 117887

SEQ ID NO: 117940 - DNA, 601 bp, Human; identical to SEQ ID NO: 117888

SEQ ID NO: 117941 - DNA, 601 bp, Human; identical to SEQ ID NO: 117889

SEQ ID NO: 117942 - DNA, 601 bp, Human; identical to SEQ ID NO: 117890

SEQ ID NO: 117943 - DNA, 601 bp, Human; identical to SEQ ID NO: 117891

SEQ ID NO: 117944 - DNA, 601 bp, Human; identical to SEQ ID NO: 117892

SEQ ID NO: 117945 - DNA, 601 bp, Human; identical to SEQ ID NO: 117893

SEQ ID NO: 117946 - DNA, 601 bp, Human; identical to SEQ ID NO: 117894

SEQ ID NO: 117947 - DNA, 601 bp, Human; identical to SEQ ID NO: 117895

SEQ ID NO: 117948 - DNA, 601 bp, Human; identical to SEQ ID NO: 117896

SEQ ID NO: 117949 - DNA, 601 bp, Human; identical to SEQ ID NO: 117897

SEQ ID NO: 117950 - DNA, 601 bp, Human; identical to SEQ ID NO: 117898

SEQ ID NO: 117951 - DNA, 601 bp, Human; identical to SEQ ID NO: 117899

SEQ ID NO: 117952 - DNA, 601 bp, Human; identical to SEQ ID NO: 117900

SEQ ID NO: 117953 - DNA, 601 bp, Human; identical to SEQ ID NO: 117901

SEQ ID NO: 117954 - DNA, 601 bp, Human; identical to SEQ ID NO: 117902

SEQ ID NO: 117955 - DNA, 601 bp, Human; identical to SEQ ID NO: 117903

SEQ ID NO: 117956 - DNA, 601 bp, Human; identical to SEQ ID NO: 117904

SEQ ID NO: 117957 - DNA, 601 bp, Human; identical to SEQ ID NO: 117905

SEQ ID NO: 117958 - DNA, 601 bp, Human; identical to SEQ ID NO: 117854

SEQ ID NO: 117959 - DNA, 601 bp, Human; identical to SEQ ID NO: 117855

SEQ ID NO: 117960 - DNA, 601 bp, Human; identical to SEQ ID NO: 117856

SEQ ID NO: 117961 - DNA, 601 bp, Human; identical to SEQ ID NO: 117857

SEQ ID NO: 117962 - DNA, 601 bp, Human; identical to SEQ ID NO: 117858

SEQ ID NO: 117963 - DNA, 601 bp, Human; identical to SEQ ID NO: 117859

SEQ ID NO: 117964 - DNA, 601 bp, Human; identical to SEQ ID NO: 117860

SEQ ID NO: 117965 - DNA, 601 bp, Human; identical to SEQ ID NO: 117861

SEQ ID NO: 117966 - DNA, 601 bp, Human; identical to SEQ ID NO: 117862

SEQ ID NO: 117967 - DNA, 601 bp, Human; identical to SEQ ID NO: 117863

SEQ ID NO: 117968 - DNA, 601 bp, Human; identical to SEQ ID NO: 117864

SEQ ID NO: 117969 - DNA, 601 bp, Human; identical to SEQ ID NO: 117865

SEQ ID NO: 117970 - DNA, 601 bp, Human; identical to SEQ ID NO: 117866

SEQ ID NO: 117971 - DNA, 601 bp, Human; identical to SEQ ID NO: 117867

SEQ ID NO: 117972 - DNA, 601 bp, Human; identical to SEQ ID NO: 117868

SEQ ID NO: 117973 - DNA, 601 bp, Human; identical to SEQ ID NO: 117869

SEQ ID NO: 117974 - DNA, 601 bp, Human; identical to SEQ ID NO: 117870

SEQ ID NO: 117975 - DNA, 601 bp, Human; identical to SEQ ID NO: 117871

SEQ ID NO: 117976 - DNA, 601 bp, Human; identical to SEQ ID NO: 117872

SEQ ID NO: 117977 - DNA, 601 bp, Human; identical to SEQ ID NO: 117873

SEQ ID NO: 117978 - DNA, 601 bp, Human; identical to SEQ ID NO: 117874

SEQ ID NO: 117979 - DNA, 601 bp, Human; identical to SEQ ID NO: 117875

SEQ ID NO: 117980 - DNA, 601 bp, Human; identical to SEQ ID NO: 117876

SEQ ID NO: 117981 - DNA, 601 bp, Human; identical to SEQ ID NO: 117877

SEQ ID NO: 117982 - DNA, 601 bp, Human; identical to SEQ ID NO: 117878

SEQ ID NO: 117983 - DNA, 601 bp, Human; identical to SEQ ID NO: 117879

SEQ ID NO: 117984 - DNA, 601 bp, Human; identical to SEQ ID NO: 117880

SEQ ID NO: 117985 - DNA, 601 bp, Human; identical to SEQ ID NO: 117881

SEQ ID NO: 117986 - DNA, 601 bp, Human; identical to SEQ ID NO: 117882

SEQ ID NO: 117987 - DNA, 601 bp, Human; identical to SEQ ID NO: 117883

SEQ ID NO: 117988 - DNA, 601 bp, Human; identical to SEQ ID NO: 117884

SEQ ID NO: 117989 - DNA, 601 bp, Human; identical to SEQ ID NO: 117885

SEQ ID NO: 117990 - DNA, 601 bp, Human; identical to SEQ ID NO: 117886

SEQ ID NO: 117991 - DNA, 601 bp, Human; identical to SEQ ID NO: 117887

SEQ ID NO: 117992 - DNA, 601 bp, Human; identical to SEQ ID NO: 117888

SEQ ID NO: 117993 - DNA, 601 bp, Human; identical to SEQ ID NO: 117889

SEQ ID NO: 117994 - DNA, 601 bp, Human; identical to SEQ ID NO: 117890

SEQ ID NO: 117995 - DNA, 601 bp, Human; identical to SEQ ID NO: 117891

SEQ ID NO: 117996 - DNA, 601 bp, Human; identical to SEQ ID NO: 117892

SEQ ID NO: 117997 - DNA, 601 bp, Human; identical to SEQ ID NO: 117893

SEQ ID NO: 117998 - DNA, 601 bp, Human; identical to SEQ ID NO: 117894

SEQ ID NO: 117999 - DNA, 601 bp, Human; identical to SEQ ID NO: 117895

SEQ ID NO: 118000 - DNA, 601 bp, Human; identical to SEQ ID NO: 117896

SEQ ID NO: 118001 - DNA, 601 bp, Human; identical to SEQ ID NO: 117897

SEQ ID NO: 118002 - DNA, 601 bp, Human; identical to SEQ ID NO: 117898

SEQ ID NO: 118003 - DNA, 601 bp, Human; identical to SEQ ID NO: 117899

SEQ ID NO: 118004 - DNA, 601 bp, Human; identical to SEQ ID NO: 117900

SEQ ID NO: 118005 - DNA, 601 bp, Human; identical to SEQ ID NO: 117901

SEQ ID NO: 118006 - DNA, 601 bp, Human; identical to SEQ ID NO: 117902

SEQ ID NO: 118007 - DNA, 601 bp, Human; identical to SEQ ID NO: 117903

SEQ ID NO: 118008 - DNA, 601 bp, Human; identical to SEQ ID NO: 117904

SEQ ID NO: 118009 - DNA, 601 bp, Human; identical to SEQ ID NO: 117905

SEQ ID NO: 118010 - DNA, 601 bp, Human; identical to SEQ ID NO: 117854

SEQ ID NO: 118011 - DNA, 601 bp, Human; identical to SEQ ID NO: 117855

SEQ ID NO: 118012 - DNA, 601 bp, Human; identical to SEQ ID NO: 117856

SEQ ID NO: 118013 - DNA, 601 bp, Human; identical to SEQ ID NO: 117857

SEQ ID NO: 118014 - DNA, 601 bp, Human; identical to SEQ ID NO: 117858

SEQ ID NO: 118015 - DNA, 601 bp, Human; identical to SEQ ID NO: 117859

SEQ ID NO: 118016 - DNA, 601 bp, Human; identical to SEQ ID NO: 117860

SEQ ID NO: 118017 - DNA, 601 bp, Human; identical to SEQ ID NO: 117861

SEQ ID NO: 118018 - DNA, 601 bp, Human; identical to SEQ ID NO: 117862

SEQ ID NO: 118019 - DNA, 601 bp, Human; identical to SEQ ID NO: 117863

SEQ ID NO: 118020 - DNA, 601 bp, Human; identical to SEQ ID NO: 117864

SEQ ID NO: 118021 - DNA, 601 bp, Human; identical to SEQ ID NO: 117865

SEQ ID NO: 118022 - DNA, 601 bp, Human; identical to SEQ ID NO: 117866

SEQ ID NO: 118023 - DNA, 601 bp, Human; identical to SEQ ID NO: 117867

SEQ ID NO: 118024 - DNA, 601 bp, Human; identical to SEQ ID NO: 117868

SEQ ID NO: 118025 - DNA, 601 bp, Human; identical to SEQ ID NO: 117869

SEQ ID NO: 118026 - DNA, 601 bp, Human; identical to SEQ ID NO: 117870

SEQ ID NO: 118027 - DNA, 601 bp, Human; identical to SEQ ID NO: 117871

SEQ ID NO: 118028 - DNA, 601 bp, Human; identical to SEQ ID NO: 117872

SEQ ID NO: 118029 - DNA, 601 bp, Human; identical to SEQ ID NO: 117873

SEQ ID NO: 118030 - DNA, 601 bp, Human; identical to SEQ ID NO: 117874

SEQ ID NO: 118031 - DNA, 601 bp, Human; identical to SEQ ID NO: 117875

SEQ ID NO: 118032 - DNA, 601 bp, Human; identical to SEQ ID NO: 117876

SEQ ID NO: 118033 - DNA, 601 bp, Human; identical to SEQ ID NO: 117877

SEQ ID NO: 118034 - DNA, 601 bp, Human; identical to SEQ ID NO: 117878

SEQ ID NO: 118035 - DNA, 601 bp, Human; identical to SEQ ID NO: 117879

SEQ ID NO: 118036 - DNA, 601 bp, Human; identical to SEQ ID NO: 117880

SEQ ID NO: 118037 - DNA, 601 bp, Human; identical to SEQ ID NO: 117881

SEQ ID NO: 118038 - DNA, 601 bp, Human; identical to SEQ ID NO: 117882

SEQ ID NO: 118039 - DNA, 601 bp, Human; identical to SEQ ID NO: 117883

SEQ ID NO: 118040 - DNA, 601 bp, Human; identical to SEQ ID NO: 117884

SEQ ID NO: 118041 - DNA, 601 bp, Human; identical to SEQ ID NO: 117885

SEQ ID NO: 118042 - DNA, 601 bp, Human; identical to SEQ ID NO: 117886

SEQ ID NO: 118043 - DNA, 601 bp, Human; identical to SEQ ID NO: 117887

SEQ ID NO: 118044 - DNA, 601 bp, Human; identical to SEQ ID NO: 117888

SEQ ID NO: 118045 - DNA, 601 bp, Human; identical to SEQ ID NO: 117889

SEQ ID NO: 118046 - DNA, 601 bp, Human; identical to SEQ ID NO: 117890

SEQ ID NO: 118047 - DNA, 601 bp, Human; identical to SEQ ID NO: 117891

SEQ ID NO: 118048 - DNA, 601 bp, Human; identical to SEQ ID NO: 117892

SEQ ID NO: 118049 - DNA, 601 bp, Human; identical to SEQ ID NO: 117893

SEQ ID NO: 118050 - DNA, 601 bp, Human; identical to SEQ ID NO: 117894

SEQ ID NO: 118051 - DNA, 601 bp, Human; identical to SEQ ID NO: 117895

SEQ ID NO: 118052 - DNA, 601 bp, Human; identical to SEQ ID NO: 117896

SEQ ID NO: 118053 - DNA, 601 bp, Human; identical to SEQ ID NO: 117897

SEQ ID NO: 118054 - DNA, 601 bp, Human; identical to SEQ ID NO: 117898

SEQ ID NO: 118055 - DNA, 601 bp, Human; identical to SEQ ID NO: 117899

SEQ ID NO: 118056 - DNA, 601 bp, Human; identical to SEQ ID NO: 117900

SEQ ID NO: 118057 - DNA, 601 bp, Human; identical to SEQ ID NO: 117901

SEQ ID NO: 118058 - DNA, 601 bp, Human; identical to SEQ ID NO: 117902

SEQ ID NO: 118059 - DNA, 601 bp, Human; identical to SEQ ID NO: 117903

SEQ ID NO: 118060 - DNA, 601 bp, Human; identical to SEQ ID NO: 117904

SEQ ID NO: 118061 - DNA, 601 bp, Human; identical to SEQ ID NO: 117905

SEQ ID NO: 118062 - DNA, 601 bp, Human
accatgcaaccttctcaccatcacccaaccacttcagcctcacactcccatggtggaggagacagcagcatgatgatgatggtgagtgccataggaggggcaatgcaggccctttcccacccacttgggtaatagaaataatggaattttagtactggaagcttattatctttaaaggtcagtttaccagtgaggataactaaagcagacccaagcaagtcaagtcatttgctccagattatgtggcaagctacttacagagtcacaccagaaccaagattttaggcttctttctttggtrgtcccttctgaaatcgactcttttctgaattaggggttctggtctttatgccttgggtggaaaagagaaaaagacaaaagttggccaggcacagtggctcatgcctgtaatcccaacactttgggaggccaaggcaggtggatcacaaggtcaggagatcgagaccatcctagctaacacggtgaaaccccatctctactaaaaatacaaaaaattagctgggcatgatggcattcgcctgtagtcccagctacttgggaggctgaggcaggagaatcgcttgaacccaggaggtggagg

SEQ ID NO: 118063 - DNA, 601 bp, Human
gcatgatgatgatggtgagtgccataggaggggcaatgcaggccctttcccacccacttgggtaatagaaataatggaattttagtactggaagcttattatctttaaaggtcagtttaccagtgaggataactaaagcagacccaagcaagtcaagtcatttgctccagattatgtggcaagctacttacagagtcacaccagaaccaagattttaggcttctttctttggtggtcccttctgaaatcgactcttttctgaattaggggttctggtctttatgccttgggtggaaaagaraaaaagacaaaagttggccaggcacagtggctcatgcctgtaatcccaacactttgggaggccaaggcaggtggatcacaaggtcaggagatcgagaccatcctagctaacacggtgaaaccccatctctactaaaaatacaaaaaattagctgggcatgatggcattcgcctgtagtcccagctacttgggaggctgaggcaggagaatcgcttgaacccaggaggtggaggttgtagtgagccgagatctcgccactgcattccagcctgggctacagagcgagaatccgtatcaaaa

SEQ ID NO: 118064 - DNA, 601 bp, Human
cagaagggatcacaattccaagtgtgagactagctggcaatgggttttccagaaaggggtcctgggttctcccagctccccactgagccttgttccaaagcttacagtccgcagtgtcactgccaccttagcgctgtggaagcttgaaccagctctgcggtgaggtcttgggtctccatgagattccagcctgggatagggagcatgaatatgagaggcaaccactggaccagctgcttggtcctcaccacctcctgcttctgccaatcagtgtggggaaatctcaacagtaaggtggctyatattccctgcctggcagcctcagagcagagagaagagccttgataccagggcaacatcagggaccctggagctagggctccaatatctcatccaaacagggtcagtgctttgtggtggctatggaggggaggggctgcgtgtaaggtatattctagcacggctcaactccaagcattctctttctttgtctatgtatgtacagataattacatggccgatttgcttatcgctggccaaaattaatctttcttttaagaagtgccagctgggtcattaagacagctcagcctgcatgcag

SEQ ID NO: 118065 - DNA, 601 bp, Human
gggcattctgactcctgactccttccaacctgtctccccgttccttctaaaaggccccacttccaaatatttggcactgtcctaacccttgaggttctcccagagacccgcagtctccctcctgccccgtgtttccacggcccctttgcgcagcatcatttagaggaagtacaatgaagtgccagtagcaataactgccccggccctcgctttcatgtgcttgtaaagttgtttggcaggaactgggacttggaaaggagacatgactttgtcagagggcttggggctgggcatggtgtgrgtggcgaaggggagaaggaggaaaggggaaggaaaggagctcttgttgccccattctggggagtggtggactctggacaaccacgaggaaactttggaaaggagcaaggctttgaggaggagtccagtctttgtatgggaaagcaaaaagtggagaaatggccaaatgtagttaagtgacattggacccagaaactctgagttggggaacagatatcttgaattcggggtcttgtgcaggaggaagaaagtggcccttggtggaggccaggggggatgagtccttcatgcacatgcatct

SEQ ID NO: 118066 - DNA, 601 bp, Human
agaactagaaataccatttgacccagccatcccattactgggtatatacccaaaggactacaaatcatgctgctataaagacacatgcacatgtatgtttattgtggcattattcacaatagcaaagacttggaaccaacccaaatgtccaacaatgatagactgggtgaggggatctttgcttgggaattgcatgcctggtgttgagaaagaggagagcgtctgagagccctgggtcttagggctggcacacacctttctgctcccttctctctaattgagcattagagactccgccccytgctgggagttagaactttagctgtgttttcccatgtgaaggagcaaagaggcaaagcttcatctctgttggggctagcatcaactaattcaggtattccccatttacacattggacatctacttgctgcaaaggcatggtgacaagtccttgtgtgggaggctggcagccagtaggaaaatgttccatttgttttttcccaaatttccccacaaaggaggggatgctggacagcatgaaattcttagttcatgacagattcccttccattcattcaggaactatttcctgactcattgt

SEQ ID NO: 118067 - DNA, 601 bp, Human
ggtaccatatggtcctgtgtaaagcagggtcctaagtcctgagtctctaggaaatactgctcagtgagcactgactctatactagatgtgaagccgggggtagcacaggatatcttatctaagcctcccaacagcccaatacacctagcactctctttaactccattttctagataaagagatcgagacttgtggagatggcatgacttgccccaggatccagtggtggagttgggatttccgcattatctaacatcctcccatgttagactccaatgcttatgctccttcaattcattaygtgtctggaggactttggaagctatacgtggctctcccacactacctgtcccctgtggccagcataagtgaactcttgcatgggtggcttctctctccatccccggcaggctgtggactcttggctgccctgccctggcctgtctctccccaggtttggccacagatatcagagatgccaaccaagttatttgtaactaaaataaatcacatcccttatcagagtccagctgccctcccagatatgctctgatttacaggcttggaataaagagagaggtggttgcttgtctacaggaca

SEQ ID NO: 118068 - DNA, 601 bp, Human
gaccaggcaagcatttcacatgcacagacccagagacccactcctcacatgctcattagtaggttgtgcgaccctgggtaggaggctgacatgggtcttgaactgaaacccagtgtgtggctctaggtgacatgtggccacccaagtgaggtttcggatccacctgcagtgtcagatgcttcaaggctggggtcccctgatggagaggaggtggttggagatcacctgggcctcctcagcactgcctcctggctggggctggggctggggataagagagtaactgcaattgtgcttccccrgcaccttcgctttaggtcactccaccgaagagcctgaaagggaagtggttcttgcgaaagaatgagctgaagcaggtggcagatgctaccaggcaccgtgtagttttcaaaggggatctttttctgcctcagagagaaattctggggtttgcacagcaagaaaccgatgactcaatttcctttgtgtccctgctttaatgggaaggttgtaggcgttctttagaatggcagggtaggttgataccttctaccttaaatttgaatcccacttttcactcacttagcaggttgaattttttt

SEQ ID NO: 118069 - DNA, 601 bp, Human
ctctccattgctcaattgccccactgggtgacgtaccaagataagccacatgtttgattcttgtttgctggatgtggacatatgcacattgcaggtatgcctataagtacatgcctgaaggatctatgtgtgtggtgggaattggtgatgccaaagaatgctaaagactttcatgccccttaaaggggaaaataaccacaacaaaacaaattccaatgtatcttctcctgtcttctgcagcactgggggagtcccctgataacagggatcatgtcacattcatttttgtgggcccagatcycagtaatattgacccataactgttgaactgcaatgaatgtctagaatataaaagtcatgatatctatatatatggaagcatgctgtcagtatgggctaaggtgcaaatacatttatgtgtaagtgagaaccatggtgatggctgtgttgctcaggacagggctgacttggctggctgactgcccaccacaggcctcatgtttggtctaccccaaacagtgagctcacccatctgtttgtttgcggctttggtggctgcctgctgtgaccgctggggacatctggctaaagacagggttac

SEQ ID NO: 118070 - DNA, 601 bp, Human
gatagggctgaaagggatgtgaattgagttgtttgttcattatcacttcattatttgtcacctggatgaaaggtaaaggtggctgattagtgtttctccatcagctagaactttgactgggaaatgagccaatcaaatagcagcaaaatatttgccctcaccttacaggcccttggttccagggtcttctctccaccggctagaatggatgagggagggagagaaactctgagaaaagaggctgtcaggagtagggctgtacatatccagggcacaaggaatttggcaaaagctggaagtrtactatagcccttctctccagccctagcctaaaccagatgaccaggcttctatttggcccagcatgtgaccatcccatcagggagcaagagagtttcctctgggtacccctcactgagaaaaaagccacccaggaagggaggaggcaaggccccctgggaacatctggctcagtccacaggaagggatgcaggccttttcctgggaatgaggactcatcccatattccagcccccttcccccaacttttttttttttcaattttagtgcatctctttacacttaacaggtctgcagtgac

SEQ ID NO: 118071 - DNA, 601 bp, Human
aggagtagggctgtacatatccagggcacaaggaatttggcaaaagctggaagtatactatagcccttctctccagccctagcctaaaccagatgaccaggcttctatttggcccagcatgtgaccatcccatcagggagcaagagagtttcctctgggtacccctcactgagaaaaaagccacccaggaagggaggaggcaaggccccctgggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcctttccaagatagtagcacgataacagtaaagcccctttgcaagtgttcactattatgcacattaagatgccagggagagggctgggaaaggtggctcacacctgtaatcccagcactttgggaggccgaggcaggcggatgacctgaggtcgggagttcgagaccagcctgaccaacatggagaaacccc

SEQ ID NO: 118072 - DNA, 601 bp, Human
gtcaaaaaaaattgatgcctgatttgtattaaatgtcaaaagtgaattattaatccatgccagaaataaacatatggacccaattacactctaactccaatgggcaagagtgttgtagggacaaagtgctttgcccgtagtacttcatagaatcctctagaccatgtggaaggtgagcagatgaagcagctctggccagagaagttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcctcaagcaacccctgtaacttgttggcacaaaattaaccacaatattcagacaaagcagtacttacagggtgagtgctagtatcctatgcaactagggtagcctgagaatctaggggaaaaaaagctagaccaaacaaaagattatatataatctttccccaaatcaaggcactgagcaaggcaggcctgagagatg

SEQ ID NO: 118073 - DNA, 601 bp, Human
gacttaatgagcatttggaaaccataaggcccacagcaacctgacctttgacttgcccagactctctgagcaattttgtgagttgagtcaacaatcaatggttttcaaattattcaattgttcactcaacgcatactagttgaacaccaatatctgtgctctgctaggcactggggataccactgtagacaagagaggcatagtctcctctctcctggaacttacagtctatctggaagacagacagtaaacaactaatgatgcctttgtttaattacacttgtggtaagtgctatgaagragaagcactggatcttgtgagagcataatagggagatctcatctgatttaaagcaccagggaaagcctcccaggacctgttggatgaatagcagtaaccatgtctccaggatccccacaattccttgaggacccttgttgtcagacttctcagagctgtaccagccctctcactgtctcaccattgggtcttctgagtaagaaagcaagaaaaaaaattttactcctcaaaattctgaaagcaagtggtttatcatgtctgccctgtaatagtggtgggaagaaaatcatgagaacctct

SEQ ID NO: 118074 - DNA, 601 bp, Human
ttcactcaacgcatactagttgaacaccaatatctgtgctctgctaggcactggggataccactgtagacaagagaggcatagtctcctctctcctggaacttacagtctatctggaagacagacagtaaacaactaatgatgcctttgtttaattacacttgtggtaagtgctatgaaggagaagcactggatcttgtgagagcataatagggagatctcatctgatttaaagcaccagggaaagcctcccaggacctgttggatgaatagcagtaaccatgtctccaggatccccacarttccttgaggacccttgttgtcagacttctcagagctgtaccagccctctcactgtctcaccattgggtcttctgagtaagaaagcaagaaaaaaaattttactcctcaaaattctgaaagcaagtggtttatcatgtctgccctgtaatagtggtgggaagaaaatcatgagaacctctaagctgactcaggattttagaagcacacatttggggagaagggaaacaaaaattctggagaagcaaaaagtgtcatatggtatagaagttattttaagctactggggaaaattcataatt

SEQ ID NO: 118075 - DNA, 601 bp, Human
aatagccagtcttctgcacacttgagtactttattattagaaactcattacttgcaacccatctcagcactgttggagctacaccatgcatgaggaccgctgctctagagtcatccattaaaaaagaattcctacgaacctgaatgagcatttctttctctaaattatgagatgatgaccctcaagggaaatggccgtcttcccttttctactgcactcttagagtgcattaatgtgtgtgaagtgttttcggttccattatctaaagcagccctcatattaacatcgtggttggcattaytggcctcctgtatgggatgaaagtttaatgacttctgcaaggttatgaaaggtcaagatcacagctaattagtgcaaattcaggatttgaattctagtttctaccccagagctgatgtccatgtcaccatggacatcatttgctcccaatatacctgatttactttcaaggggtctggaattgactattggattttatattaaaaattgctctttcataggcaggaaaaagtccttcctaatagtttgagtccaaagcttaagggtctagcatctcaactttttaatgaacccaaaaatg

SEQ ID NO: 118076 - DNA, 601 bp, Human
gagcttggctccaactacacctcatgtgtctgttacatttatcatgctgtgttgtcaacttgtttaatgtctgtcagtggctcatgcctgtaattcagcactttgggagcctgaggcaaaagacttactttgacagcagaggtttgcagaggttgctgggcaacatagtgagaccctgtctctacaaaaatatatttttaattggctgtgcatggtggcatgcacctgtagtcccagctgctcaggaggctgaggtgggaggagtgcttgggcccaggagtttgaggttacactgagctargattgtgctactgcactccagcctgggtgatggagccagaccctgtctctattaaaaattaggaaaagaaatagcctgtctactctattggtccataacctctatcgagacagtgaccttgtctgctttattcaatgcctggatcttttcctagcacagtgcccagcacatggagacactgaatttggattctcctttttgaagtccccatatccacttcagtattggggtgattttgatgggattgtgacttaccatggtggatgcatcctgtgagttccaaactcaacttcttaaaaa

SEQ ID NO: 118077 - DNA, 601 bp, Human
ctattaaaaattaggaaaagaaatagcctgtctactctattggtccataacctctatcgagacagtgaccttgtctgctttattcaatgcctggatcttttcctagcacagtgcccagcacatggagacactgaatttggattctcctttttgaagtccccatatccacttcagtattggggtgattttgatgggattgtgacttaccatggtggatgcatcctgtgagttccaaactcaacttcttaaaaaaccttgtctatcatctatccatctatctgtctgtctgtctatctatctrtctatctatctatctatctatctatctatctatctatcatctgtctgtattctatgttccatctatcatctatctgtcatatatctatctctatctattaattatctctatctttatctatttatatctatcatctatctgccatatatctatctctatctcttaattgtctctatctttatctatttatatctatcatctatctatatctatcatcttttaacctatctgtttctattggaataagagacaagtgcttgaaaagcagaggagagtcaatacacaggccacatcttctct

SEQ ID NO: 118078 - DNA, 601 bp, Human
taaaaattaggaaaagaaatagcctgtctactctattggtccataacctctatcgagacagtgaccttgtctgctttattcaatgcctggatcttttcctagcacagtgcccagcacatggagacactgaatttggattctcctttttgaagtccccatatccacttcagtattggggtgattttgatgggattgtgacttaccatggtggatgcatcctgtgagttccaaactcaacttcttaaaaaaccttgtctatcatctatccatctatctgtctgtctgtctatctatctatctrtctatctatctatctatctatctatctatctatcatctgtctgtattctatgttccatctatcatctatctgtcatatatctatctctatctattaattatctctatctttatctatttatatctatcatctatctgccatatatctatctctatctcttaattgtctctatctttatctatttatatctatcatctatctatatctatcatcttttaacctatctgtttctattggaataagagacaagtgcttgaaaagcagaggagagtcaatacacaggccacatcttctctcact

SEQ ID NO: 118079 - DNA, 601 bp, Human
ctctatctcttaattgtctctatctttatctatttatatctatcatctatctatatctatcatcttttaacctatctgtttctattggaataagagacaagtgcttgaaaagcagaggagagtcaatacacaggccacatcttctctcactccctccttcctcctcatagctgtgagccaccccagtccctgtacctgcttccttggctggcatcatctaagaaatcatctcttccacagtttcctgcaagggcatcaccccaagggaagctgaacacatgcaacatctgcccactcagggtaagtgtgagggataaggaggaaacatttttcctctagagacaggactgttggggcaagggctggggaagcaagacatggatactccaggctacttcttgctggggctgaggggagtgctcggtgtggctcccctctgggacgtgtttagggcagctctctcgcctctgaaacaagcctcatcagatcatccccaggcttccttccgcatagtttctgatgatataggaaaggagcccgattatctgtttgagcttcctgttctttgtattgtttggaaggctaaagtcaacagccactt

SEQ ID NO: 118080 - DNA, 601 bp, Human
gaaacatttttcctctagagacaggactgttggggcaagggctggggaagcaagacatggatactccaggctacttcttgctggggctgaggggagtgctcggtgtggctcccctctgggacgtgtttagggcagctctctcgcctctgaaacaagcctcatcagatcatccccaggcttccttccgcatagtttctgatgatataggaaaggagcccgattatctgtttgagcttcctgttctttgtattgtttggaaggctaaagtcaacagccacttttgtattctgcattgtttgcrttgttaaaaactctggaaaactcatctggtttcttctccaaaagtagcttcccagagccctgggagacactcagaaataagatccttttcaaataggccagcagggaccagggtctctcagaaccagctttcctatcttcttccaaaggccggaattgagaaggtttactccagcccacataattgagtctctgggctgtcaaggacgcattggggagtttgcttctggtgtgctgggtgcttagaaagccgtatgaattgcagagatagagttgggttccagttctgccagtcaccaat

SEQ ID NO: 118081 - DNA, 601 bp, Human
tgaataaggcatggtcccagtggaacccactttggttatatgggttaggacacttgaggcaggatcctccttagaatggtgttttataaagtctctctttctctttctctctctctcatctctctccaatctatcctctctatcaagagagaacacatgtaatgtagagtgagagcccatgtattggataattaggcttctggctcctaattatcaggaagcctggaggtcttgagtggttgtaaccaaggatactgaaagtggttgaccagttaataaagaattaagttagagtaagagrcactttacttttaagctgcctttaatacactttaatctttgagatgattggctaatatctgttaagtaccaggctctttgcagagagtcaggtcctttgctaaatgatttaggtatatttcttcatctaatactcaaaaagcaccccataaggaaggcattacttttattttactgatgaagagactgaggcttaaaggttaagaaaacatagcatgcataacatcccacaagagctcaagccaggacttggacccaagtctttcttggatctttccgatccaagccatatggttactgc

SEQ ID NO: 118082 - DNA, 601 bp, Human
ctgttaagtaccaggctctttgcagagagtcaggtcctttgctaaatgatttaggtatatttcttcatctaatactcaaaaagcaccccataaggaaggcattacttttattttactgatgaagagactgaggcttaaaggttaagaaaacatagcatgcataacatcccacaagagctcaagccaggacttggacccaagtctttcttggatctttccgatccaagccatatggttactgcaatctcacaatacaatgagggtaaatccttgcaatcaccagttaccagcaattgtgaarcaatggatggcatagatgtcagggggtcaggagagccttgcaagcgttcagagggcttgggagtggacacatcacagttgcactctgctgggcagcgctgtaagtctctgattggattttgccttgaattttttctggtcaagactcagaaaggatggatgtagcttcacttacaccaattctacccagcttgtgacccaaatggaactcttatcccttaagccaggtcattcagttgttgtagcctttgccttccaagtttcccttgtctaccctactgagtctgaattctaaggacat

SEQ ID NO: 118083 - DNA, 601 bp, Human
ggtattagcaaattctaacccaagatgttaaaactatctgagaagaggcatgattctgcttcttgtctgtaccctcctaaagtcaaggtgcagcaaggagagagacatttgcatgtggcccctgagaaagaagagatttgtctgcctcaccccctgctggtgcaaacttgcacctctctcagcctcagttttcttatgtgtatcaagtttcaatgatcgcaatagtacttatctcatgtgactactgtgggattgaaacgagatagttcatgtgaagtaccgagcacagagcctggcacasagtaggtactctattagtgttaatatcactggaaaacccagctgggggctcagcagtagaagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctgagtggattgtactcagcctcacttgttgcatctgtgaaat

SEQ ID NO: 118084 - DNA, 601 bp, Human
tgcaaacttgcacctctctcagcctcagttttcttatgtgtatcaagtttcaatgatcgcaatagtacttatctcatgtgactactgtgggattgaaacgagatagttcatgtgaagtaccgagcacagagcctggcacacagtaggtactctattagtgttaatatcactggaaaacccagctgggggctcagcagtagaagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctgagtggattgtactcagcctcacttgttgcatctgtgaaatgggggtgattttttgacttctcaaggtatagcatctattaaggcacatagactacaatctgacacaaattagcagctccatacattgcagaatcttttctttttcacttaaggagatgctaaaagaggcaagaggaaagaaaatcaaatttggagatgcc

SEQ ID NO: 118085 - DNA, 601 bp, Human
ctgctgagggtggagccccaatgtgtcttaattcatatgaggtttctgagaagctttttgagattttaatactgtcccaggtatgcacatcaaccttctcacttttatcccccaagctccaaaatttcataactttttatttcatcttgggtggcaggaaggcaaggtgtgcctgggggagctacagggagttattcaaggtcacataattagcttataattaacagagtttaggctagaaccagtgcatcccactcccagatgggggcccccggcttatctcagcatgtcagcaacccawgaatcagccctgaaatatagatattacctatgagtaacagtttctcatcctacctcaactgttacgaaagtcttccctcaaactaaagctaagcagttccacaaaatgccagctatagacattagcagaaactgtatattgattaggtgatgtatcagtcattgtaactacccagaaaaaaaaatacaatgacaaaaccaagtggcccaaccttattttctacttgcaagaggaaaaaccctatttgggccccaagatgcttttttcatttcatttaccacatcctgggtttgtgctagt

SEQ ID NO: 118086 - DNA, 601 bp, Human
ttaggagacagggacagtactgttctccaaactctcaaaacaacccaagagctttctaggctgtgcattgggttgatcatttggtggccttggctgaagggccagggtaacagctaggagaacccttgggattcttctccaatgtgacaggcccctccatgttggttcagcgttgactgccatgacaggctccaggctccacggaaaaaaggcagagaaatcagggggtccagccaggcgccaagacgttggggtgccttgcatttctaagtgccaagtgatgaatagctcagttgaaagyaacccagggcacattctggaggaaattctctgggtatgattgtgcatgactgttttctctgctcattaaaccctcatctgcctccagggcaattccgggagagactgagtcactcaagactcatggtctgcactgggcagccaaaggcgattcggccaccaagtgtgattctggcctcattcagaagtggatgctaaacaatacaccctttcaccaggagcccatcacatgggcatcaggagatgggggcgagtgatgtgccagccttctagactggcaggcctggggggcagcagaggg

SEQ ID NO: 118087 - DNA, 601 bp, Human
aatcagggggtccagccaggcgccaagacgttggggtgccttgcatttctaagtgccaagtgatgaatagctcagttgaaagcaacccagggcacattctggaggaaattctctgggtatgattgtgcatgactgttttctctgctcattaaaccctcatctgcctccagggcaattccgggagagactgagtcactcaagactcatggtctgcactgggcagccaaaggcgattcggccaccaagtgtgattctggcctcattcagaagtggatgctaaacaatacaccctttcaccagsagcccatcacatgggcatcaggagatgggggcgagtgatgtgccagccttctagactggcaggcctggggggcagcagagggcacaatagctagaaagactcccagatgaaaacttctgggctttgaagccttcgaacaaatgaagaagaaaatgacttcttcgtgtcctattaagacagtgagttgtggcttttttgagagcagcttgctcagacctcttatgaaagatagatcagtagcaagagcactggtgtaggagtcagaaatctgcaattatgaaccactgagttttgtgtgtg

SEQ ID NO: 118088 - DNA, 601 bp, Human
ctgcaattatgaaccactgagttttgtgtgtgtgtgtgtgtgtttttgtttttgttttttgtttgttttgttttgttttttaacttgctggaggaccatactcggctatccttgattttattttctcctgtgtcacaagagaaattggttagaagcttcccattgtgcctcctggctttaaaaatagataatccaattaacaataatgctttaaaacaacaaaaccttgtccttttcccttcctacttctgatcagaaccagctcagtaagatttattagttgtgcaatctgttttggacwtgagctcagcaaatcagaggacagaaatagaatcctggctttttaatgataaacactgtaaaaataaaaaatttggagagcttaccagtgcttctggctgcccaagtggtttgtgtgtggttgactcccaggagctcaatcactttgggtgcagtccacccagagagctatgttccagctacatcaacctggagccttagcttggtcagtctagatttttgggtttggctgcagacatctcgtaatgtcacaaggacagcctgtgtccttggtgacccaaccctgggccaaccccaagtc

SEQ ID NO: 118089 - DNA, 601 bp, Human
tcctggctttaaaaatagataatccaattaacaataatgctttaaaacaacaaaaccttgtccttttcccttcctacttctgatcagaaccagctcagtaagatttattagttgtgcaatctgttttggacatgagctcagcaaatcagaggacagaaatagaatcctggctttttaatgataaacactgtaaaaataaaaaatttggagagcttaccagtgcttctggctgcccaagtggtttgtgtgtggttgactcccaggagctcaatcactttgggtgcagtccacccagagagcyatgttccagctacatcaacctggagccttagcttggtcagtctagatttttgggtttggctgcagacatctcgtaatgtcacaaggacagcctgtgtccttggtgacccaaccctgggccaaccccaagtcctggagtcctctcctaagagccctgcctaattgtagagagagcattcaggctgtaaagggcaggaggcctgggggctacgactaggtttgggctttctaaattcccaagagtatgatgggaagaccaacaggcagaatcagagagaagcagtcagcccactgctgggga

SEQ ID NO: 118090 - DNA, 601 bp, Human
gtgaaatattaggtgtaaagtgctgaataccttgaacccagactaggcactcagtgagtgctcactgtggttatggaccaggagctgcaggaattagaacaccattgagtagcaggaactggctttattctcatcttcatgataaagcaacttctccttacatatagcttaatctggaaccaaaaatctaattctgcctcatccctcctgaggagatgacaaatagggatcaggcacacctgggtggctcaagttagaaaacaaattaactcattttgcagaatctggagacgtctggtckggagaactgacagtgccctctctttgggcatagtatgactgtaggttgtctttgggtggtcttcatatggaatgtactgtgtttgccatgttccctaggagatctggcctcagaaatggccctgtgatggtatgtgaacatactgtcctgtaactgagatgatagcttgcacattcagacagacaaagccagttacaaaactaaaagttggtctctgaaacatttgctttcggggaaaacagcaaatgttcacagaagcaaagttctgggttaaagacattttaagtatccaataaggaa

SEQ ID NO: 118091 - DNA, 601 bp, Human
aacccagactaggcactcagtgagtgctcactgtggttatggaccaggagctgcaggaattagaacaccattgagtagcaggaactggctttattctcatcttcatgataaagcaacttctccttacatatagcttaatctggaaccaaaaatctaattctgcctcatccctcctgaggagatgacaaatagggatcaggcacacctgggtggctcaagttagaaaacaaattaactcattttgcagaatctggagacgtctggtctggagaactgacagtgccctctctttgggcatagyatgactgtaggttgtctttgggtggtcttcatatggaatgtactgtgtttgccatgttccctaggagatctggcctcagaaatggccctgtgatggtatgtgaacatactgtcctgtaactgagatgatagcttgcacattcagacagacaaagccagttacaaaactaaaagttggtctctgaaacatttgctttcggggaaaacagcaaatgttcacagaagcaaagttctgggttaaagacattttaagtatccaataaggaattctcagcaaacaccagctggtgattcctcagat

SEQ ID NO: 118092 - DNA, 601 bp, Human
cttgggtgaaaattacacagtgctctcttcccagcacatgttgtgattttctacaacttcagaaataactggggtggaccaagaagctattattcctcgcaggccctacaatctaggcaaagctttgaaatgtgctcggacaattttatcagagatctattttccttgatctgaggcttagggggcagtatagatgagattaatggcatttgggatcagtgatggtttatccaggagagaatgcatagtacctgtaaccaggagcctgaataggaggcaacatagcatagaggttagaatsctgactttcccacttggatgacattgggcaaaggacttcaccactttgtgcctcagtttcctcatctctaaaatgggtttagcaatagtgcctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgacaggttcgcattgtcatcccatcaaggaagaggtggagagtcagagaggttaagt

SEQ ID NO: 118093 - DNA, 601 bp, Human
ttcaccactttgtgcctcagtttcctcatctctaaaatgggtttagcaatagtgcctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgacaggttcgcattgtcatcccatcaaggaagaggtggagagtcagagaggttaagtaattaacaacctgtgtcacctaaagtgagtggcaggktcaggaattgaaccaggtttgaggaggtcctaactaggttgaactactgaccttcataaaagtttggcactacagaccagctttataggacaaaaaaaccttctttcagagctcctttttctcgccttcctgacagctccctagcagacctcttcccatgtgggtagggagataaggttcctagacactgggacactggtctccatgacccctctgtgctgcccacagccctatagtaatgagcgtgctaaaggcctggtggcatttctaccacgggaagtctcctctccaaatccaaaa

SEQ ID NO: 118094 - DNA, 601 bp, Human
ctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgacaggttcgcattgtcatcccatcaaggaagaggtggagagtcagagaggttaagtaattaacaacctgtgtcacctaaagtgagtggcagggtcaggaattgaaccaggtttgaggaggtcctaactaggttgaactactgaccttmataaaagtttggcactacagaccagctttataggacaaaaaaaccttctttcagagctcctttttctcgccttcctgacagctccctagcagacctcttcccatgtgggtagggagataaggttcctagacactgggacactggtctccatgacccctctgtgctgcccacagccctatagtaatgagcgtgctaaaggcctggtggcatttctaccacgggaagtctcctctccaaatccaaaagtggcctcaaacagtcagtgttttcagttgagctcatttatcgctcagagggagg

SEQ ID NO: 118095 - DNA, 601 bp, Human
acagacatctgaggagtcttgcctctctatagtggtttgcagcatggctagcaccattgccagagacactggcactctgtcaagcaatgttctgtggtccatggctattcacatcttaaccttgccttaattctacttcattgtgagtttgggcatgtttctttatttcttcccctctctgtgtgttagtttctccatctggaaaatgaggatactaatattacccacctcataggaatgttttaaggataaaatgagtaaataattctaaagtgcctaaaatagagcctggcatatacayaatgaatgcacaataaatattagccactgctcttgctgttggcattattaatatcctcccgggtaataatttgggtttgcgttagtatcaaggaaacctgatgaaatgtcttcataaattatcagggtttgaatgacacacagccttgaaaatgttggctccttttaagtcaagagggacctagagtagaaggattgtgaacattcacaggatagttgaccagaaatgaagtatttgacaccattcttgcaactcctaagtagctaaatagcgtcagggttaggagttggactttctcat

SEQ ID NO: 118096 - DNA, 601 bp, Human
ggcgcccgccaccacgcccagctaattttttatatttttagtagagacggggtttcaccgtgttagccaggatggtctcgatctcctgaccttgtgatccgcccgcctcggcctcccaaagtgctgggattacaggcttgagccaccgcgcccggcctaatttttgtatttttagtagagacggggtttcgccatgttaaccaggctggtcttgagctcctgacctcaggtgatccacccacctcggcctcccaaagtgctgggattgtaggcatgagccaccgcgcccggccttatttgrctttttaaggagtctgtcctaaactgaacttattactgtctccaaattatttatgcaaaagaatctaacatttctatttcttcccatagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctggg

SEQ ID NO: 118097 - DNA, 601 bp, Human
ctcgatctcctgaccttgtgatccgcccgcctcggcctcccaaagtgctgggattacaggcttgagccaccgcgcccggcctaatttttgtatttttagtagagacggggtttcgccatgttaaccaggctggtcttgagctcctgacctcaggtgatccacccacctcggcctcccaaagtgctgggattgtaggcatgagccaccgcgcccggccttatttgactttttaaggagtctgtcctaaactgaacttattactgtctccaaattatttatgcaaaagaatctaacatttctrtttcttcccatagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaacccca

SEQ ID NO: 118098 - DNA, 601 bp, Human; identical to SEQ ID NO: 19638

SEQ ID NO: 118099 - DNA, 601 bp, Human; identical to SEQ ID NO: 19639

SEQ ID NO: 118100 - DNA, 601 bp, Human; identical to SEQ ID NO: 19640

SEQ ID NO: 118101 - DNA, 601 bp, Human; identical to SEQ ID NO: 19641

SEQ ID NO: 118102 - DNA, 601 bp, Human; identical to SEQ ID NO: 19642

SEQ ID NO: 118103 - DNA, 601 bp, Human; identical to SEQ ID NO: 19643

SEQ ID NO: 118104 - DNA, 601 bp, Human; identical to SEQ ID NO: 19644

SEQ ID NO: 118105 - DNA, 601 bp, Human; identical to SEQ ID NO: 21117

SEQ ID NO: 118106 - DNA, 601 bp, Human; identical to SEQ ID NO: 21118

SEQ ID NO: 118107 - DNA, 601 bp, Human; identical to SEQ ID NO: 21119

SEQ ID NO: 118108 - DNA, 601 bp, Human; identical to SEQ ID NO: 19645

SEQ ID NO: 118109 - DNA, 601 bp, Human; identical to SEQ ID NO: 19646

SEQ ID NO: 118110 - DNA, 601 bp, Human; identical to SEQ ID NO: 19647

SEQ ID NO: 118111 - DNA, 601 bp, Human; identical to SEQ ID NO: 19648

SEQ ID NO: 118112 - DNA, 601 bp, Human; identical to SEQ ID NO: 19649

SEQ ID NO: 118113 - DNA, 601 bp, Human; identical to SEQ ID NO: 19650

SEQ ID NO: 118114 - DNA, 601 bp, Human; identical to SEQ ID NO: 19651

SEQ ID NO: 118115 - DNA, 601 bp, Human; identical to SEQ ID NO: 19652

SEQ ID NO: 118116 - DNA, 601 bp, Human; identical to SEQ ID NO: 19653

SEQ ID NO: 118117 - DNA, 601 bp, Human; identical to SEQ ID NO: 19654

SEQ ID NO: 118118 - DNA, 601 bp, Human; identical to SEQ ID NO: 19655

SEQ ID NO: 118119 - DNA, 601 bp, Human; identical to SEQ ID NO: 19656

SEQ ID NO: 118120 - DNA, 601 bp, Human; identical to SEQ ID NO: 19657

SEQ ID NO: 118121 - DNA, 601 bp, Human
cattatgccccatcatgacggcctaattcaaggctttgaggtgatgatggctgtgtgcgagttctgttcttgactctcagataatgaccttggccaagtcggtatttcctactgagcctcagctttggagtgagactaagaaactagatgaccgctagggtctatatgtgtgtgtcccctcccaaattcgtatgtccagacctaatcctcagtatgatggcattaggaggtggggcctttggaaagtgattgggtcatgagaggacagagccctcacgaatgggattagtgcctctctctmtatatatatatacacctacatatatatacctatatatatacatatatacacctatatatatacatatatacacctatatatatacatatataggcactaatatgtataggcatatatacacacacatatatatacacacacatatatatacacacatatatacatatatatacacacacacgcacacacatatatatttgagatggagtctcactctgttgcccacccaagctggagtgcagtggcatgatctcagctcactgcaacctctacctcccaggttcaagcaattttcctgcc

SEQ ID NO: 118122 - DNA, 601 bp, Human
gccaagtcggtatttcctactgagcctcagctttggagtgagactaagaaactagatgaccgctagggtctatatgtgtgtgtcccctcccaaattcgtatgtccagacctaatcctcagtatgatggcattaggaggtggggcctttggaaagtgattgggtcatgagaggacagagccctcacgaatgggattagtgcctctctctatatatatatatacacctacatatatatacctatatatatacatatatacacctatatatatacatatatacacctatatatatacatatattggcactaatatgtataggcatatatacacacacatatatatacacacacatatatatacacacatatatacatatatatacacacacacgcacacacatatatatttgagatggagtctcactctgttgcccacccaagctggagtgcagtggcatgatctcagctcactgcaacctctacctcccaggttcaagcaattttcctgcctcagcctcccgagcagctgggattttaggcacccgccaccacacctggccaatttttgtatttttagtagagactgcatttcgccatgttgg

SEQ ID NO: 118123 - DNA, 601 bp, Human
tatatacacctacatatatatacctatatatatacatatatacacctatatatatacatatatacacctatatatatacatatataggcactaatatgtataggcatatatacacacacatatatatacacacacatatatatacacacatatatacatatatatacacacacacgcacacacatatatatttgagatggagtctcactctgttgcccacccaagctggagtgcagtggcatgatctcagctcactgcaacctctacctcccaggttcaagcaattttcctgcctcagcckcccgagcagctgggattttaggcacccgccaccacacctggccaatttttgtatttttagtagagactgcatttcgccatgttggccaggctggtctcgaactcctgacctcaggtgatctgcccacctcaccctcctaaagtgctgggattacaggcgtgagccaccatgcccagcttagtgcccaagaggccccagagagctagctgccttgccccttccaccatggaaggacacagcgagaaggggctgtctatgaaccagaaaggcccagaaacataaggtccagaaagaaggctc

SEQ ID NO: 118124 - DNA, 601 bp, Human
cacaaaagacccagaatagtcaaaactatcctaaacaaaaagaaccaaactggagtaatcacattacctgacttcaaattatactacagagctatagtaaccaaaacagcatgttactgacataaaaacaaatacatagaacaatggaacagaatagagaacccagaaacaaatctgcacacctacagtgaactcatttttgacaaaggtgccaagaacatacacaggggaaaagatagtccaataaatggtgatgggaaaactggatatccatatgcagaagaatgaaactagacccctrtcttttgccatatacaaaaatcaaatttaaatgaattaaagacttgaatctaagactttaaactatgaaaccacagcaataaaacattggggaaactctccaggacttcggtctgggcaaaatttcttgagtaatacccaacaagcacaggcaaccaaagcaaaaatggacaaatgagatcacatcaagttaaaaagctcttgcacagcaaagcaaacaatcaacaaagtgaaaagacaacccacagaatgggagaaaatatttgcaaactatccatctgatgagggattaacaaccaga

SEQ ID NO: 118125 - DNA, 601 bp, Human
acaaatgcttgaggggatggatactccattctccattatgtgattattatacattgcatgcctgtgtcaaaacatctgaagtgccccataaatatatacacctactatgtacccacaaaaattaaaatgaaaaataaaaatagaataaaatagtgttatgttaggggccgggagttgtggattcaccctccaaatacacaggcttaactgttggactggacttggttcatctctctgggactttccagtggatcttccaaggacttcaagcattcacttccttcctctctctctctggcaratgaataactgaatcatgtgccaattgctacactaaattttgagaaataaccaaatccatcactagtcttacatatatggtggagtgagaaaatggggaagggctgtggaaatgggctctgttactggttcgctgtgcagctctctgcatggggccacagtttcctcagcataaaatggtgattatataatctctcctcatgaggctcttgtaagaatccagtgaaataatgcattgaaagggtttaacacagtgcttggcatataacaggttctcagcaaatggaagctctgcctgtga

SEQ ID NO: 118126 - DNA, 601 bp, Human
atctcttggcattcttaactctgtctttggcctctgtttctcagaggacacaggtgacctcagcactgagctgcagaagactgggctggaaaggagtggtcctcatcttctctgatggggagaataggggtggcacagaggttattgtgagtgctaggggcaaagagtgacccagaacagggaggctgaagggcacctccctcagcacgaaattggccttccctatcaagtactctttttttatttttgagacagaatttttgctcttgttgcccaggctagagtgcaatggtgcagtctyggctcactgcaacctccacctcccaggttcaagtgattctcctgcctcagcctcccaagtagctgtgattataggcgcccacgaccacgcccagctaatttttgtatttttagtagagacggggtttcaccatgttggccaggctggtctcaaactcctgacctcaggtgatccactcaccttggtctctcaaagtgctgggatgacaggcatgagccaccgtgcctggccaaggactcttgattgcaaatgacagaaactcaactcaatctcaaagtaaaaagggactttaagcgcctt

SEQ ID NO: 118127 - DNA, 601 bp, Human
ggccccgcacaatcttctccaccctgctcagtggcacctgtctttttattcaacccccaggagcccaccttctggtgagtgaggcaggggtgtattgatggaactacagacacaaatatggtaggaacctagaggagggaaccaataacaccccctagagattgggtcagatgaggtttcccagagaaagggacatttacacctgggttttgaaggaggaatagaagttcatcatggggagaaaaataagaaggcattccaagccaaagaaacagtgtgtgcaagttatttctgtaatgcrtgaaaggggcccagtgcatgtaaatgtttgttgaatgaatcaatgtttgggggaacattgagaaatttggtgtggctgcatcagagcttgcaaactgtcagtggataggccaaatcaggcaaagagaaggttaaaaaaaaaagtgaaaatggaattaattctcaacatctaaaaactgggaggcttcacagacactccggagctgggcagcatcctctgcctttaggcgcatgctatccagctcaccagagtccccacctggctcagtttactcattcatgctactccttgggccctgtg

SEQ ID NO: 118128 - DNA, 601 bp, Human
tttcccagagaaagggacatttacacctgggttttgaaggaggaatagaagttcatcatggggagaaaaataagaaggcattccaagccaaagaaacagtgtgtgcaagttatttctgtaatgcgtgaaaggggcccagtgcatgtaaatgtttgttgaatgaatcaatgtttgggggaacattgagaaatttggtgtggctgcatcagagcttgcaaactgtcagtggataggccaaatcaggcaaagagaaggttaaaaaaaaaagtgaaaatggaattaattctcaacatctaaaaaytgggaggcttcacagacactccggagctgggcagcatcctctgcctttaggcgcatgctatccagctcaccagagtccccacctggctcagtttactcattcatgctactccttgggccctgtggacatttgaatttgcacccctacctacttgttatactcctcaaggttctggactgtgagctactcacagggccaggcacacagcaggtgcctaatacatctttgttggctaagtggatagatggtgtgatgattttaaaatatgtccccaaatttcttaacactctggagccccct

SEQ ID NO: 118129 - DNA, 601 bp, Human
ggcaaatacctgactggcctcttcacagcatcaacagagttaccacacctatttcacagagaaggtaagggggaccctgagggcttgtacaatttgcccacatccccttacagtggtccagctgcaaaaaaaaaaaaaaatagtagaggggctccccaaaccacacacaccccaaatagccacagcttagctcagcttcctcccatccctggattctcagcactgagatgtctccctccccgacattctagcttcctctccctcttttcccacagggacggcccctttccctctatggccycacttcagagctctggggctacccaaggacaccccaggcctcttccttacggtatgaacaaaactgggcagatgctatggcggtggcgccacggagggggccggggtcatgttgcggcctcacgcaacaggcggctgggagcttaagtcatggtgaaagggctaaattgtcctgtgcagctgtgcttgtttttcttccccgtttcagtccgcagccctgataggggagggggtaagctggaggcggtcactttttttcctgcctgtgttcccccatcccagggagtcctccaagactgtc

SEQ ID NO: 118130 - DNA, 601 bp, Human
cctttgccaagggtttagcagggcgggagttggctcacaagatgctcacaataagcaagcatgtatacaacaaacatccttcaaaagtgcagtgacaagtactgcaattgagatgtctgagataccacaggagcccaggaagggtacttgaccaggcagaggggaagtggtcagggagggatgcctaggggagctgataacacaagcagaatcctaaaggagccatagaatatatctatgcaaatggccaggcactgtggctcatgcctataatctcagtactttgggaggctgaggctgmaggttgtttgggaggccagaagtttgaaaccagcctgaggaaggagttggttgaacttgtttgtttgagaccagagaagcaagacgtcatctctacagaaaatacaaaattagctgggcatggtggtgtgcacctagctacttggaaggctgaggtgggaggatggcttgagtctaggtggttgaggcttcagtgagctatgattgtgcccctgcacttcagcctgggcaacagagtgagactccatctctggaaaatatgtgtacaaataatttttttaattaaatgaaaatttgaaaa

SEQ ID NO: 118131 - DNA, 601 bp, Human
tcctaaaggagccatagaatatatctatgcaaatggccaggcactgtggctcatgcctataatctcagtactttgggaggctgaggctgcaggttgtttgggaggccagaagtttgaaaccagcctgaggaaggagttggttgaacttgtttgtttgagaccagagaagcaagacgtcatctctacagaaaatacaaaattagctgggcatggtggtgtgcacctagctacttggaaggctgaggtgggaggatggcttgagtctaggtggttgaggcttcagtgagctatgattgtgccmctgcacttcagcctgggcaacagagtgagactccatctctggaaaatatgtgtacaaataatttttttaattaaatgaaaatttgaaaaacaaaggaggaaggaccctccaggcaggaggatcagcatgagcagaggtttggaggtaagagcggtgtgggtgggcagcaaaaagcagttcagtgttgcaggagcccagatttgtgtggcaggaagaggcaagaagtttattgcacctgctgagtgcttactatatgcagggccctattcaggcactgggtttaggcaccatgagcaaatg

SEQ ID NO: 118132 - DNA, 601 bp, Human
cctgctctttctcttcctcctgctccagccatgtgaagtgctggcttccccttcgccttccaccatgattgtaagtttcctgaggcctccccaggagccaagcagatgccagcatcctgcttcctgtccaccctgtggaatcgtgagccaaatatctcttctttataaattatgcagtctcaagtattcctttatagcagtgcaagaatggactaatacaaaatcttgtgcttatactgtcctagaacatctctggaaggatgtactgttcactaactttttgaatctcacatttttctaytcctctaataaatatatgttttaaaaataattagcggataatcaaaaggagtgtccactgagtttggaaatacgttttttcatatatccaacccacagatatttgcgaagctgctactgtgcatcaagctttgttcttggcactggaaatggtgaagggaacagagcttcgccaccctcatgggctgggttcttttcctagggctgccataacaaaatgctacagatggagtcacataagcaagagaaatgtattgtctcaccattctgggggctagaagtttgaaatcaaggtgtcaac

SEQ ID NO: 118133 - DNA, 601 bp, Human
gaagtgctggcttccccttcgccttccaccatgattgtaagtttcctgaggcctccccaggagccaagcagatgccagcatcctgcttcctgtccaccctgtggaatcgtgagccaaatatctcttctttataaattatgcagtctcaagtattcctttatagcagtgcaagaatggactaatacaaaatcttgtgcttatactgtcctagaacatctctggaaggatgtactgttcactaactttttgaatctcacatttttctattcctctaataaatatatgttttaaaaataattakcggataatcaaaaggagtgtccactgagtttggaaatacgttttttcatatatccaacccacagatatttgcgaagctgctactgtgcatcaagctttgttcttggcactggaaatggtgaagggaacagagcttcgccaccctcatgggctgggttcttttcctagggctgccataacaaaatgctacagatggagtcacataagcaagagaaatgtattgtctcaccattctgggggctagaagtttgaaatcaaggtgtcaacggggtcggttatgttgagggctgtgaggggaggc

SEQ ID NO: 118134 - DNA, 601 bp, Human
gtgcttatactgtcctagaacatctctggaaggatgtactgttcactaactttttgaatctcacatttttctattcctctaataaatatatgttttaaaaataattagcggataatcaaaaggagtgtccactgagtttggaaatacgttttttcatatatccaacccacagatatttgcgaagctgctactgtgcatcaagctttgttcttggcactggaaatggtgaagggaacagagcttcgccaccctcatgggctgggttcttttcctagggctgccataacaaaatgctacagatggagtcacataagcaagagaaatgtattgtctcaccattctgggggctagaagtttgaaatcaaggtgtcaacggggtcggttatgttgagggctgtgaggggaggctctgttgcaggctggcttcttaacttgcgggcggccgtcttcatgttcacgtggcatctttgccatatgtacgagtgcccacatttcccctttttataaggacaccaggctattggattagggcctaccctaatgacctcattttaatgtgggttcctttgtaaagactatttattcaaataaggtcacattc

SEQ ID NO: 118135 - DNA, 601 bp, Human
taggaaatgatagtaattatggatttttttcatttttattgtggaacatgccatagagacaaaggcatatatgtacagtctgaagaataacaataaatacccttgaactcaccaatccatttaagaaatagaatactgctgttacccccgacactctgcatgctccttcctgatcaaaccccccagcctcaatgattgaagcagggatgttaatttatgggggtgactgatgacatagaaagaaagaattgattacttacaattccaagacaaggcatcacacagtgccacagagggccayggaggcagcaccaggaagccgtgcagatgcctgcgtcatgcttcctgcacaccctgtggagtgtacacccttgggtgaggaggtagaagcaggggcaaagacagcactgggccagaggctttattggagtttccaggacaaatgcaaggcaaggcagactaaacatcgtgctctcagaacggcacacaatttaaaactcattaattgtttatttctggaacttttcaattattttcggaccgaggttgaccacgggtaactgaaaccacagaaagtggaaccgcagataagcgggggctg

SEQ ID NO: 118136 - DNA, 601 bp, Human
attcctgttcttttgttccccaatttctattgtgttatttatcaatctttttcttatcgttcataggcgtttttctatattatggatgctactcctcggttagtcatgtgtgtttcaaatcttgctaattgtgactcgtcttttcattctctgaatggggtcttttcatgaaagggccctctaaattttaatgcagtcaaatttgtcaactatttactttatgggttaaactttttaatctcatttttttaagtttcattaaagaatcttttcataaagatgctctcctatattttattakaaagttgtaaagttttaccatttatatttaaatccttaatccatctggaatggatttttaatgtgtgggatgacatacggaatcattttcattttcttccatatgaatagcgagttattctggcaccatttcctgggaagaccatccttttctcctggattcgcgatgcaggctgtgttatcaccttttcatatatgcatgagaaaaaaaaatgttaaggaaaaagccaagtgaaataaaatggtaggcaacactttggcccagcaagtccatgtctaagcatttatcctaaagaaataa

SEQ ID NO: 118137 - DNA, 601 bp, Human
tccttaatccatctggaatggatttttaatgtgtgggatgacatacggaatcattttcattttcttccatatgaatagcgagttattctggcaccatttcctgggaagaccatccttttctcctggattcgcgatgcaggctgtgttatcaccttttcatatatgcatgagaaaaaaaaatgttaaggaaaaagccaagtgaaataaaatggtaggcaacactttggcccagcaagtccatgtctaagcatttatcctaaagaaataactgtaaatgcaaaaaaaaaaaaaaaaaaaaaaagatttgtcgcaaagatgtggtttataagagccaaaaattagcaaacaatctcattgcatatgcaacaaaagaaattgtttaaataaatttttgtacatctatacaatggaacattatgcagtaatctaaaaagatatggtagattttaaggaggtgacatggaaagaaaaattgaaaagcgcagactatggaaccacatacagatacagtataatcctcactatgtaatctagaggcatgttcttagacaaattacaaaagagggatgtataaccaactgcaagcagttgatctatatta

SEQ ID NO: 118138 - DNA, 601 bp, Human
actgtaaatgcaaaaaaaaaaaaaaaaaaaaaaagatttgtcgcaaagatgtggtttataagagccaaaaattagcaaacaatctcattgcatatgcaacaaaagaaattgtttaaataaatttttgtacatctatacaatggaacattatgcagtaatctaaaaagatatggtagattttaaggaggtgacatggaaagaaaaattgaaaagcgcagactatggaaccacatacagatacagtataatcctcactatgtaatctagaggcatgttcttagacaaattacaaaagagggaygtataaccaactgcaagcagttgatctatattatctgactttaaaaaaaatttgtcatcctagcatcccagtatattatctgaatttttatagtgatatcaggcaatcataaataaaacatagttcactttctccatgttaaaaaaaaatgatgttgcatatgcttaggataataccataagacccagcaacccattcctaggtattttcttaagaatctaagaacatttatgttcacacgaaagccagtatgtgaatattcatcataagcccattcacccaaaactggaggcaacccag

SEQ ID NO: 118139 - DNA, 601 bp, Human
ctgtaaatgcaaaaaaaaaaaaaaaaaaaaaaagatttgtcgcaaagatgtggtttataagagccaaaaattagcaaacaatctcattgcatatgcaacaaaagaaattgtttaaataaatttttgtacatctatacaatggaacattatgcagtaatctaaaaagatatggtagattttaaggaggtgacatggaaagaaaaattgaaaagcgcagactatggaaccacatacagatacagtataatcctcactatgtaatctagaggcatgttcttagacaaattacaaaagagggatatataaccaactgcaagcagttgatctatattatctgactttaaaaaaaatttgtcatcctagcatcccagtatattatctgaatttttatagtgatatcaggcaatcataaataaaacatagttcactttctccatgttaaaaaaaaatgatgttgcatatgcttaggataataccataagacccagcaacccattcctaggtattttcttaagaatctaagaacatttatgttcacacgaaagccagtatgtgaatattcatcataagcccattcacccaaaactggaggcaacccaga

SEQ ID NO: 118140 - DNA, 601 bp, Human
gttgatctatattatctgactttaaaaaaaatttgtcatcctagcatcccagtatattatctgaatttttatagtgatatcaggcaatcataaataaaacatagttcactttctccatgttaaaaaaaaatgatgttgcatatgcttaggataataccataagacccagcaacccattcctaggtattttcttaagaatctaagaacatttatgttcacacgaaagccagtatgtgaatattcatcataagcccattcacccaaaactggaggcaacccagatgtccctcaaccagtgcayggataaataagctgtggttcatccacacgatggaatattactcggcaacaaaaagaaacattactgatggatgcgacaccatggataaacttcagaacactgtgctaagtgaaaggagccagacccaaaaggccacatacattataattccatttatatggacattctggaaaaggcacacttataggagagcaaaacatcagtggttgccaggggcggggatggtgggagagatttactataaaggggcacggggacattttgggggtgaaggaactgttctctatcttgattatggtg

SEQ ID NO: 118141 - DNA, 601 bp, Human
gttaaaaaaaaatgatgttgcatatgcttaggataataccataagacccagcaacccattcctaggtattttcttaagaatctaagaacatttatgttcacacgaaagccagtatgtgaatattcatcataagcccattcacccaaaactggaggcaacccagatgtccctcaaccagtgcatggataaataagctgtggttcatccacacgatggaatattactcggcaacaaaaagaaacattactgatggatgcgacaccatggataaacttcagaacactgtgctaagtgaaaggakccagacccaaaaggccacatacattataattccatttatatggacattctggaaaaggcacacttataggagagcaaaacatcagtggttgccaggggcggggatggtgggagagatttactataaaggggcacggggacattttgggggtgaaggaactgttctctatcttgattatggtgatgattacatgactatgggtttgtcaaaactcataaacctactaactacaaactacccactagaaagggaaaactttacaatatgtaaattacacctcaataaagaatcgcaagctat

SEQ ID NO: 118142 - DNA, 601 bp, Human
taggataataccataagacccagcaacccattcctaggtattttcttaagaatctaagaacatttatgttcacacgaaagccagtatgtgaatattcatcataagcccattcacccaaaactggaggcaacccagatgtccctcaaccagtgcatggataaataagctgtggttcatccacacgatggaatattactcggcaacaaaaagaaacattactgatggatgcgacaccatggataaacttcagaacactgtgctaagtgaaaggagccagacccaaaaggccacatacattatrattccatttatatggacattctggaaaaggcacacttataggagagcaaaacatcagtggttgccaggggcggggatggtgggagagatttactataaaggggcacggggacattttgggggtgaaggaactgttctctatcttgattatggtgatgattacatgactatgggtttgtcaaaactcataaacctactaactacaaactacccactagaaagggaaaactttacaatatgtaaattacacctcaataaagaatcgcaagctataaaaggtgttgcaggttatacctttgta

SEQ ID NO: 118143 - DNA, 601 bp, Human
ttgtaaattaaaatacaccaacaatgtgaaagctaaagaaaaatatgtgatgtaagaacatttaatgatatggaaaaacattcacagtatcgtcaaatgaatatccatgttgcacaacgctgtaatacacaagtctatgtacacaaaggcatgcatacatgcacacaccggtagaaagaaaaaactgctggataaacgccgcaaatggtgtccacaggtctctctgagtggaggggtcactgctggtctttattttctttcgctccctgggtttgctgttttcccacgacgtttcccacartgtgtccccgctggagtccatggctgactcagggaggctgggaggaggtggccactccacagctgggaaaaccgcagcctcccgatgaaccctggctgacgacctgtctatgtttactttttctccctgggcagacaagacaggagactggaagaaggggccagaaattcagactcagaagccccctccagaggccacaaggcagcctggtcctctctgaaccagtggctcccactcactggccccttgtctctgcctggactcctgcggatgagtggaaggccaagagggcgccctctg

SEQ ID NO: 118144 - DNA, 601 bp, Human
acaaaggcatgcatacatgcacacaccggtagaaagaaaaaactgctggataaacgccgcaaatggtgtccacaggtctctctgagtggaggggtcactgctggtctttattttctttcgctccctgggtttgctgttttcccacgacgtttcccacaatgtgtccccgctggagtccatggctgactcagggaggctgggaggaggtggccactccacagctgggaaaaccgcagcctcccgatgaaccctggctgacgacctgtctatgtttactttttctccctgggcagacaagacrggagactggaagaaggggccagaaattcagactcagaagccccctccagaggccacaaggcagcctggtcctctctgaaccagtggctcccactcactggccccttgtctctgcctggactcctgcggatgagtggaaggccaagagggcgccctctggtgcccactagatcgactcccaattaatcacttaactgtgtgaccctgggccaactactcaacctctctgtgcctcgggtcctcctctgaacatggggataaagacagtgcttgcctcgtggggatgttgtgtgtgtataca

SEQ ID NO: 118145 - DNA, 601 bp, Human
acgcctggtaccatttacatgctcagtaaatgtttaggaggattgttgtgataacccagcagactgatgtgtaagcctatggtcccatctcagggcatgtgggtgtcacaggatcgtagtcctaacagcccaaaaataatgttaaaatgactcaaggacttcacttatgcttctgagcatcctgaaggaaataggcacagtctacagaactacttcctaatgctccccttagttcaactgtccacttcctcagcacagtccctgtatgtctttggaggtcccccttctccagacctccttyattcagccaacagcgtttattgagcacctgctctgtgccagccagctgctgttctaggctcttagaataaatcagaaaaccaaatagatgaaaaattctcattgttcacaagtagattctagacttctccccagagcaaagcccaggcccttggccttcctctcccctgcctctttcttcctcattctgcacccagaacccaagaaaacgctgcagcccttcctgggagggcaggagagaggaaagatctgagttggccaagccaggctctccagcaggcagggctccagcagaggctgg

SEQ ID NO: 118146 - DNA, 601 bp, Human
ctgctgttctaggctcttagaataaatcagaaaaccaaatagatgaaaaattctcattgttcacaagtagattctagacttctccccagagcaaagcccaggcccttggccttcctctcccctgcctctttcttcctcattctgcacccagaacccaagaaaacgctgcagcccttcctgggagggcaggagagaggaaagatctgagttggccaagccaggctctccagcaggcagggctccagcagaggctgggcaccttcagccatcagcaactgtgtcccattacctgtggaaagcrccagccctggcctggaaaacagtaggagttcatcaagagtggctttgttgtacagtggttgtcttgtacccagttggattggcagcagcttcggggcacgaggagcgactgttcactccttggggagcttgcagcacagggcaaggtgcacagtaggcacttggtggctggcagggccctctggggcatcctatgggtgaatatcttgctgagcccatggaaggcccatgtcagaatccagtaatgtgctggggaggcgagctggggtggggttggaagtggtgctcaccagcccagcca

SEQ ID NO: 118147 - DNA, 601 bp, Human
ttagaataaatcagaaaaccaaatagatgaaaaattctcattgttcacaagtagattctagacttctccccagagcaaagcccaggcccttggccttcctctcccctgcctctttcttcctcattctgcacccagaacccaagaaaacgctgcagcccttcctgggagggcaggagagaggaaagatctgagttggccaagccaggctctccagcaggcagggctccagcagaggctgggcaccttcagccatcagcaactgtgtcccattacctgtggaaagcaccagccctggcctggmaaacagtaggagttcatcaagagtggctttgttgtacagtggttgtcttgtacccagttggattggcagcagcttcggggcacgaggagcgactgttcactccttggggagcttgcagcacagggcaaggtgcacagtaggcacttggtggctggcagggccctctggggcatcctatgggtgaatatcttgctgagcccatggaaggcccatgtcagaatccagtaatgtgctggggaggcgagctggggtggggttggaagtggtgctcaccagcccagccagggttcctcttaaaag

SEQ ID NO: 118148 - DNA, 601 bp, Human
agccagtacagtgcctcacccctttttatgccctcacctggctcatctcccatccattagtcctcaaggtacatctgtgagtcccatgggtcaggtagtgggtgcaatgggaggagatgagggtgtggacttgtcctcagatctacctcttagtacctatgagaagtcagcaaccaccctgaccctctgtgtcttcatctgtaaaatgcatatattagtctcttctttggtggaaaggattaaatgagatgttgcatatggaggcatgtgagggttttgtaagtgctcattctcccttttscctcaggaagaaagcctccaccttcagactatcaggcacctggggacagaccccaggacactgccttttgtggctcttgccacccatggtcacctcagttactcaagccacacatgcatgttcgtgcatcccccacatatacacagaaactcacgggcgttatatcaaccagggttcctagctgcaagcaacagaaagcaaccatgactgacttaagcagaaaaggaatttctcaaaagaatattatttgatttatggaatcacaggaaatcatccaggtctctacctggaaggcagaat

SEQ ID NO: 118149 - DNA, 601 bp, Human
ctcacctggctcatctcccatccattagtcctcaaggtacatctgtgagtcccatgggtcaggtagtgggtgcaatgggaggagatgagggtgtggacttgtcctcagatctacctcttagtacctatgagaagtcagcaaccaccctgaccctctgtgtcttcatctgtaaaatgcatatattagtctcttctttggtggaaaggattaaatgagatgttgcatatggaggcatgtgagggttttgtaagtgctcattctcccttttgcctcaggaagaaagcctccaccttcagactaycaggcacctggggacagaccccaggacactgccttttgtggctcttgccacccatggtcacctcagttactcaagccacacatgcatgttcgtgcatcccccacatatacacagaaactcacgggcgttatatcaaccagggttcctagctgcaagcaacagaaagcaaccatgactgacttaagcagaaaaggaatttctcaaaagaatattatttgatttatggaatcacaggaaatcatccaggtctctacctggaaggcagaatgaaccttattaaaatcagttgagatgcgcact

SEQ ID NO: 118150 - DNA, 601 bp, Human
agtcccatgggtcaggtagtgggtgcaatgggaggagatgagggtgtggacttgtcctcagatctacctcttagtacctatgagaagtcagcaaccaccctgaccctctgtgtcttcatctgtaaaatgcatatattagtctcttctttggtggaaaggattaaatgagatgttgcatatggaggcatgtgagggttttgtaagtgctcattctcccttttgcctcaggaagaaagcctccaccttcagactatcaggcacctggggacagaccccaggacactgccttttgtggctcttrccacccatggtcacctcagttactcaagccacacatgcatgttcgtgcatcccccacatatacacagaaactcacgggcgttatatcaaccagggttcctagctgcaagcaacagaaagcaaccatgactgacttaagcagaaaaggaatttctcaaaagaatattatttgatttatggaatcacaggaaatcatccaggtctctacctggaaggcagaatgaaccttattaaaatcagttgagatgcgcacttagcattgtgccttgcacagagtaactgctcaggaaaggttatccaa

SEQ ID NO: 118151 - DNA, 601 bp, Human
tggacttgtcctcagatctacctcttagtacctatgagaagtcagcaaccaccctgaccctctgtgtcttcatctgtaaaatgcatatattagtctcttctttggtggaaaggattaaatgagatgttgcatatggaggcatgtgagggttttgtaagtgctcattctcccttttgcctcaggaagaaagcctccaccttcagactatcaggcacctggggacagaccccaggacactgccttttgtggctcttgccacccatggtcacctcagttactcaagccacacatgcatgttcgkgcatcccccacatatacacagaaactcacgggcgttatatcaaccagggttcctagctgcaagcaacagaaagcaaccatgactgacttaagcagaaaaggaatttctcaaaagaatattatttgatttatggaatcacaggaaatcatccaggtctctacctggaaggcagaatgaaccttattaaaatcagttgagatgcgcacttagcattgtgccttgcacagagtaactgctcaggaaaggttatccaataataatgaaagcatgtcttatggtgtgacacctctgctcaaaatc

SEQ ID NO: 118152 - DNA, 601 bp, Human
tacctcttagtacctatgagaagtcagcaaccaccctgaccctctgtgtcttcatctgtaaaatgcatatattagtctcttctttggtggaaaggattaaatgagatgttgcatatggaggcatgtgagggttttgtaagtgctcattctcccttttgcctcaggaagaaagcctccaccttcagactatcaggcacctggggacagaccccaggacactgccttttgtggctcttgccacccatggtcacctcagttactcaagccacacatgcatgttcgtgcatcccccacatatacrcagaaactcacgggcgttatatcaaccagggttcctagctgcaagcaacagaaagcaaccatgactgacttaagcagaaaaggaatttctcaaaagaatattatttgatttatggaatcacaggaaatcatccaggtctctacctggaaggcagaatgaaccttattaaaatcagttgagatgcgcacttagcattgtgccttgcacagagtaactgctcaggaaaggttatccaataataatgaaagcatgtcttatggtgtgacacctctgctcaaaatcctttcatagatccaattg

SEQ ID NO: 118153 - DNA, 601 bp, Human
aacagaaagcaaccatgactgacttaagcagaaaaggaatttctcaaaagaatattatttgatttatggaatcacaggaaatcatccaggtctctacctggaaggcagaatgaaccttattaaaatcagttgagatgcgcacttagcattgtgccttgcacagagtaactgctcaggaaaggttatccaataataatgaaagcatgtcttatggtgtgacacctctgctcaaaatcctttcatagatccaattgtctaccatggaaacccggcctctgggctgtggatacttgtgatgggrgaggtggtgcgggctccgaattctttccaatagtctgcaaacccgcagagccatgaagcattgtctgtaggccagcactcatcctccacccctctgcctgcttctccgctctcctagttccttctccctcctctaggaattcagcattgccactctgattggctggattttgggacattgattgagccttgttttctagtgggcaggaggctctgtgtcttaaaggccactggcccagctgccaatgaatcagtactttgtttccccaggtagagtgggggcagggggcagggaacgggc

SEQ ID NO: 118154 - DNA, 601 bp, Human
gggagaggtggtgcgggctccgaattctttccaatagtctgcaaacccgcagagccatgaagcattgtctgtaggccagcactcatcctccacccctctgcctgcttctccgctctcctagttccttctccctcctctaggaattcagcattgccactctgattggctggattttgggacattgattgagccttgttttctagtgggcaggaggctctgtgtcttaaaggccactggcccagctgccaatgaatcagtactttgtttccccaggtagagtgggggcagggggcagggaackggcagggcaagtttggggcattctgctccgaggtccctctagccaaacgttatcaaatctcatccaacatgctcctggctctccatttcagatgtctgtaaactggggactacaaaatgcaaatatgtttaagagttgctaaatttgcagtgactttttctcaatcagtgttttgcaaatctaactactatcataggaagacctttatacttgaaaaacttggcgggtcactcaccacccagatcaagaccaaagcatggctgtcagtgccttcgcttaaacagttctctccacctggcc

SEQ ID NO: 118155 - DNA, 601 bp, Human
tcgcttaaacagttctctccacctggcctgcccttctgccatgcccctcctaggccatcacagatgccagctcagaggggcagttcctgctggctgcatggtgtcccacctggactgtgtcaccagcctcttcacagcctctagccttcggtgctccctacctgaccacccatacgtctagcaggcagacggacgggtccagaaatgcacacctggtcaccttgattgcactgagccctgccctgcagtcagttacctgggttttccaccaggcatccatttagcttagtcatcttcctcygggacagtggccgtttgatggtgacagacctaggcccaggtttctaagaatcaggaagatgaagcaacagggaaagcaggttgaccctcgcttccttccccttccacaggacggtcctgccccggctgacagaggaggggtgagtcctgctgcttcctggcctgtaagatgcccctcaaggtcgggcgtggtggctcacacctgtaatcccaacactttgggaggccaaggcgggcagatcacctgaggtcagaagtttgagaccagcctaaccaatatggtaaaatctcatctttacca

SEQ ID NO: 118156 - DNA, 601 bp, Human
taggcccaggtttctaagaatcaggaagatgaagcaacagggaaagcaggttgaccctcgcttccttccccttccacaggacggtcctgccccggctgacagaggaggggtgagtcctgctgcttcctggcctgtaagatgcccctcaaggtcgggcgtggtggctcacacctgtaatcccaacactttgggaggccaaggcgggcagatcacctgaggtcagaagtttgagaccagcctaaccaatatggtaaaatctcatctttaccaaaacgacgacgacaacaacaacaacaacaacaaaattagctggatgtggtggtgtgtgcctgtaatcctactcaggaggctgaggtgggagaattgcttgaacctgggaggtagaggttgcagtgagctgggactgcaccactgcactccagcctgggcggcagagggagacccagccaaaaaaaatgccccttaagtttcccagcctgaatatattcagtcacctgagccactgagaggctcccccgtggctccagtcagtggcaggagctggaagtctcaggagagaaggaaaacggaacccaaacctttgcaaacactcagaccggct

SEQ ID NO: 118157 - DNA, 601 bp, Human
atcacactgactcctccggcgagccctgtaaggctggcgttactatcccactttacagatgaaggaactgaaggtggctgaggtagcgacccttcctaatgggtgggagtgggattgaactgagccacacagtcagcatttatccccccaacaaagagtaataactgcccccgtggcccaggcctggcttgccaaaggctgtacattctgtgtggaataaacctaagatgctgtgggagggagggagttcagggaaggcttcctggaggacacggtgctgcatgccaggcaatgggaaatkcatcttcaaaggcatggaggtgtgacaaagtttcacatgttcaaggttatttctctaagttagtgtttctcgaggggtggcatcaactgggagctttccaagccttgtcacctaccctgtactcaggatcagggcgtggggcttgcttttggaaatctgcgtggtcataagctcctgggtggttgtacttgaaagtggcagtgcgagaaccaatggggtgggatgtggagggccctgtgagcctgttaaggaagtgggccttgccccttggtgatgtgaagcagaggggggatggtgctg

SEQ ID NO: 118158 - DNA, 601 bp, Human
tccctgctcagagggcacgacctgaatccagtcccaaggaaacaacagccaaacccaaaccgacagacattctgcaaagcagctgggttgtcctctccaaaaatgtcaagtcatgaaaacactgagaaactgttccagcttaaaagagaccaagagcctgggcacagtggcttacacctgtaatcccaacactttgggaggctgaggtgggcggatcatgaggtcaggagttcgagaccagcctgaccaacgtggtgaaaccctgtctctactaaaaatacaaaaattagccaggcatggyggcgcttgcctgtaatcccagctgctcgggagacgaaggcaggagaattgcttgaacccaggaggtggaggttgcagtgagccgagatctcaccactgcactccagcctgggtagtaagagtgaaactccatctcaaaaaaaaaaaaaaaaaaagaccaagagacatgagaagaaactgcaacaggaggtcctatattggaccctagacccattcacatcattattggtaccattggtgaaatgggaatggggtcagtggattagctggtaatactgtatgaatgtttgtgctgtgatag

SEQ ID NO: 118159 - DNA, 601 bp, Human
tctgtaagtttggtattatttcaaaataaaaaattgaaagcaattttacagtctcaacaaccacaaattataatagacatggctaccataattgagcatctagtatggactccaatgcattggctcatttaatctaacattaacaacacaaggtagatattattcgtcctgttttacaaaaaacgaaagatctcagagtggttagtgactttcccgaggtcatacagcttgaaagcagcagaggccagaattgaacccaggccatactggcttaagaatccgtgctgtcaacctctgagaratggagaaatgagcaagtaaacagacgacaattacacagggtggcaattatggagacagactctgaagggagcccagataacctggaaggctccatgtaggaggcgatatttgaactgggccttgaagcatgtatagaagttttccacttatggaaagaaagtctccaggtagaagaaatggcatagtcaagggcgcagaagcttgaaaggataggtccctggaggttgtttttctgggcctcaccaccctgtgggtaaaaacgtggttacattaagtgtcactggctttttgtcattgc

SEQ ID NO: 118160 - DNA, 601 bp, Human
gagcagtactatgtatttctcttctgcagaagagaaaaccgaggttcagagaggttaaagggcttgcctgaggtcggaccactagagaatgacagggctaagatttaaaaccatagccaagatactagactctaaaatgtgagcattgaatcattaccactactgcctctcaggacaagaaaacacgaaagcatctgttttcttaaatgttttactatcaaaaatacaaaagaaatcaaaagtagaaagaaaaatatgaatccttatgtctgtgccacccaccttcaagggagtctgtagrtgggggcatttgggtggggacacagagcggggaatggggtgcctagggaggggaaccaatctacacacacacatacacacacgcacgcccgcgcacacacacgcatgcatacatggacatgcgagcctcccaggctgcacttctccctgcctgtggggccctaaccacaatggaaaaccacagcggccctccctctttcccaccctcaccaggttccttcctcctttccacattctactgacttgcatttccccacccgactcttttatagctccctggttcaacctcaaggccttgagg

SEQ ID NO: 118161 - DNA, 601 bp, Human
tgaatccttatgtctgtgccacccaccttcaagggagtctgtaggtgggggcatttgggtggggacacagagcggggaatggggtgcctagggaggggaaccaatctacacacacacatacacacacgcacgcccgcgcacacacacgcatgcatacatggacatgcgagcctcccaggctgcacttctccctgcctgtggggccctaaccacaatggaaaaccacagcggccctccctctttcccaccctcaccaggttccttcctcctttccacattctactgacttgcatttccccasccgactcttttatagctccctggttcaacctcaaggccttgaggttttggcagctctggaggatgagagagaacatggccaggggcccttgcaacgcgccgagatgggtgtccctgatggtgctcgtcgccataggcaccgccgtgacagcggccgtcaaccctggcgtcgtggtcaggatctcccagaagggcctggactacggtaactggatgcctcccttccctcctctccacccctgaggagcacttacttagcatctactgtgtgcacccctttagatccagcacctggcacact

SEQ ID NO: 118162 - DNA, 601 bp, Human; identical to SEQ ID NO: 23079

SEQ ID NO: 118163 - DNA, 601 bp, Human; identical to SEQ ID NO: 23080

SEQ ID NO: 118164 - DNA, 601 bp, Human; identical to SEQ ID NO: 23081

SEQ ID NO: 118165 - DNA, 601 bp, Human; identical to SEQ ID NO: 23082

SEQ ID NO: 118166 - DNA, 601 bp, Human; identical to SEQ ID NO: 23083

SEQ ID NO: 118167 - DNA, 601 bp, Human; identical to SEQ ID NO: 23084

SEQ ID NO: 118168 - DNA, 601 bp, Human; identical to SEQ ID NO: 23085

SEQ ID NO: 118169 - DNA, 601 bp, Human; identical to SEQ ID NO: 23086

SEQ ID NO: 118170 - DNA, 601 bp, Human; identical to SEQ ID NO: 23087

SEQ ID NO: 118171 - DNA, 601 bp, Human; identical to SEQ ID NO: 23088

SEQ ID NO: 118172 - DNA, 601 bp, Human; identical to SEQ ID NO: 23089

SEQ ID NO: 118173 - DNA, 601 bp, Human; identical to SEQ ID NO: 23090

SEQ ID NO: 118174 - DNA, 601 bp, Human; identical to SEQ ID NO: 23091

SEQ ID NO: 118175 - DNA, 601 bp, Human; identical to SEQ ID NO: 23092

SEQ ID NO: 118176 - DNA, 601 bp, Human
tcactgaaatcaatgactttctgagttacggctgttcaacatggaaagggcttccttggaactggagatttcttctgcactattgattttcagctgaggtggggacggatgtccaagtggctgctatacagtgaagtcccttcaagggtcctttaagccctgagacagatttaaggatctgaaaagtgattgaaacctcactttgcagaaaagctgcccaatggggtgccctctcaaaccctctcctttattcactcttaatttgggtaagaaagatgacatagccacagtgaaaaccatggctttggaagaaccaagcttaagttcagaaacactaactgttgaacactgggcaagttgctcaaattctctgacccagtgtcctcaatgcatgtcctcatgtaaagacaatatgagaaggcttgtctgggaaggttgttttcaggttaaagaagataataatagctaagacaccatatagaattacttaatacatagcaggaattgaataattgtagttacttgcatcatgactattattgttgttattacattatctccagttttcaagtctgttcttttagaacaaacaactcactcc

SEQ ID NO: 118177 - DNA, 601 bp, Human
ttctctgactccaaagctttacatatattattttatgtcagttgctttacatatattattttttaatacttacaacagctgcccagagcaaattttatttccatttttatggataagagaactgaagagcttaagtagcttttccaaggtcacacagctagtaattggaagagctgccatttaaccccccgttaagctggttctgtatctcatgctcctgtttataacactggagagaggacaagggtcagcacctccatcacccagacttcccagttgatgggaattgagacgtgaccartccattgtctctccatgggacacagagggtattcaagggtgggactaacagggaaactgaattcattcactgaaatcaatgactttctgagttacggctgttcaacatggaaagggcttccttggaactggagatttcttctgcactattgattttcagctgaggtggggacggatgtccaagtggctgctatacagtgaagtcccttcaagggtcctttaagccctgagacagatttaaggatctgaaaagtgattgaaacctcactttgcagaaaagctgcccaatggggtgccctct

SEQ ID NO: 118178 - DNA, 601 bp, Human
tgacatcaacttggaagaggttggactccagatttggatactcagatcccggtgagagactaccttgtgcccacttttaaactaagatgtaactaataccatagaagagattatactaggaatgtgcttcagtggggcagtgggaaaaacactggatcaggtgccagaggctggagttctagttccattttgcctcttcgaagctgtgtgatctgggaaaaccgttcaatctctctgaacttcagtgtcttcactagaatgagggcaataatccttttgatttcactattgctgagaggamcctattagttcaagtactgtcatatcattctgtaaattgtagagtaatataaaatgtgagaaccaattaggttctcccacaattttaagttgttattcatcaatctgaattttcaaaagaataactaaactgtgtattttgggcacattcttcctaatccaactatttctccctccctccctccctccctccctccctccctccctccctccctccctcccttccttccttccttccttccttccttccttccttccttccctccttctttccatcctttttcctttccttccctccctt

SEQ ID NO: 118179 - DNA, 601 bp, Human
gtattgagaaattattttttcccacttcactttaggttactcaaatggcaccaatgtgctaattaaggagctatgatttgaaatcccagttaggtcctggcttatgaacataaccttttcagcttcccgcattgctttggaattcttgtgtcccaacactcccctagacactcccagaatgtgagcttaccctggcaaggtaccaagggatgggccatttgtttatcagcgttgcctggtactggcaagggtcattgaaggtgggatacaattataggcttgcccgtcactcggccctgtktgtaacctgggtcacaatctccatcataccacctggcacgactctctgggccagtccctgagatgactatgttgtcaaagacaaatcgtgggtcaagattgaaatgggggacagtctggaatttacgaggatgagatagaatggacagccctgtgacatcaacttggaagaggttggactccagatttggatactcagatcccggtgagagactaccttgtgcccacttttaaactaagatgtaactaataccatagaagagattatactaggaatgtgcttcagtggggcagtgggaaa

SEQ ID NO: 118180 - DNA, 601 bp, Human
tggcagcgacacttgtaaaattaatgatatagaaattttcaatgaaaacaaccttaggtcaaatttctcatttcagatttgcagtggagatttcattggcatgtcttgcaagttaataggagacagagatacctcttgggggataaaaatacatatatatctgtgtgtgtgtgtgtgtgtgtggattcattgcctaggcatacttttcaaaatgagaataggattacagataatacctccttcacaaactaatgtatcctagcactggttgtttttaagcgatcataaatatctgacatayatcatcaggacttgaaatttaaaatataaatctgtaagtactctattaatgatgctcagttccatttctgaagatgggaatgtaaccatggaggctaaacagaagatgtctcacaggccaaaaggtagaggatattttaaagcatcctgaatccaggccaggcatggtggctcacgcctgtaatcccaggactgaggccgaggcgaatggatcatgaggtcaagagatcaagaacatcctggccagcatggtgaaaccccatctctactaaaaatacaaaaatcagctgggcgtggtggc

SEQ ID NO: 118181 - DNA, 601 bp, Human
tgctaaatgcagattctggtttggtagatctggggagaggcaggaaattctgcatttctaacagactccaggcaatattgatgctgctggcagtggactacattttgggtagcaaaatcttagcttatcttgctgatagaaaagcatattaataatatataaaatctcctattccaagttattcctcatatccatacattcctttttaagaatataatcacctaggctataagatatattggcactacactaggtcagtagttggaaacttgctttctgctttcagggctaccctctaccwgctgttcatatcaggatgaactacatagcttaactttatacctgttttcccacctatacagttattcttttccctgctgctttagtgtcctttagaaaatcaaatgacatgatgtgcaggaaggtcccacagagttcacagtgctcaacaggagccagaccatggtgctgacatgtcctcctgcaccattggagacattcagctacaaggagctgctaatagccacagccccaggactgtcattgtctcctcaccacaggattacatttaagagatattaaccaaagaaaattatttaaa

SEQ ID NO: 118182 - DNA, 601 bp, Human
accagtcacagctggcttcagtcacagctgaccagaaggggcaacatagacagccaaatccatcctggcttcagataagtgctgggttcctttctctgccaagtcacatgttgtcaatgtcgccatggggtcaaagttttccctacagggagcagtgacaggctagcttgttctgacgttgagctacaggaaaatgaatggcctctgagctgggcaagcagttgaagcaagggtattcaggagagcaccatcttttcttggtggagcccaagagttaaatttctaaccagttcccaggtartgctgatgctgcttgtcccaggaccacactatgagaaccactggcatacagtgtttgtgattcaatgtgaattttgtgatgctgtccggatgctgaggggcccccagggtgtccacccaactcactgcagtggaaacacgtcttgtggaaactccttccattgcactggatttcttctgcatggtagacggtcttttcacaggctccacattttgcgcctccgccccagtttggcatcttgaagactatctggtcaaggtcaagtctaaggggacataaagcaaataccctacattgaag

SEQ ID NO: 118183 - DNA, 601 bp, Human
ctcaaggttctcaaggttctcaaggttcaagccacaaggtctcaaggttctccctatttttgacatgtgtgagtcagtgtctggcgggtaatggtcaggatttctttcatgcagttactggtgcccaggccctgaaatgcttccctctctgactcttacatacagagttggcatgtgttgcccccctgcctgacataggttctctctcagacaagaccagtcacagctggcttcagtcacagctgaccagaaggggcaacatagacagccaaatccatcctggcttcagataagtgctggsttcctttctctgccaagtcacatgttgtcaatgtcgccatggggtcaaagttttccctacagggagcagtgacaggctagcttgttctgacgttgagctacaggaaaatgaatggcctctgagctgggcaagcagttgaagcaagggtattcaggagagcaccatcttttcttggtggagcccaagagttaaatttctaaccagttcccaggtagtgctgatgctgcttgtcccaggaccacactatgagaaccactggcatacagtgtttgtgattcaatgtgaattttgtgatgctgt

SEQ ID NO: 118184 - DNA, 601 bp, Human
atctcagtgagtacatggcagagcccagactcaaacccgaatcccttgtactctaattctagaattctttctaatattcctaatcctgttttttaaagaatgctagctctctttggacaaaagccccaacagatggagtccagcccttggagttcttttcaattgcatggatgccttgcagctaccgggctgaagcatgggggtgctggcatggctgtggggactagtcggggagggggctcgccaaatatccagcagagctagcccttaagccagacctcctggacagaagcagagaagrtaagtggccattttaaaaccaaggccaattttctcccaaacaggactagctgccaggaaacagtatagaatgcagtcatgtcaaagagcactggacatggagtctaaaggtagaggttcatgtataagactctatcgcagatgcacatgacccgggcttagatgtgagaaatgacttatcgaaagtcacgtgagtcaggcaggaccagactcacaaggtctcaaggttctcaaggttctcaaggttcaagccacaaggtctcaaggttctccctatttttgacatgtgtgagtcagtgtc

SEQ ID NO: 118185 - DNA, 601 bp, Human
taccaaaaaatgctcaaatctcttctactataactcctttgaacagggcatcttcctgctacctgggaaagacaagacaccctctactaaggaaagcttccctacaatttcctgttcccacgcagttaccaaagttgatcaaaggagaatacaggcctagaaggctggatttccatatcaagaccccccagttttctccttgtaacaacctgtgcagtaggtataatcatctttgttttataagtggagaaattgaggttcaccatggtgaaatgacctgcccaaaatctcagtgagtacrtggcagagcccagactcaaacccgaatcccttgtactctaattctagaattctttctaatattcctaatcctgttttttaaagaatgctagctctctttggacaaaagccccaacagatggagtccagcccttggagttcttttcaattgcatggatgccttgcagctaccgggctgaagcatgggggtgctggcatggctgtggggactagtcggggagggggctcgccaaatatccagcagagctagcccttaagccagacctcctggacagaagcagagaaggtaagtggccatttt

SEQ ID NO: 118186 - DNA, 601 bp, Human
taaaagggatgtaccaaaaaatgctcaaatctcttctactataactcctttgaacagggcatcttcctgctacctgggaaagacaagacaccctctactaaggaaagcttccctacaatttcctgttcccacgcagttaccaaagttgatcaaaggagaatacaggcctagaaggctggatttccatatcaagaccccccagttttctccttgtaacaacctgtgcagtaggtataatcatctttgttttataagtggagaaattgaggttcaccatggtgaaatgacctgcccaaaatcwcagtgagtacatggcagagcccagactcaaacccgaatcccttgtactctaattctagaattctttctaatattcctaatcctgttttttaaagaatgctagctctctttggacaaaagccccaacagatggagtccagcccttggagttcttttcaattgcatggatgccttgcagctaccgggctgaagcatgggggtgctggcatggctgtggggactagtcggggagggggctcgccaaatatccagcagagctagcccttaagccagacctcctggacagaagcagagaaggtaa

SEQ ID NO: 118187 - DNA, 601 bp, Human
ccatcaaagggttctcaggaaatatcaaagggttaaaagggatgtaccaaaaaatgctcaaatctcttctactataactcctttgaacagggcatcttcctgctacctgggaaagacaagacaccctctactaaggaaagcttccctacaatttcctgttcccacgcagttaccaaagttgatcaaaggagaatacaggcctagaaggctggatttccatatcaagaccccccagttttctccttgtaacaacctgtgcagtaggtataatcatctttgttttataagtggagaaattgargttcaccatggtgaaatgacctgcccaaaatctcagtgagtacatggcagagcccagactcaaacccgaatcccttgtactctaattctagaattctttctaatattcctaatcctgttttttaaagaatgctagctctctttggacaaaagccccaacagatggagtccagcccttggagttcttttcaattgcatggatgccttgcagctaccgggctgaagcatgggggtgctggcatggctgtggggactagtcggggagggggctcgccaaatatccagcagagctagcccttaa

SEQ ID NO: 118188 - DNA, 601 bp, Human
atgattagtctagagatttaattgtgaagatttatctagaagtcaggggaacactggcctgggcacaatgtaaggtagaccctgcgtctctgaacgccttttccagcagctacagagttgcctgcggacggacaggtgattatcttgtggtaataatatagaaaagtgtgctcctctctggggctcttctacccatcgttcctgaaatgtatgctgctcaaatcctcatcccatcaaagggttctcaggaaatatcaaagggttaaaagggatgtaccaaaaaatgctcaaatctcttctrctataactcctttgaacagggcatcttcctgctacctgggaaagacaagacaccctctactaaggaaagcttccctacaatttcctgttcccacgcagttaccaaagttgatcaaaggagaatacaggcctagaaggctggatttccatatcaagaccccccagttttctccttgtaacaacctgtgcagtaggtataatcatctttgttttataagtggagaaattgaggttcaccatggtgaaatgacctgcccaaaatctcagtgagtacatggcagagcccagactcaaacccgaa

SEQ ID NO: 118189 - DNA, 601 bp, Human
ataaagtaattgaatatgggagtggaggaagaagataaggttgtagatgaggtaggattagccaggggctgatgagtgtggggcaagggagtttattctgggactttatttgactattctgtcaacattgtatgtgttaaaaaatatctgtaccaaaaaaaagtttaaatcagtaaataaaataattggaagaatgtcttacagcaggagagactttataaggctttaaacacaaggcatatcttttttatgaagatgaatttggggggagaatgccttatattgagacatagaaggtgtrtacacttgtctctacccttcttgttactgtcagttaccaacctccacaacaactgcttgcatatttgctgatggtctagactctgagttccttgagggcaagcctgttttgtcttaatattccgagaatttagcacaaggcctgggccagaattagtcctctgtaaacatttattgagtacatgaatgaatgaatgaatgaatgtgtcaatgtaaatcagtgagttgttcacaattatacaatagtaagttgcagagccacggcttacctcagctcttttgactcctagtccagtgctca

SEQ ID NO: 118190 - DNA, 601 bp, Human
gccgcgactgtcgtgctgtcaagagccttcctgcaggccactgccaggaaaaggaagggtcatgggattggaattgaaatccttctccccttctttgcactcccaatgccatgctcggggccagagacccagcatgaggggcccctgagccaagaatacaatgttgattcctgaccagagtatctgccctgagttgtgcactccaagacagtcccgatctcacagatgacaaaattgggttcagtggttcccagctggaaaagggtggaagctagcattagaacgagatatatagtctcaracctgctaaggactgcatccctgagtcttcccaaatgacatcagggaagtgtgtgtgtgtgtgtgtgtgtgtgtgtgtgtgtgtgtgtttgtgggcgcgcgcgttggcagggggtgggttaaggcaggagagaaacttacttttttcttaatcataaaagaatcaggattgagcactttctgtacttaccacagcctttgaaggacactgtgatattcaagcagacaattgccattgaggctaattttggtcaaattctggaagcagaggaggtggggaagggggtagacctgccttatt

SEQ ID NO: 118191 - DNA, 601 bp, Human
acaccttgcagtagatctccgactcatgagccgcgactgtcgtgctgtcaagagccttcctgcaggccactgccaggaaaaggaagggtcatgggattggaattgaaatccttctccccttctttgcactcccaatgccatgctcggggccagagacccagcatgaggggcccctgagccaagaatacaatgttgattcctgaccagagtatctgccctgagttgtgcactccaagacagtcccgatctcacagatgacaaaattgggttcagtggttcccagctggaaaagggtggaagytagcattagaacgagatatatagtctcagacctgctaaggactgcatccctgagtcttcccaaatgacatcagggaagtgtgtgtgtgtgtgtgtgtgtgtgtgtgtgtgtgtgtgtttgtgggcgcgcgcgttggcagggggtgggttaaggcaggagagaaacttacttttttcttaatcataaaagaatcaggattgagcactttctgtacttaccacagcctttgaaggacactgtgatattcaagcagacaattgccattgaggctaattttggtcaaattctggaagcagagga

SEQ ID NO: 118192 - DNA, 601 bp, Human
acgggggggtcccgagaaggaattggcgggtccgggaagggaattggagtcctgaggaggaatcgccgagctagaggaaggaattgggaatctgaaaagagaattggcggctgggtggggaatatgggagtcaaataaaaggaatcgggaaggctgatgaaggatttggagggtctgggcgtgccattaggggaaaccgaggagatgactgggcaggctgaaatggaactgggatccgaggcgggcttgaagggtcggagcatgggttgggggtgctgggaggagaatcaggggaggctgrgaagggaatttctgggtctgggaagtgtgaggaggagcttgagtgtggaggggttggttatttggagagcagaaagatctgaaggagattggaattgggggagcctcaggttgggggagttataaaggggatgaagaatcaagtgtgaggatggagtggagattgtggggtctgaagacgggtgggaagactagggaggctgggaagatgaaaacaggggctaagggtagaattgagcatgaaaagacatgggcttagggtgtgaggagggtagaggtgccaggactgggggtctgagga

SEQ ID NO: 118193 - DNA, 601 bp, Human
ggtctgaagacgggtgggaagactagggaggctgggaagatgaaaacaggggctaagggtagaattgagcatgaaaagacatgggcttagggtgtgaggagggtagaggtgccaggactgggggtctgaggagggtggggtgcggaaggaagaagttaaggggcccgtgaatcagacgtttttgaagggggtgagatttatttgtggtgccctgttccaaaggggagaagattaagagataggaggaataataagaggaattgatgagggatggagaagccgaagtagaggggatacggaragtggggataatttggggagggatttctaaagaattgatgggaagctgaaaagctaaagcgttggagagaatgaggaagtgtagagggagaaggtgagatcggtgggagggagggtgagctggaatggtggataatgggagagaggttcgtttaggaaaatgaaagtctcattagaaagggaatgcgtaatggatagactgagaaaggaatttgaggagggggtgctggctcctggaggtgcagtcccgggactggagagcgtgtgtgtgtcgtgcaggcagaatgagtttggggaggaa

SEQ ID NO: 118194 - DNA, 601 bp, Human
aaaggaatttgaggagggggtgctggctcctggaggtgcagtcccgggactggagagcgtgtgtgtgtcgtgcaggcagaatgagtttggggaggaagcgttgagagtgtccaggaagaattgtgtcttttttggagagaccggaggtaggtgaagggatcctgaagcagagactgtgttcaggtggcactgtttttttggggggcggggggggcaacttggtagggccccacagcagtgaaaaggtgatcagaagtggagtgggatccccgagcgaggtgtcagtgtctgtgggggggggataaatccagtgtggttgaggggggagctctgagtgtgtgcaggaagagctaaagaaaggagcgtggtgagtgggtgtgtgtggggggaaggggttgttcagaagttttgtgcgtgaaatgggtgggaggtacttgaagttggaagcatttcgtgggatctggagatctggattttctttccagatttgttactgattcgctctgtggccttggacaagacccttgaactctccgggcagttttgttatctgcaaaatgcaaagggatccgagggttccctgcggtgattctgttaataa

SEQ ID NO: 118195 - DNA, 601 bp, Human
gtcgtgcaggcagaatgagtttggggaggaagcgttgagagtgtccaggaagaattgtgtcttttttggagagaccggaggtaggtgaagggatcctgaagcagagactgtgttcaggtggcactgtttttttggggggcggggggggcaacttggtagggccccacagcagtgaaaaggtgatcagaagtggagtgggatccccgagcgaggtgtcagtgtctgtgggggggggataaatccagtgtggttgaggggggagctctgagtgtgtgcaggaagagctaaagaaaggagcgtrgtgagtgggtgtgtgtggggggaaggggttgttcagaagttttgtgcgtgaaatgggtgggaggtacttgaagttggaagcatttcgtgggatctggagatctggattttctttccagatttgttactgattcgctctgtggccttggacaagacccttgaactctccgggcagttttgttatctgcaaaatgcaaagggatccgagggttccctgcggtgattctgttaataaagagggatgtgtgtagagttgggactttggacagggctctgaaggtttgggagagtgagtttggtg

SEQ ID NO: 118196 - DNA, 601 bp, Human
ggctgggttttttctacattgcagtgttgctttagtgaatgacagattgcccttcttgcctctccaaggctgagccactgggcacgggaagaatgacagtcctgggggttctgtacatgcatactccaaaaaaatatgcatccagaacagctgtaggccctcaaagtgggtagaattgaattcttctaggaattaagcaagagttggcccaaatcagaggggacgtgtgtctcacttctgcttggaagccctttgctctgacttctagggacccctgtaacccgtaagtaggttatgcaayggtttttacatgagagggccatgagtgttctcctggcgggatggagaagcattgttctggtctttgagcaaattcttgagcaattacagttctgggccacagttccctctcccaatttctaaaagtggcctgggtaacctcatcaccctctgttgtcctggaagggtgagatctcttgaaggttatgccaaatctcattacagcaagaagaaatgactcacttgctaagttttcgtgttcattgaaacatcactatttcaggggcctcaatgtttcaaccctgaccgttggctttttttt

SEQ ID NO: 118197 - DNA, 601 bp, Human
ttctggtctttgagcaaattcttgagcaattacagttctgggccacagttccctctcccaatttctaaaagtggcctgggtaacctcatcaccctctgttgtcctggaagggtgagatctcttgaaggttatgccaaatctcattacagcaagaagaaatgactcacttgctaagttttcgtgttcattgaaacatcactatttcaggggcctcaatgtttcaaccctgaccgttggctttttttttggagacggagttttgctcttgttgcccatgtggctgtattaggtatgagttaaytatttgaaagtttttgtttgttttttgtatttgttttttttgttttgttttgttttgttttttttgagacagagcctcactctgtcaccaggctggagtgcagtggtgtgatcttggctcaccacaacctcttccaggttcaaggaattctcctgcctcagcctcctgagtagctgggactacaggcgtgtgctaccgtgcctggctaatttttgtgtttttagtagagacagagagtttcaccatgttggccaggctggtctgaaactcctgaccccaagtgatccgcctgcctcggcc

SEQ ID NO: 118198 - DNA, 601 bp, Human
aagtgatccgcctgcctcggcctcccaaagtgctgggattacaggcgtgagccactgtgccctgccttgtttttcttgaagtagatctttttttctttttaaaggctgataatggaggccccaaagtagccatctgttactttgttccattactctaattgcttgcctcttaggatctggctaggactaacagttttcaaaattgagtaacacacttgacaaaaaaaaaggaaccaaactcaaactcaactgttatctagaaaaaagactgtgtaaatatgtgtgagaggcaagtatactytgtttgccctcttgtaagagggataggggaggccactcagctgctagcactctgttctctcccctcatcctctccagaatgtattttagaacttgactcttctaatgactgaagaaaaggtggggtatgggaagatggcctgggactgcagggtcacttacactcacctggctaagagttgagatctggctggtgccctggagtggcacctgccactcacctaatcctaaacaatccagggtgtgggcccaggattgccctctgccttttgaaacaccctccctggttccggcttctaag

SEQ ID NO: 118199 - DNA, 601 bp, Human
cgtttctttttttatggaaataagaggcaagtgatagcaagtgggtaattcaatggcagtggtaactgaagcactgacctgttacaagagagacggaagcttctacttgagcagatacaaatactgtcatccgtggagatttgaaagaagtctttctatcactgggtagtttgagagctcattagtcttctttagaatgggtttaaacttggaaacatcaaagcaagttacaaggaaacttagttttacagtgttggcagcctaggcgccagaatttgttataaagtgtctgaaagtggcmcaggtatcacttaacttttcttcaagaaggtctatgagttacattttactcggtatcccaggcatcaaggagtgtaactttcaatgaatcaaagagaaacagaatcattttaaattccagcctctgtttaaagaaggatcttatgaaggggagaaattaaccacctgacccagggaaggatcccgcctcctccagaaagtgaaatcgccgggtgtggtggctcacgcctgtaatcccagcactttgggaggtcgaggtaggtggatcacgtgaggtcaggacttcaagaccagcctggcg

SEQ ID NO: 118200 - DNA, 601 bp, Human
gaggcaagtgatagcaagtgggtaattcaatggcagtggtaactgaagcactgacctgttacaagagagacggaagcttctacttgagcagatacaaatactgtcatccgtggagatttgaaagaagtctttctatcactgggtagtttgagagctcattagtcttctttagaatgggtttaaacttggaaacatcaaagcaagttacaaggaaacttagttttacagtgttggcagcctaggcgccagaatttgttataaagtgtctgaaagtggcacaggtatcacttaacttttcttcaagaaggtctatgagttacattttactcggtatcccaggcatcaaggagtgtaactttcaatgaatcaaagagaaacagaatcattttaaattccagcctctgtttaaagaaggatcttatgaaggggagaaattaaccacctgacccagggaaggatcccgcctcctccagaaagtgaaatcgccgggtgtggtggctcacgcctgtaatcccagcactttgggaggtcgaggtaggtggatcacgtgaggtcaggacttcaagaccagcctggcgaacatggtgaaaccccatctcta

SEQ ID NO: 118201 - DNA, 601 bp, Human
agtgcatgggaagttttatccaagtagcagtttccctgggattataaaaatccccgaggcatttgtcttggtgttgtgcctttttttggttgtgttttttcacgtccctcccctcccctttctccataaacaagagaggcattaacttggaatgtccgtggaaagtcttagaagctgattggtgtaatttgcctgccttccctttagtttgaacagcgtttactctggaagaggtcagtggcctttttcttggttgtgatttatgcaagtgttatctgaaggcgagtggagtgagtttacrtgggatttgctgtttgccacctgttgttgtgctggctccttccttcctgggatgagttccattctctccccctcccccaggagtgaggctccccagccagagcagtccccctgtgcttatccccttccttcgtaaactgcagccatttgtgattttccataaccacttttatagacacataataatttcctttgaatcagtttgcattttaaattaagttttgaaaggaaaactgacaagagtatggcaactggaaaacccagctcccctggccataaatataatagaaggaaactgcaa

SEQ ID NO: 118202 - DNA, 601 bp, Human
acttgggaaaaaaacttgatctcatctggtcgaggtgggcagggcagcaccttgtccaggagcacacagcccctcttggctctgtgtgtcatccggccatactagactcgaacatatggctcatgactggatgatgcttgattcatcttcagtttcaagtgttagtgcttttgaggttttgtaagaaaccaggacacattgaaaatacagtcatttctcagtatctgtgggggattggttccaggaacccccttatataccaaaatccacagatgctcaagttccttatgtaagataaaaygatgtgtaatttgcattttaactatgcacatcctcctgaatactttaaatcatctctagattacttataacctaatgctaaatgctacgtaaatggttgttacactgtgctgtttaggaaataatgacaaaaatatgtacatgttcagtgcagatgcaaccattcattttttttcttccagtattttcgatccattgttggttgaattcacagatagagaacccatggatacagagggctagctgtaagaaatgtgggtttatcatttgttcctcacacaacttttttctttcttcgttt

SEQ ID NO: 118203 - DNA, 601 bp, Human
gatgtcttttgagagtgggtggaagccacagtctaggtggatcagaggaagcacagaaggcaggcagtataccccactttgtgttttccatgtctgaagggaacacatttggtttttgttctgttttgattttttagagacagggtttcactgtcacccaggctggagtgcagtggcctaatcataactcactgcagccttgaactcttgggctcaagggatctttcagcctcagcctccctagtagctgggattatgtgtgcaccaccatggccagctaattttaattttttttttttttgagatggagtctcactctgtcacccaggctggagtgcagtagcacgatctcagctcactgcaacctctgcctccccggttcaagtgattctcctgcctcagcttcccaagtagctgggattacaggcgcgcgccacgacgcccagctaatttttgtatttttagtagagacagggtttcaccatgttggccaggctggtcttgagctcctgaccttaagcgatccacccaccttggcccaacaaagtgctggggttacaggcatgagccactgtgcccgaactaatttttaaattttttg

SEQ ID NO: 118204 - DNA, 601 bp, Human
gtaatgcccacctaggcctcccaaagtgctgggattacaggtatgagccaccgcgcccagcccctttgtaactttcattaacactgatgaggcacaagccataggatagaattgaatccattgagagctgtgagccaattgagggatgattggttaatagattgtggcttgaagctgtggaaggtaaggggtgacacttgactcctattagccttgtagaaacacctcagagattcacaggaagcaaactttgaccataaaaatataagactcacagcgcaccgagttctcttagcagctrccttagagttgagaaagttttgggcctctttaataaacaagcacaaagcagttcttgccaaatacggcctgctctggggccacagggttagcttaggagacaactttcttgcctaaaaataaatgcatgttcctatcagacattccaagcatagtttaaacatgagacttctgagcagcagctcaagctctgtgggttcaattatgtcagagtatgggcagtgagggtctttggggagtgtgcccccttatttgggattggttgtggctaccaaggaaatcagatgatcaaatgcaaaac

SEQ ID NO: 118205 - DNA, 601 bp, Human
cacaaagcagttcttgccaaatacggcctgctctggggccacagggttagcttaggagacaactttcttgcctaaaaataaatgcatgttcctatcagacattccaagcatagtttaaacatgagacttctgagcagcagctcaagctctgtgggttcaattatgtcagagtatgggcagtgagggtctttggggagtgtgcccccttatttgggattggttgtggctaccaaggaaatcagatgatcaaatgcaaaacttcctccatcttatttctatatgatcttttttttttttttttgagttggagtcttgctctgttgcccaggctggagtgcagtggcaggatctcagctcactgcagcctctgtctcccagattcaagctattattctcctgcctcagccttccaaatagctgggactacaggcgtggccatcatgtccggctaatttttgtatttttagtagagacagggttttgccatgttggccaggctggtctccaactcctgacctcaggtcatccacccgctttggcctcccagagtgctgggattacaggcatgggccaccgcccccagccttatttctacacgttc

SEQ ID NO: 118206 - DNA, 601 bp, Human
gttagcttaggagacaactttcttgcctaaaaataaatgcatgttcctatcagacattccaagcatagtttaaacatgagacttctgagcagcagctcaagctctgtgggttcaattatgtcagagtatgggcagtgagggtctttggggagtgtgcccccttatttgggattggttgtggctaccaaggaaatcagatgatcaaatgcaaaacttcctccatcttatttctatatgatcttttttttttttttttgagttggagtcttgctctgttgcccaggctggagtgcagtggcakgatctcagctcactgcagcctctgtctcccagattcaagctattattctcctgcctcagccttccaaatagctgggactacaggcgtggccatcatgtccggctaatttttgtatttttagtagagacagggttttgccatgttggccaggctggtctccaactcctgacctcaggtcatccacccgctttggcctcccagagtgctgggattacaggcatgggccaccgcccccagccttatttctacacgttcttgatctatcacaggctggtgggggagacagcatgcatatagata

SEQ ID NO: 118207 - DNA, 601 bp, Human
tctatcacaggctggtgggggagacagcatgcatatagataatgaacaaggtaacttcagataggattatgtgcaataaattaaataacagctagcattttaccttgtgctagacactattctaagtgcttcccatggactgactggtttttgtttttttttctttcctttgagactgagtttcgctcttgttgcccaggctggagtgcaatggcgtgttcttggctcactgcaacctccgtctcctgggttcaagcaattctcctgcctcagcctcccgagtagctgggattacaggcaygtgccaccatgcctggctaatttttgtatttttagtagagacggggtttctccttgttggtcaggctggccttgaactcccaacctcaggtgacccacccgcctcagccaccccaagtgctgggattacaggcgcgagccaccatgcccgacccatggactcacttgtataatcttgtgaagcaggtgttgttacccttacatgcagaaatggatccatgggcctttaagccacttgcccctgtgacagtgccaggatttgaatgtagaagttgaggctttcaagtttatgctgttattt

SEQ ID NO: 118208 - DNA, 601 bp, Human
cgagtggtcagagcggagcccgtggaagagatgggcacagccagattgcttagagctgtgttgttagaagtgctgatgagtctacattcaacttgcgcctgcaaactcagtccctcttagatgccagtaggtcaggaacctcatgcttccaggactctggcgctcctaccctttcctcccaggcctcctggacaggccaaaccagaactgacttctaaagtgggaaccccaagacggcagaacatgaatcagccaaacaaaagctgcagttatctctgtgatgatttcggcagtcggcacstgtatttgattaaagcgttggtaactttgaatctggagttttatggcactgtgtactactcataatggctttgtagtgtggctctcttagggagcttaacttttacaacatgaacaagttccagcctcctttggtcccatcaagaggccatttctacctggtgggatgccacttgctttacaaagcatcttttgtaaaatgttgagtctccttctttgaagttggaagccaggaagcctgattttttttccaataagtattgtagaagatggcagcctgatttatttttatttatttatt

SEQ ID NO: 118209 - DNA, 601 bp, Human
gagtttcctgcatggtcccaggggctgggaggagccacctgctcagctggtggttagctgatagcacccagcctacccaccaagataggaggcagctcagatgtcactgggattcgcagtaccacaggctgtccctgggcccaagcagttagctagctgcaccccgggagggggtgttgagagcactgaagctcctgtgggagagtgcctttgacatcccccactccccactgcccagaactaggaggtagtgaaaggtgtcagtggcaagaaggctgggccagagcatggagggaggccracctgggctccacacccacctcctccaccaccggctggctgtgcgaccctgggcaggtggcgggggttaagcctcagtgtccttctttgaaaaggggcatcatcctatcctcagtttgaggattagacgtgatagtgcgcaggaagcactctggtgcctggtacattgtaagtgctcaataaatgcagcttcccaaaatgatttcaatggcacatggtcctgcatccaggtgggatctgctacttgagtctccccctcaaaggggcctgctgaaatacgcagctcagtgggaaaccaaaa

SEQ ID NO: 118210 - DNA, 601 bp, Human
ggcttggagatacaacaagaaagaaaaccaacccaaccctgtccttaaagaaaagatggacgatgaagggccaggcgcagtggctcactcctgtaatcccagcactttgggaggccaaggcgcacagatcacgaggtcgggagtttgagaccatcctggccaacatggtgataccccgtctctactaaaatacaaaacattagctgggcatggtggtgcgcgcctgtagtcccagctactcaggaggctgaggcaggggaattgcttgaacctgagaggcggaggttgcagtgagccgagrtcgtgccactgcactccagcctggcaagagagtgagactccatcgcaaaaaaagaaaaaagaaaaaaagaaaagatggacaatgaattgcatgatggaagtgaacagtgttagggcgatatgcagatgtaaatgtggtcttgttttactgctcactgacttactgaagtaaacccattgacttcgccttcatgggtttgaaaagggtttttccaatgtgctctgtgtgtctcggagctcaggtgttcagagctgcctcccttataaatcgacctccaggagagttgtgtgtttggttctt

SEQ ID NO: 118211 - DNA, 601 bp, Human
tgggaggccaaggcgcacagatcacgaggtcgggagtttgagaccatcctggccaacatggtgataccccgtctctactaaaatacaaaacattagctgggcatggtggtgcgcgcctgtagtcccagctactcaggaggctgaggcaggggaattgcttgaacctgagaggcggaggttgcagtgagccgaggtcgtgccactgcactccagcctggcaagagagtgagactccatcgcaaaaaaagaaaaaagaaaaaaagaaaagatggacaatgaattgcatgatggaagtgaacaatgttagggcgatatgcagatgtaaatgtggtcttgttttactgctcactgacttactgaagtaaacccattgacttcgccttcatgggtttgaaaagggtttttccaatgtgctctgtgtgtctcggagctcaggtgttcagagctgcctcccttataaatcgacctccaggagagttgtgtgtttggttcttggtgtatggtttcgtaggctccccagggctgaggagtcaccttgggatccagctttttttcttttttcgagacagtctctccctgtcgcccaggctgaaatgcagtg

SEQ ID NO: 118212 - DNA, 601 bp, Human
tactccaacttaaaaaaaaaaaaaaaaacctgcaggccatacaaaatagggcctattgggtgtgaagagctacccatttgtgacccctaaccttgcatggtcttgaccctgtctctgcctctcctctagtctcccctttcctcttgtctgaattgctgctgcttaatcctctcactaggagcgagaaaattgtactttgccccttagtgacagctctgataaaaggtggttgaagtggatggtagtaaaaagggtttgctttagctgtggttttccagcctccggactcctccccctttcycatcaccatagataattaagagttgactcctcaaaattcctcccaccatattgcatatttttaggcttcaggtttttgtgaaccaaaatagtggaaagtttttttgtttgtttgttttgggtagcccaaagcaacacttttctacagaggcagccattctgcacgcacaataacctggtgaacaatgccagctttctattaataaatgaactgccagttcagaatttgtacccatgtggcagatggacagaaatagtttctttaggattgatctcttaaatttgactttgggaagatact

SEQ ID NO: 118213 - DNA, 601 bp, Human
tgaaccaaaatagtggaaagtttttttgtttgtttgttttgggtagcccaaagcaacacttttctacagaggcagccattctgcacgcacaataacctggtgaacaatgccagctttctattaataaatgaactgccagttcagaatttgtacccatgtggcagatggacagaaatagtttctttaggattgatctcttaaatttgactttgggaagatactggcagtccaggttttgtgacagagatccatcctgagatctttgtaaatggaaaagcctgaatgcagcgtttcttattgmtaggagagttgatggatttcaggaaaatgggatatagtagatgtgcaatgaatttgttgacttggaaacaaatttggacacttatccctgaaaacttcaggccattttttcctaaactctaattgagtccctgtgattggagtactagccccacagtccttatcaaacttcgcatttggagcaggcagtctgtctgggaaaagccaggaagctcgccatgaaggcatcgccctctgcttttaacttttttaggctctgttacctctgcactggcttgagtatttcctggctcaattgttt

SEQ ID NO: 118214 - DNA, 601 bp, Human
gactttgggaagatactggcagtccaggttttgtgacagagatccatcctgagatctttgtaaatggaaaagcctgaatgcagcgtttcttattgataggagagttgatggatttcaggaaaatgggatatagtagatgtgcaatgaatttgttgacttggaaacaaatttggacacttatccctgaaaacttcaggccattttttcctaaactctaattgagtccctgtgattggagtactagccccacagtccttatcaaacttcgcatttggagcaggcagtctgtctgggaaaagcyaggaagctcgccatgaaggcatcgccctctgcttttaacttttttaggctctgttacctctgcactggcttgagtatttcctggctcaattgtttctcaggctggccttgagtccttagatgttatttgtgtgcctagaaatagctggaagaaaaatggttgtaatgctttgcattgctcactgctctccatggatggaaattctgtgagggaaagagggctttccacccagaaaaagagctgggcagcgtagacttcattgtcctgctggcctgtcatgttattctgctatactacagc

SEQ ID NO: 118215 - DNA, 601 bp, Human
taatgctttgcattgctcactgctctccatggatggaaattctgtgagggaaagagggctttccacccagaaaaagagctgggcagcgtagacttcattgtcctgctggcctgtcatgttattctgctatactacagcgattaggatgagagagtttctcgctctccctgggtgtgccacctaaggtacattagggtagggacgaacatggcgggagttctcatagtgggctttcctgccagacgtatggcccacacagcagtatttcttacatgtggttcttttttttttttttttttttgagacggagtctttctctgtcgcctaggctggagtacagtggcgtgatatcggcttactgcaacctccacctcccaggttcaagcaattctcctgcctcagcctcctgagtagctgggaccacagatgcatgccaccacacctggctaatttttgtatttttagtagagacgtggtttctccatgttggccaggctggtcttgaactcctgacctcaagtgacccactcgccttggcttcccaaagtgttgggattacaggtgtgagctaccacaccctgccaaggttctattatttgat

SEQ ID NO: 118216 - DNA, 601 bp, Human
ggcctgtcatgttattctgctatactacagcgattaggatgagagagtttctcgctctccctgggtgtgccacctaaggtacattagggtagggacgaacatggcgggagttctcatagtgggctttcctgccagacgtatggcccacacagcagtatttcttacatgtggttcttttttttttttttttttttgagacggagtctttctctgtcgcctaggctggagtacagtggcgtgatatcggcttactgcaacctccacctcccaggttcaagcaattctcctgcctcagcctccygagtagctgggaccacagatgcatgccaccacacctggctaatttttgtatttttagtagagacgtggtttctccatgttggccaggctggtcttgaactcctgacctcaagtgacccactcgccttggcttcccaaagtgttgggattacaggtgtgagctaccacaccctgccaaggttctattatttgatctatgttctttgtttgtttgtttgtttgttttgagatggagtttcgctcttgttgcccaggctggagtgtaatggcacgatctcggctcaccgcaacctctgtctcc

SEQ ID NO: 118217 - DNA, 601 bp, Human
agtgttgggattacaggtgtgagctaccacaccctgccaaggttctattatttgatctatgttctttgtttgtttgtttgtttgttttgagatggagtttcgctcttgttgcccaggctggagtgtaatggcacgatctcggctcaccgcaacctctgtctcccgggttcaagcaattctcctgcctcagcctcctgagtagctgggataacaggcatgtgccaccacacccggctaattttgtatttttagtagagacggggtttctccatgttggtcaggctggtctcaaactcctgamctcaagtgatccacctgccttggcctcccaaagtgttgggattacaggcgtgagccaccatgcccggcccctgtaaccatttttaagtgattgatcatctcagcatgattgatggagatgatggggttggccatccattcttttttttttttttttttggagacagtctcactctgtctccaaggctggagtgcagtggcacaatcttggctcactacaacctctgcctcctgggttcaagcgattcttctgcctcagcttcccaattagctgagattacatgcatgcaccaccatgcct

SEQ ID NO: 118218 - DNA, 601 bp, Human
tctcccgggttcaagcaattctcctgcctcagcctcctgagtagctgggataacaggcatgtgccaccacacccggctaattttgtatttttagtagagacggggtttctccatgttggtcaggctggtctcaaactcctgaactcaagtgatccacctgccttggcctcccaaagtgttgggattacaggcgtgagccaccatgcccggcccctgtaaccatttttaagtgattgatcatctcagcatgattgatggagatgatggggttggccatccattcttttttttttttttttttggagacagtctcactctgtctccaaggctggagtgcagtggcacaatcttggctcactacaacctctgcctcctgggttcaagcgattcttctgcctcagcttcccaattagctgagattacatgcatgcaccaccatgcctggccagtttttgtgtttttaatagagacagggttttatcatgttggccaggctggtctcaagcccctgacctcaggtgatccccccacctcagcctcccaaagtgctaggattacaggcatgagccaccacacccggcctattcatcatttattgagc

SEQ ID NO: 118219 - DNA, 601 bp, Human
gcctcctgggttcaagcgattcttctgcctcagcttcccaattagctgagattacatgcatgcaccaccatgcctggccagtttttgtgtttttaatagagacagggttttatcatgttggccaggctggtctcaagcccctgacctcaggtgatccccccacctcagcctcccaaagtgctaggattacaggcatgagccaccacacccggcctattcatcatttattgagcatttatttatacccactatgtgccgtaaacaaggtgctgagtaatgagatgtgaacagaatagtcctycttcttgtcctcatggagcacacagcctagtcggggacaataggcattaaaaaataccaacaatgaaaacccaagacatacatagagtgttccaaattgtggttttattttttatatatatatattcatatatatttatatatatttatatatatattcatatatatttatatatatgaatatatatttatatatatgaatatatatttatatatatgaatatatatttatatatattcatatatacttatatatatttatatatacttatatatatttatatatattcatatatattta

SEQ ID NO: 118220 - DNA, 601 bp, Human
atatgtataattttttttttttttttttttgtgatggagtctctatcacccaggctggagtgcagtagcgtgatctcagctcactgcaacctctgcctcccaggttcaagcaattctctgcctcagcctcctgagtagctgggattacaggtgcctgccaccacgtccggctaatttttgtatttttagtagagatgggatttcaccatcttggccaggctggtcttgaactcctgaccttgtgatctacccgcctcggcctcccaaagtgctgggattacaggcgtgagccactgcgccyggtgtgattatttttatgaaggaaaagaccagagtcctttaagaggggacagtgggggacttgcaatagattgtgtgggagctgtcaggggagactttccaagatgatgacagtgaagtgaggcctggagggagagttagagccaacctcagagaagggaacactgttctaggcaggaggacccagggttgtgggaagagagaaataaaatgagaccaagacagtggggagagcagtgtgagttgaagtcagaggggtgacagcagccagaatgtgccggtagcgaggatcttggatttt

SEQ ID NO: 118221 - DNA, 601 bp, Human
cttggattttattctagctgcaatgagagctttgattctacaaatatttattgcgtgctagtcactgttttaggtactgggtgtacaacagtgaaaaaagaacttcccagccgagtggaatgccgtggagcatatctgtttcgatgctgggacagatccctaacacagctcattaaagcagatagcaccattccgtctctttcttcagcttcactttacgtcagtcccagcatttttatccctacccttacagatgagagaactaaagttcagagaggtgacgtgacttgccccaggcccctcagtcagtaaaagacagaactgagaatccaaccagactcttccctttttaggttatttctctaacattagggccgagtatcgattctctttacctctgacttcgtgtccctggtattaagactcagggcccacagtgcctcttggaattcaggcatatggtgacatcagtgtgcctaccattcaggtcttggagaatagggtatggcgaaaggagagaactcgtgatatcgctgattcagtagcccagagttgtacgagtccttgggtgtttcaccttcatccaggcatctgagattgg

SEQ ID NO: 118222 - DNA, 601 bp, Human
ggataaggaatatgagccagtagagacgagtgtgttgtatagcagtgtcctgcgactgggctggagacgtggctgagggaggccagggggcctcagagtgcacgggaggaggcttacagaggtcttttgcatcctgcagaacaccacatgtgtccttccctctgggaaacctcccacccgggcagggcctctggggccggatgtggaaggtaaacaggctgcctttctgctctctaccacagacaggcccggaaaggcctgagtaggagcttttcatctcaggaagccctgaggtcccacrgcttctcctgaagcagcctcattgtccctttgtaagagcatgaccaggtgctctagctcctggagcaccagtggagaactagagtggcccaggtgctgatgccaagttcgagcaacagctcctggcgggtttccctgcatccccccactcactcccatctattcttcacataggggccaaagaacatcctgcttgacatcttgatcagtgtcccttgccctcaggatcaaacctgcaagtccccaaggccctgcaggatctgttttctcctctctgtgctccgggcgcatgccagctgcc

SEQ ID NO: 118223 - DNA, 601 bp, Human
actcttcttcctcatctcctatggctaaattctctccctctgtccactgcttacacatgggcatttcacaatgtcctttttccctgaaggaacttaccccctcccctcagccttaagtaccccatctgtggggatgatgcccatgcctgtagtcctgactcactcaccacgctctatcgcagttatttactgatgcatctctctcccctatcagacgctgaggtctttgatggagcaaccttgtatttgtccgtgtatccccagcaccacacctgtccatagctggagctcaggaagtttkttttttttttttttttttaaagtcagagtctcactcagtcgcccaggctagagtgcagtggcacaatcttggctcactgcaacctccacctcctgggttcaagcaagcacgtctgggtaatttttgtatttttagtagagatggggtttcaccatttggccaggctggtctcgaagtcctgactgcaagtgatctggccgcctttggctcccagattgctgggattacagacaggcatgagccactgcgcccggcctcaggaagtagttgaatgagtgactgaatgaatgcccacgtgag

SEQ ID NO: 118224 - DNA, 601 bp, Human
accttgtatttgtccgtgtatccccagcaccacacctgtccatagctggagctcaggaagttttttttttttttttttttttaaagtcagagtctcactcagtcgcccaggctagagtgcagtggcacaatcttggctcactgcaacctccacctcctgggttcaagcaagcacgtctgggtaatttttgtatttttagtagagatggggtttcaccatttggccaggctggtctcgaagtcctgactgcaagtgatctggccgcctttggctcccagattgctgggattacagacaggcrtgagccactgcgcccggcctcaggaagtagttgaatgagtgactgaatgaatgcccacgtgagcaaatgacctgtttgctgaactttagactgacgttgcctgatgcccactgcttgtgcagtacgtacttcagtctcagcgtgtctgagaccaaactcattttcaagtcccacttcttgggcttggcattgcccatttgtcagccatccgagtcagaaaccttggagtcagcttttgacttctcatcctgtaacaggcaccaagtttgatttctttcccttgaatatctcttagaaccc

SEQ ID NO: 118225 - DNA, 601 bp, Human
ggtgacagagtgagactccaatctctagaaaaaaaaaaaaaaaaaaaaaaaagcagattctaaactcacagtgctgctgctggctgcctgagcttgtgtggctttggacagatgacttaaccactctgtgaagatggtatctgatgcacaggaaatgctccaacgttggctcttgtcgtcatctgtgcccatgtctccctcagcagcctcctgactggccttctccagtctcctggtttggattgaggctccctagaccctacctttctgagactggtatctagtcaggttactctgggasatctccaccccccactgcccagagagcaggttctgagctcttcagtctctccaccttctggccccggctgacaccatccctgccacttctcctggggtccccaaacatctgtggtacttttgtctttcttgcccttggtgttcccactctgcagaacaaccttctctccaggtcaccactgatcgcaatcgcgctctcctttcaaggcccagatcaggtgtcacctgacctttgctgtcctcagatcacacctccctgtagcgactggctcgccagtgtccctctctgaccgagctgtgc

SEQ ID NO: 118226 - DNA, 601 bp, Human
tcatctgtgcccatgtctccctcagcagcctcctgactggccttctccagtctcctggtttggattgaggctccctagaccctacctttctgagactggtatctagtcaggttactctgggagatctccaccccccactgcccagagagcaggttctgagctcttcagtctctccaccttctggccccggctgacaccatccctgccacttctcctggggtccccaaacatctgtggtacttttgtctttcttgcccttggtgttcccactctgcagaacaaccttctctccaggtcaccrctgatcgcaatcgcgctctcctttcaaggcccagatcaggtgtcacctgacctttgctgtcctcagatcacacctccctgtagcgactggctcgccagtgtccctctctgaccgagctgtgcactcctccagggcagcactgtcagggtctcccccagacccttggttgtgattctctctccttgtcctgaatctcagttttcctgatacatgggatgctacctgaaggcaggtttcaactttcaatctttttttttgttttttgggtgagatggagtcttgctctgttggtcaggctgg

SEQ ID NO: 118227 - DNA, 601 bp, Human
cccaggtccttttagttctctccagcctcactgctggaaccctcacccaagccaccaccttgcagtccacacacggccactgggattggggcggcgttctccgcgcgaaatctggctgtgctcctcccccatgaggccctccaaaggcttcctcttcttaggatgaaacccacactgccagccgaagctcctcaggctcccaccctctacaagctccttctgctccagccacactcaccaggcccgagttcccacctagcaccttccctgggaatgatctccccctggttggctctttctmcttattcagcctcaaatgtcatctccactgagaggcctttcctgacctgctgagcttgattccctcccctccccagtcacattactccgtgttatggtacccatccctgtctccttagcttgtttttgtctgtattggctcttccactagactgtaagttgcatgagggcagggatgtctgtttaatcccagtgctcaggatagtgtatggctcgtgatagatgcctagtacattttaaaatgagaacgaatgaagtttgggagaggctcagagcagtgagtctcccccttgttggggga

SEQ ID NO: 118228 - DNA, 601 bp, Human
aggatgaaacccacactgccagccgaagctcctcaggctcccaccctctacaagctccttctgctccagccacactcaccaggcccgagttcccacctagcaccttccctgggaatgatctccccctggttggctctttctacttattcagcctcaaatgtcatctccactgagaggcctttcctgacctgctgagcttgattccctcccctccccagtcacattactccgtgttatggtacccatccctgtctccttagcttgtttttgtctgtattggctcttccactagactgtaagytgcatgagggcagggatgtctgtttaatcccagtgctcaggatagtgtatggctcgtgatagatgcctagtacattttaaaatgagaacgaatgaagtttgggagaggctcagagcagtgagtctcccccttgttgggggactggggagtgcctgggaggggctatctggtgccagcggtttggagtggctgggatgactctggaatcctgtgaggcccagtcagtttctttggttctcatgcagtgcagtgccctcagacctaaccattttgttccgtgctggcttgaaagggtctgcc

SEQ ID NO: 118229 - DNA, 601 bp, Human
cctgggaggggctatctggtgccagcggtttggagtggctgggatgactctggaatcctgtgaggcccagtcagtttctttggttctcatgcagtgcagtgccctcagacctaaccattttgttccgtgctggcttgaaagggtctgcctccctcccagtgcagcccctgcctctcctctttctcgccccccgccctcctccagagaaagcaggtggtgagggctctctaacccagacaggacttgctgttcagccccagcttgaaattgatttcctccagccctccttgagccaggcccygtgaacagaggaggggtctgagccaggcctcctaggccattggtgggagggagaatgagacagccatttggcccacaggccaccaacttttcccccccttctctaaaagacacacaatggcagttgggctgcacctttgtgagtcaccggtgatagcccatcataaattgttatttcctatatttccagagcagctttatcgggcgttgcctgtgcagtccgggaaccgatttgatatggggtcagttaacatgctgtcttgttgaaatctgtcatcatgcccatataaggcaaactcct

SEQ ID NO: 118230 - DNA, 601 bp, Human
gacaggacttgctgttcagccccagcttgaaattgatttcctccagccctccttgagccaggccccgtgaacagaggaggggtctgagccaggcctcctaggccattggtgggagggagaatgagacagccatttggcccacaggccaccaacttttcccccccttctctaaaagacacacaatggcagttgggctgcacctttgtgagtcaccggtgatagcccatcataaattgttatttcctatatttccagagcagctttatcgggcgttgcctgtgcagtccgggaaccgatttgrtatggggtcagttaacatgctgtcttgttgaaatctgtcatcatgcccatataaggcaaactccttgggttactttttaccttggcagaatcacaggaatgtcaaggtaaccaggccacctcagcatagctctgattctcacccggtcacctgacttgcccgccctcccccatgactcacccagtggctcagcatggggcctgctgcactgtggctgctggaatctgccaaggacctcctgggactgcccttggttttgtgtcttccttagagtagatcaaatgagaggaaccatgtgaa

SEQ ID NO: 118231 - DNA, 601 bp, Human
gggccccacctgccttgggttgagacctatctcttcctggactctgtgtggggagtgcaggctcttccccttggggagaacccagttctttgacgtataatctgagtggtttgggttggttggttggttggttggttggtttcccatgtgtgggatggctccggaagtctgtttgagaacagaggcaggctcagatgggagcagctcctaccccgggccgcctatccccctttaccctggggtttcttttagctccaagcatccattccagtctaacaaatctggtggcagagtctctttkttttttttttttgagacagagtctcactctgttgcccaggctggagtacagtggcacaatctcggctcactgcagcctccgcctcctgggctcaagcgattctcttgcctcagcctcctgagtatctgggattacaggcgtgtgccaccacgtctggctaatttttctgtattattagtagagacggctggtctctactaatagttcaagacggctggtcttgaactcctgacctcaaatgatccacctgcctcagcccccccaaagtgctgggattacaggcgtgagcccctgcaccca

SEQ ID NO: 118232 - DNA, 601 bp, Human
cattccagtctaacaaatctggtggcagagtctcttttttttttttttttgagacagagtctcactctgttgcccaggctggagtacagtggcacaatctcggctcactgcagcctccgcctcctgggctcaagcgattctcttgcctcagcctcctgagtatctgggattacaggcgtgtgccaccacgtctggctaatttttctgtattattagtagagacggctggtctctactaatagttcaagacggctggtcttgaactcctgacctcaaatgatccacctgcctcagcccccccaaagtgctgggattacaggcgtgagcccctgcacccagcccctctggttctactgagacctcagatctttcatttatggaacaagggggttggattagattgttcgctctcagccctcacttcatgttagactcactaggtggactttgtcaaatgtcattgcccagggcccaccttgagggaatctgtctcattttgcctgtggtgaaattcaggtatttttaaaaagctcccaggtcccatacatctattgtcaattgattttcaacaagggtgcaggaccattcaatgggggaaaga

SEQ ID NO: 118233 - DNA, 601 bp, Human
ttcaacaaatagtgcaggaacaactattaatagatacccatctgcaaagaatgaagttgaacctttacctcacaccatatacaaaaattaactccaaacggatcagatacctaaatgtaagagctaaaactgtaaaactcttagaagaaaacacaagtgtaaatctcatgaccttgggttaggcaatggttattagatatgacagcagaaacacaaccgaagaaaaatagataaatcagactgtttcaaaactggaaactttttgcttcaaaggacactattaaagtaaaaggacaacccrcagaatatttacaaattgtatatctgataagggtctactgtccaaaatgtataaaggactcttaaattcaacagtaaaaagacacaccagttaaaaatgggcaaaggattcaaatagacacttctccaaagaagatctacaaatggtcaataagcacatgaaaaggtgttcgatgtcattactaattagggcaaatcaaaaccataaccactacaaatggtcaataagcacatgaaaaggtgttcaatgtcattactaattagggcaaatcaaaaccataacgtggttgggcctggtggc

SEQ ID NO: 118234 - DNA, 601 bp, Human
aattccaacatttttggaggtagaagtgggaggatggcttggggccacgaattggagaccagcctgggcatcatagtgagaccctgcctctacagagaattaaaataaaaaattaggccgggtatggtggctcatgcctgtaatcctagcactttgggaggccgaggcgagtggatcacctgaggtcaggagtttgagaccagcctggcaaacatggtgaatgaaaccttgtctctaccaaaaaaaaaaaaaaaaaaaaacccacaaaaattagctggacatggtggtgggcgcctgttgkcccagctagtggggaggctgaggtgggagaatcgcttgaacctgggtgggagaggttgcattgagccgagatcacgccattgcactccagcctgggcaacagggtgagaccctgtctctaaataataataaaaatgagaaattggccaggtgtagtagcatattcctgggaggctgaggtgggcagattgcttgagcccaggagttcaaggctgcagtgagctatgatgacaccactgtactccagcctgggcaacagagtaagaccccaaccctaaaacaaaaaaaaacagaaaaccac

SEQ ID NO: 118235 - DNA, 601 bp, Human
attggagaccagcctgggcatcatagtgagaccctgcctctacagagaattaaaataaaaaattaggccgggtatggtggctcatgcctgtaatcctagcactttgggaggccgaggcgagtggatcacctgaggtcaggagtttgagaccagcctggcaaacatggtgaatgaaaccttgtctctaccaaaaaaaaaaaaaaaaaaaaacccacaaaaattagctggacatggtggtgggcgcctgttgtcccagctagtggggaggctgaggtgggagaatcgcttgaacctgggtggsagaggttgcattgagccgagatcacgccattgcactccagcctgggcaacagggtgagaccctgtctctaaataataataaaaatgagaaattggccaggtgtagtagcatattcctgggaggctgaggtgggcagattgcttgagcccaggagttcaaggctgcagtgagctatgatgacaccactgtactccagcctgggcaacagagtaagaccccaaccctaaaacaaaaaaaaacagaaaaccacaatgagataccactgcacacccaccatgatggctataatcagaaagtcag

SEQ ID NO: 118236 - DNA, 601 bp, Human
aggagtttgagaccagcctggcaaacatggtgaatgaaaccttgtctctaccaaaaaaaaaaaaaaaaaaaaacccacaaaaattagctggacatggtggtgggcgcctgttgtcccagctagtggggaggctgaggtgggagaatcgcttgaacctgggtgggagaggttgcattgagccgagatcacgccattgcactccagcctgggcaacagggtgagaccctgtctctaaataataataaaaatgagaaattggccaggtgtagtagcatattcctgggaggctgaggtgggcagrttgcttgagcccaggagttcaaggctgcagtgagctatgatgacaccactgtactccagcctgggcaacagagtaagaccccaaccctaaaacaaaaaaaaacagaaaaccacaatgagataccactgcacacccaccatgatggctataatcagaaagtcagataataagtattgactaggatgggagaaatcagaaccctcacattgctggtcaaagtgtaatgtggtgcagcttcttgggaaaacagtctggcagttcctcaaaatttaaacatgttttgtatttttagtagagacg

SEQ ID NO: 118237 - DNA, 601 bp, Human
tcctcaaaatttaaacatgttttgtatttttagtagagacggggtttcaccatgtcacccaggctggtcttgtctcagcctcccaaagtgttggaattacaggcatgagccaccacgcccagccaagttcctcaaatttttaaatataagaggtatcatatgactcagcaattttactcctaggtatatgcccaaggcagttgaaaacatgtccacataaaacttgtacatgaatattcacggtggtgctaatatccaaaagatagaagcaacacaaataatgcccatcagccaatgaatkgataaataaaatgtggtatatccatacaatggaatgttattcagacaggaacgaagtactggtacatgctacaacatggctgaaccttgaaaacatgctaaggagaagccaaactcaaagatcatataccatatggttccacttatatgaaatgcccagaataggtaaattgcaagagacgaaagaaaggtaggttagtggttgccaggggctgggggctgggtaggagggaagtggggttggagagtaactgtaccagttttgcggtggtagacatgttccttgtatttttggtttttt

SEQ ID NO: 118238 - DNA, 601 bp, Human
attacaggcatgagccaccacgcccagccaagttcctcaaatttttaaatataagaggtatcatatgactcagcaattttactcctaggtatatgcccaaggcagttgaaaacatgtccacataaaacttgtacatgaatattcacggtggtgctaatatccaaaagatagaagcaacacaaataatgcccatcagccaatgaattgataaataaaatgtggtatatccatacaatggaatgttattcagacaggaacgaagtactggtacatgctacaacatggctgaaccttgaaaacrtgctaaggagaagccaaactcaaagatcatataccatatggttccacttatatgaaatgcccagaataggtaaattgcaagagacgaaagaaaggtaggttagtggttgccaggggctgggggctgggtaggagggaagtggggttggagagtaactgtaccagttttgcggtggtagacatgttccttgtatttttggttttttgttttgttttgttgttttgagataaggtctcactgtcgcccaggctagagtgcagtggcgctgtcatagctcactgtagcctcgaattcccaggc

SEQ ID NO: 118239 - DNA, 601 bp, Human
tgacttccacccctccggatccagcagggtgtctgctgcatttctgatccagcgaggcgcccattgctgctcattcgggctagaggctcgccattgttcctgtgcggctcagtgctcgagtttgtcctaatcgagctaaacactagtcgctgggttccatggttctcttccatgacccacggcttctaatagagctataacactcactgcatggcccaaggttcaattccttggaatccgtgaggccaagaatgttaggtcagagaacaaaaggcttgctgccatcttgggagcagccacyaccaacttgggagctctaagaacaaagacccaccggtaacagccaggctggtcttgaactcctgacctcgtgatctgcccgccttggcctcccaaagtgctgggattacaggcgtgagccaccttgcctagccttgttctggaattagtggtgattgttgcacgatcttgtgaatatactaaaactccctgaattttatgtaaaagggtgaattttttggtatgttatgtgaattacatttcaatttttaaaaattgattctccaaattatgtacatatttaaagagtacatgaaagaga

SEQ ID NO: 118240 - DNA, 601 bp, Human
agtaaaacaatgcagtgtgaggccgggtgtgttggctcacgcctgtaattccagcactttgggaggccgaggtgggcggatcacctgaggttgggagttcgagactagcctgaccaacatggagaaactccgtctctactaaaaataaaaaattagccaggcctgtaatcccagctactcgggaggctgaggccagagaatagcttgaactcaggaggcagaagttgcgttgagctgagatcatgccattgcactccagcctgggcaacaaaagtgaaactccgtctcaaaaaaaaaaaaacaaaaaaaacaaaaaaaaaaacccaacaacgcagagtggagtgatagcctaggggagatgacagagtccaggaaggcctcctgggttgctgacatttgaggcaagtcctgagtgatgagacaaaaccagctctataaagagctagacgaaagtcttagaccagtatttctcatgaggaggagacagcactccaaaatccatcctttggcctggcgcggtggctcacgcctgtaatcccagcactttgggaggctgaggcgggtggattacctgagatcaggagttcgagaccagcctggc

SEQ ID NO: 118241 - DNA, 601 bp, Human
aacaatgcagtgtgaggccgggtgtgttggctcacgcctgtaattccagcactttgggaggccgaggtgggcggatcacctgaggttgggagttcgagactagcctgaccaacatggagaaactccgtctctactaaaaataaaaaattagccaggcctgtaatcccagctactcgggaggctgaggccagagaatagcttgaactcaggaggcagaagttgcgttgagctgagatcatgccattgcactccagcctgggcaacaaaagtgaaactccgtctcaaaaaaaaaaaaacaaacaaaacaaaaaaaaaaacccaacaacgcagagtggagtgatagcctaggggagatgacagagtccaggaaggcctcctgggttgctgacatttgaggcaagtcctgagtgatgagacaaaaccagctctataaagagctagacgaaagtcttagaccagtatttctcatgaggaggagacagcactccaaaatccatcctttggcctggcgcggtggctcacgcctgtaatcccagcactttgggaggctgaggcgggtggattacctgagatcaggagttcgagaccagcctggccaaca

SEQ ID NO: 118242 - DNA, 601 bp, Human
gccgggtgtgttggctcacgcctgtaattccagcactttgggaggccgaggtgggcggatcacctgaggttgggagttcgagactagcctgaccaacatggagaaactccgtctctactaaaaataaaaaattagccaggcctgtaatcccagctactcgggaggctgaggccagagaatagcttgaactcaggaggcagaagttgcgttgagctgagatcatgccattgcactccagcctgggcaacaaaagtgaaactccgtctcaaaaaaaaaaaaacaaaaaaaacaaaaaaaaaaacccaacaacgcagagtggagtgatagcctaggggagatgacagagtccaggaaggcctcctgggttgctgacatttgaggcaagtcctgagtgatgagacaaaaccagctctataaagagctagacgaaagtcttagaccagtatttctcatgaggaggagacagcactccaaaatccatcctttggcctggcgcggtggctcacgcctgtaatcccagcactttgggaggctgaggcgggtggattacctgagatcaggagttcgagaccagcctggccaacatggcagaaacccgtct

SEQ ID NO: 118243 - DNA, 601 bp, Human
cattgcactccagcctgggcaacaaaagtgaaactccgtctcaaaaaaaaaaaaacaaaaaaaacaaaaaaaaaaacccaacaacgcagagtggagtgatagcctaggggagatgacagagtccaggaaggcctcctgggttgctgacatttgaggcaagtcctgagtgatgagacaaaaccagctctataaagagctagacgaaagtcttagaccagtatttctcatgaggaggagacagcactccaaaatccatcctttggcctggcgcggtggctcacgcctgtaatcccagcacttygggaggctgaggcgggtggattacctgagatcaggagttcgagaccagcctggccaacatggcagaaacccgtctctactgaaaatataaaaattagccgggtgtgatggtgggtgcctgtaatgccagctactcgggaggctgaggcaggagaatcacttgaacccgggaggtggaggctgcagtgagccgagatcatgccaccgcactccaacctggcgacacagcgagactctgtctcaaaacaaacaaacaaacaaaatccgtcctttgcagcagcaacacgcacgctttctggca

SEQ ID NO: 118244 - DNA, 601 bp, Human
aattagccgggtgtgatggtgggtgcctgtaatgccagctactcgggaggctgaggcaggagaatcacttgaacccgggaggtggaggctgcagtgagccgagatcatgccaccgcactccaacctggcgacacagcgagactctgtctcaaaacaaacaaacaaacaaaatccgtcctttgcagcagcaacacgcacgctttctggcacctcaaaggggattgtccaagactggaacactggctgcagggagggggccgggtgcaaagagctggtttctgggtggacacgcaggaccttwggaatgctcgctaccccactcagcagtatttatacctcttctccaactgcgaagtcagagctttttcatgcaggctgagaaaactccgaataaggcaacttcaggccaggacataagacgcattccatatttcactgtaattgctttcaaattaggttatgtcgtcatgtaacaggcacacacagtgcacttgctttgcccctggctggggttgggtcctggacaggctgccccgtgtgtcgctgaactgccgcagtgctagccctgattgcctgggcagtagggctgtctgcgtcccac

SEQ ID NO: 118245 - DNA, 601 bp, Human
cacctcaaaggggattgtccaagactggaacactggctgcagggagggggccgggtgcaaagagctggtttctgggtggacacgcaggacctttggaatgctcgctaccccactcagcagtatttatacctcttctccaactgcgaagtcagagctttttcatgcaggctgagaaaactccgaataaggcaacttcaggccaggacataagacgcattccatatttcactgtaattgctttcaaattaggttatgtcgtcatgtaacaggcacacacagtgcacttgctttgcccctggcyggggttgggtcctggacaggctgccccgtgtgtcgctgaactgccgcagtgctagccctgattgcctgggcagtagggctgtctgcgtcccacgttgctgcacccatctaatttgtggctgtgttattgtgacctgctcgttttctgttctttcaacctgcttcctggcttttatctccttcagaatctggtggcagtggatcttcaaaaagtgctcaggtgtgcagtctcacaggccagaggctccacgggcccccttgccagggcgagcatctctgcctgtgccgctggtaacccaga

SEQ ID NO: 118246 - DNA, 601 bp, Human
caggaactgaaaagatgccccagtggggctaggccttgcctgaggtctggcaatagcctgccagatgggtgataagaaggcctacccaggtgataagcctacccaggaataaatagctgtacctcccctgtgtccaagccctggacacccttccctaggacccatggaagcaggaaccatgggcagcgtcagaggccacagcaggcaaggtggaagttcaggaggtgggacggcgccctccccctcaaagcaactgatgccccagcggagcgacaaaccctacacggtatttcagagccarggtttgaaaactcccagggtgctagggagctccgtctggcctccgggtacctggggttggggctggctgtggccagttgcagtcaaccctgagcctgggcaaaatgcatgcaggctggtcctcctgggtgatatcctgctaggcgggtgggcagtgtacacggcagaagagggttgcggcatgaggcagcaaacgtttttttctaaaatcttgtcaagcgtggggtccgtggaatccacatgtgagcatcagcctggtgggtggggagagtgaagcctgcgatccagtctggatcatgtg

SEQ ID NO: 118247 - DNA, 601 bp, Human
agtctggatcatgtgctacacagtgcagagccggcatgctcacccctcctgagggatcgctcgagcctatttctaggcccaaagcgactttgcaagagactccctttattctgggcttagtggaattccagcttccaacagccatttccctccacccccttcagttctgagaacatgttttgtaacaggaaggcaggaagaaaagagaaggcgagtttgttcagctgggtcagccgcatcccaccaaggccctttcttccctccagctcaccatcgctctgcccactggaaccactcggtkgccctgtgtctgccgaatgtttgtttcttaatcagcgccccagagtagagagggctttgcctcttcgggttgagggagggaatcattgatgaatggctcattaaagcccactgctgccacattcctgggtgcttaggtcacctcctgaacaatatccatcattcattcacctaccgccccacatcctggcggctgggaggggtccctgtgacgcaggaaggactttatgaccagagatgctaggtctccgtctccctcctgcagcccacagtgacaaagcagaaactgctcttggggccc

SEQ ID NO: 118248 - DNA, 601 bp, Human
aggcaggaagaaaagagaaggcgagtttgttcagctgggtcagccgcatcccaccaaggccctttcttccctccagctcaccatcgctctgcccactggaaccactcggttgccctgtgtctgccgaatgtttgtttcttaatcagcgccccagagtagagagggctttgcctcttcgggttgagggagggaatcattgatgaatggctcattaaagcccactgctgccacattcctgggtgcttaggtcacctcctgaacaatatccatcattcattcacctaccgccccacatcctggyggctgggaggggtccctgtgacgcaggaaggactttatgaccagagatgctaggtctccgtctccctcctgcagcccacagtgacaaagcagaaactgctcttggggccccctgaagcccgccttagctgggtcaccatgggccttggcacacggaggggtgacagtggatcccaactcaactgacaagcttgcctttctctgttcttccaccccccttccccgcactcacaccctgtgctattttagcaaccagagaagcctctttaataggctgcccgtgtgcaggggcaagctctga

SEQ ID NO: 118249 - DNA, 601 bp, Human
ggggtccctgtgacgcaggaaggactttatgaccagagatgctaggtctccgtctccctcctgcagcccacagtgacaaagcagaaactgctcttggggccccctgaagcccgccttagctgggtcaccatgggccttggcacacggaggggtgacagtggatcccaactcaactgacaagcttgcctttctctgttcttccaccccccttccccgcactcacaccctgtgctattttagcaaccagagaagcctctttaataggctgcccgtgtgcaggggcaagctctgaagcctcctstctgtggtttggttcacatgtgttctcaaagacagatgagtccacatccttccttcctccctagataggtcaagggctgggtgcaggctgccttcacaggagggccagggacaggctgggaggagcggggccaccttttgcgaagcgggtgatctgctggggcgttgctctgcctgcctgccttgttctctgagtttacctctagcttggggaccaagggtgggctggggccttctttttttttttttgaaaccgagtcttactctgtctcccaggctggagtgcagtggcgcgatcttg

SEQ ID NO: 118250 - DNA, 601 bp, Human
tgctgtctctccctcactggccagcacctcccattctactcagacatcgtggaatgaatgcccaccccgtgtttgtatgtatcatctgtgtctgtgtgacattaagcaagtcactgaacctctccctgcctcagtttcctcatcaaatggagataatatcgcatgtgatcatggggttggaggttttaaagagttgctaatgtgtaaatagtaagaactagcaattagccgttatagcataattacctttaatatgtcatgccccccgcacccccgtgctgaatgtaattttgcgggggggcgggttgagacagggtctggctctgtcaccgaggctggagtgcactaacacaatctcagcttactgcaacctctgcctctcaggcacaagctgtcttcccacctcagcctctcgagtagctgggactacaggcgctcagtaccacgcctggctaatttttgtagtttttgtagagatggggttttgccatgttgcctaggctgatctcaaactcctgtgctaaagcaatcctcccgcctcggcctcctaaagtgctgggattacatggtgtgtgccaccatgcctggctggccagaatgt

SEQ ID NO: 118251 - DNA, 601 bp, Human
cattctactcagacatcgtggaatgaatgcccaccccgtgtttgtatgtatcatctgtgtctgtgtgacattaagcaagtcactgaacctctccctgcctcagtttcctcatcaaatggagataatatcgcatgtgatcatggggttggaggttttaaagagttgctaatgtgtaaatagtaagaactagcaattagccgttatagcataattacctttaatatgtcatgccccccgcacccccgtgctgaatgtaattttgcgggggggcgggttgagacagggtctggctctgtcaccsaggctggagtgcactaacacaatctcagcttactgcaacctctgcctctcaggcacaagctgtcttcccacctcagcctctcgagtagctgggactacaggcgctcagtaccacgcctggctaatttttgtagtttttgtagagatggggttttgccatgttgcctaggctgatctcaaactcctgtgctaaagcaatcctcccgcctcggcctcctaaagtgctgggattacatggtgtgtgccaccatgcctggctggccagaatgtaaatgataactgttttgcttcctcctgtgtc

SEQ ID NO: 118252 - DNA, 601 bp, Human
atggccactgccacgttctggacagtcagagtcgctgctgcccctggaagatgaccgcgatcatgaagcccaggagagctcgatgctttttgcctttccctcctcccacagagggctggcagctctggttcctcccaaatgaaatagaaaccttgagtttgcatttcttctttggcgtgccggcagggcacctctgccttcctcttcctgccagggggaggaagtttctctcaggggctcttcaccctgctttattcctggccatcacacattgacccttgtccccttcggctctttcccygcatggcagggacagcatgaccgtttaatggctttgtgaggccagcatgccagcctcacttctttactcccttccttctcggagtgggctctgtcccttctgcaggagggctttggcacatgctcttcccagtatctggaaggtctccctcatttttatcttattaactcctcatccttcagctcagagtttgagaatgacttcttcaaggacacctttctgtgtctgcctcaccagtcgcttggtgcccccccaccccgccaccatgctgaccgcactcttcagctcccatcccagggg

SEQ ID NO: 118253 - DNA, 601 bp, Human
tctgcaaaatggaggcagtactagcacctccctccagagatgattacgagggtgacagaattagtaagtgaccaagtgcctcgagcagtgcccgcccctagtagactctatggaagtgtctgctgcagttattgctgttattattaccacttttcctaagggcgttatttctggagtggactgatcgcttgattaatgagatcagacctggagcctcatgagagtgtctgcttttgctcactgttatggattcagcacagggcctggccctctgctgacccccagcatatgcttgtccagrgaatgaatatgtacggacccatggtggcctggggcatcatgaggtcggctgcccacattctgagaattttgcatggtggagggcggcgtggtgggcgcatagggcccccatctatagaaaccacctctccacaccatccaccccacgcagcgtagtctaaaccgggtagggagaggaaggatggaagcagagtgttatttttgtaaccaagtagaagaagcgatgaatttttaatgtcccattcgaactccagctcctactcaccagtctctccgcatggagaagtggccgtcatggtcg

SEQ ID NO: 118254 - DNA, 601 bp, Human
acagaattagtaagtgaccaagtgcctcgagcagtgcccgcccctagtagactctatggaagtgtctgctgcagttattgctgttattattaccacttttcctaagggcgttatttctggagtggactgatcgcttgattaatgagatcagacctggagcctcatgagagtgtctgcttttgctcactgttatggattcagcacagggcctggccctctgctgacccccagcatatgcttgtccagagaatgaatatgtacggacccatggtggcctggggcatcatgaggtcggctgccmacattctgagaattttgcatggtggagggcggcgtggtgggcgcatagggcccccatctatagaaaccacctctccacaccatccaccccacgcagcgtagtctaaaccgggtagggagaggaaggatggaagcagagtgttatttttgtaaccaagtagaagaagcgatgaatttttaatgtcccattcgaactccagctcctactcaccagtctctccgcatggagaagtggccgtcatggtcgacctgttcccaagggtggccttgtgagtgcaggctctcctcaccagagctgagg

SEQ ID NO: 118255 - DNA, 601 bp, Human
ctctccacaccatccaccccacgcagcgtagtctaaaccgggtagggagaggaaggatggaagcagagtgttatttttgtaaccaagtagaagaagcgatgaatttttaatgtcccattcgaactccagctcctactcaccagtctctccgcatggagaagtggccgtcatggtcgacctgttcccaagggtggccttgtgagtgcaggctctcctcaccagagctgagggctttgtgaacctctgatgtcaatagatgcccctcatcttccaggaggacaaaacagggcaaagcaagacwtggggtgagaacaggagtgcatcagtggggttccccaagcctgtgtcaggtccggatctgggtgggagttcccttctgcgtcatccaggccaggcgagtgggcatcctccctgagcacctgtgcttggggctttgcctgtgtcagtcaggaagacagagtacacggaagagttaccattgctttcagagcaaaccttcctttgacatgcatttaacacagcacggagtgattgacatgtgtccttgtgtttaatccctatcttaacctctcggttactgtcctgtttatcagtgaggaaa

SEQ ID NO: 118256 - DNA, 601 bp, Human
catccaccccacgcagcgtagtctaaaccgggtagggagaggaaggatggaagcagagtgttatttttgtaaccaagtagaagaagcgatgaatttttaatgtcccattcgaactccagctcctactcaccagtctctccgcatggagaagtggccgtcatggtcgacctgttcccaagggtggccttgtgagtgcaggctctcctcaccagagctgagggctttgtgaacctctgatgtcaatagatgcccctcatcttccaggaggacaaaacagggcaaagcaagacatggggtgagracaggagtgcatcagtggggttccccaagcctgtgtcaggtccggatctgggtgggagttcccttctgcgtcatccaggccaggcgagtgggcatcctccctgagcacctgtgcttggggctttgcctgtgtcagtcaggaagacagagtacacggaagagttaccattgctttcagagcaaaccttcctttgacatgcatttaacacagcacggagtgattgacatgtgtccttgtgtttaatccctatcttaacctctcggttactgtcctgtttatcagtgaggaaactgaggctta

SEQ ID NO: 118257 - DNA, 601 bp, Human
ttttaatgtcccattcgaactccagctcctactcaccagtctctccgcatggagaagtggccgtcatggtcgacctgttcccaagggtggccttgtgagtgcaggctctcctcaccagagctgagggctttgtgaacctctgatgtcaatagatgcccctcatcttccaggaggacaaaacagggcaaagcaagacatggggtgagaacaggagtgcatcagtggggttccccaagcctgtgtcaggtccggatctgggtgggagttcccttctgcgtcatccaggccaggcgagtgggcrtcctccctgagcacctgtgcttggggctttgcctgtgtcagtcaggaagacagagtacacggaagagttaccattgctttcagagcaaaccttcctttgacatgcatttaacacagcacggagtgattgacatgtgtccttgtgtttaatccctatcttaacctctcggttactgtcctgtttatcagtgaggaaactgaggcttattgcttgcctgaggcctcagtggcagaagcaagatgtgaatccgcacctgtgtgatgcccaagccagagctcttgtttactacccagagaagat

SEQ ID NO: 118258 - DNA, 601 bp, Human
actacccagagaagatgagcacaggtgggatgtacgtatggagggcgggtagggcagcagcccctctgaggacaggtggccagaacccaagcggcgaggtttgttcacagcctccacagggtggggtggggccatccgcagagggtctcctgccatcccattttccctgcataccagtgggtggtctgagagcctttgcagagaagagactggatctcagcacgtgcttatgtgcgtgtgtacatgcacacacatgcgtgtgattcatctggctcttactttatgccaaggagcctgtcasatgctttaaatgtattttccctagtttaattcttagagcacactgcaggaggtagattctgataaatccatcttacagggaaggaaacagacttaagtaggtaaagtcacttggttgaaaacatggaatgagtaagccaaggggcaggtattcaaacccaaacccaggtctgtgcccctgcagagcctgcaggagcagcccacacaggccaaggctgtgaggggtgctgtttgcacgcgtgcgtggccctccctgcagcccaggtgcctaggtctgggcctggcaacaccagagcacggg

SEQ ID NO: 118259 - DNA, 601 bp, Human
gtagggcagcagcccctctgaggacaggtggccagaacccaagcggcgaggtttgttcacagcctccacagggtggggtggggccatccgcagagggtctcctgccatcccattttccctgcataccagtgggtggtctgagagcctttgcagagaagagactggatctcagcacgtgcttatgtgcgtgtgtacatgcacacacatgcgtgtgattcatctggctcttactttatgccaaggagcctgtcacatgctttaaatgtattttccctagtttaattcttagagcacactgcargaggtagattctgataaatccatcttacagggaaggaaacagacttaagtaggtaaagtcacttggttgaaaacatggaatgagtaagccaaggggcaggtattcaaacccaaacccaggtctgtgcccctgcagagcctgcaggagcagcccacacaggccaaggctgtgaggggtgctgtttgcacgcgtgcgtggccctccctgcagcccaggtgcctaggtctgggcctggcaacaccagagcacggggccttgccctcggggaacagccctcttttgtcctcaggctgtgggatg

SEQ ID NO: 118260 - DNA, 601 bp, Human
accagtgggtggtctgagagcctttgcagagaagagactggatctcagcacgtgcttatgtgcgtgtgtacatgcacacacatgcgtgtgattcatctggctcttactttatgccaaggagcctgtcacatgctttaaatgtattttccctagtttaattcttagagcacactgcaggaggtagattctgataaatccatcttacagggaaggaaacagacttaagtaggtaaagtcacttggttgaaaacatggaatgagtaagccaaggggcaggtattcaaacccaaacccaggtctktgcccctgcagagcctgcaggagcagcccacacaggccaaggctgtgaggggtgctgtttgcacgcgtgcgtggccctccctgcagcccaggtgcctaggtctgggcctggcaacaccagagcacggggccttgccctcggggaacagccctcttttgtcctcaggctgtgggatgtgtcttggctactttgctgcccagcagtgcctgctctcaggcacatgtgagagtagaggcctagcatccgtggccacttccttcccagcccatttgctgctgccctttgctctgcagggctgct

SEQ ID NO: 118261 - DNA, 601 bp, Human
gtgtacatgcacacacatgcgtgtgattcatctggctcttactttatgccaaggagcctgtcacatgctttaaatgtattttccctagtttaattcttagagcacactgcaggaggtagattctgataaatccatcttacagggaaggaaacagacttaagtaggtaaagtcacttggttgaaaacatggaatgagtaagccaaggggcaggtattcaaacccaaacccaggtctgtgcccctgcagagcctgcaggagcagcccacacaggccaaggctgtgaggggtgctgtttgcacrcgtgcgtggccctccctgcagcccaggtgcctaggtctgggcctggcaacaccagagcacggggccttgccctcggggaacagccctcttttgtcctcaggctgtgggatgtgtcttggctactttgctgcccagcagtgcctgctctcaggcacatgtgagagtagaggcctagcatccgtggccacttccttcccagcccatttgctgctgccctttgctctgcagggctgctgggctcctgggctccacgcctgcttgctgcctgccatcaaggctggcagtgctctggggctgtaa

SEQ ID NO: 118262 - DNA, 601 bp, Human
catgcgtgtgattcatctggctcttactttatgccaaggagcctgtcacatgctttaaatgtattttccctagtttaattcttagagcacactgcaggaggtagattctgataaatccatcttacagggaaggaaacagacttaagtaggtaaagtcacttggttgaaaacatggaatgagtaagccaaggggcaggtattcaaacccaaacccaggtctgtgcccctgcagagcctgcaggagcagcccacacaggccaaggctgtgaggggtgctgtttgcacgcgtgcgtggccctcyctgcagcccaggtgcctaggtctgggcctggcaacaccagagcacggggccttgccctcggggaacagccctcttttgtcctcaggctgtgggatgtgtcttggctactttgctgcccagcagtgcctgctctcaggcacatgtgagagtagaggcctagcatccgtggccacttccttcccagcccatttgctgctgccctttgctctgcagggctgctgggctcctgggctccacgcctgcttgctgcctgccatcaaggctggcagtgctctggggctgtaaaggtgcaggcgccgt

SEQ ID NO: 118263 - DNA, 601 bp, Human
gcccagcagtgcctgctctcaggcacatgtgagagtagaggcctagcatccgtggccacttccttcccagcccatttgctgctgccctttgctctgcagggctgctgggctcctgggctccacgcctgcttgctgcctgccatcaaggctggcagtgctctggggctgtaaaggtgcaggcgccgtacttcccaacccctggagctcgcacatggtaggagagaaagctcatgtgcatgcaacatccaataagactaaaagtgactgggggttgctacgggagaggtgctgagggtgggcyggggacagagcaggcacactgtggagggggtgggcaggactcctgagaccagggcagggagggaggagatgctgggaggcacagggccatccagagagctgccacttcctgagcattgccatgcacgctgcaggcatggccatcttgagtcctcacactgcccgtggcctaggtggggtcttcatccccacgttgcagaggaggaaatggaagttaggaaggttaggtgacgtgcccacatgagtggtgtaagcatggttcccgccctgggctctctgaattcagtattgtatgggggag

SEQ ID NO: 118264 - DNA, 601 bp, Human
catgctgggtccacactggtatggcgtattaattaggcagctgctttgtctgggagggggctttgtgtcgagtctccctgaatgagcagggctggcgacagttgtcaaaacacatggtgcttggtcagagcccccgtagaagccccttgtcctccgcatggcctccgcctgcacccggggcgtggaatgtgctcttgtgtgtccctggctgtctgcttgcttctacactggcccctgcagatggagggggtggggtacaggggttcctataagaagcagacacttggggtttttcccaggycctgttgcaggagggtgcgtgggctggtttccctgaaggcgcctgggcgtgttggtgttaactgatctgagatcttctgtggccctgatgtctatgagcatgccccagcttgcagggggctgagtagccgggcaccaccaggaggctgcgtgccctgtgcttgggtgtacccatgccctgtcagcatcgttggtctgttagggtcagggacttcggcttcttgtttagtaccctccatcccttccagttgatcatcagaaacattctccttagatgcggctgcctgaccccggtgagggg

SEQ ID NO: 118265 - DNA, 601 bp, Human
cttgcttctacactggcccctgcagatggagggggtggggtacaggggttcctataagaagcagacacttggggtttttcccaggccctgttgcaggagggtgcgtgggctggtttccctgaaggcgcctgggcgtgttggtgttaactgatctgagatcttctgtggccctgatgtctatgagcatgccccagcttgcagggggctgagtagccgggcaccaccaggaggctgcgtgccctgtgcttgggtgtacccatgccctgtcagcatcgttggtctgttagggtcagggacttcrgcttcttgtttagtaccctccatcccttccagttgatcatcagaaacattctccttagatgcggctgcctgaccccggtgagggggcctgcctcccacttgccttccagcctcctctaagctgcactgagtcttaaaaataggaaggatagggctgggtgtggtggctcacgcctgtaatcccagcagtttgggagaccgaggcgggtagatcacttgaggccaggagttcaagaccagcctggccaacatggtaaaaccccatctctactaaaaagacaaaaattagatgggcatgttg

SEQ ID NO: 118266 - DNA, 601 bp, Human
ttcccaggccctgttgcaggagggtgcgtgggctggtttccctgaaggcgcctgggcgtgttggtgttaactgatctgagatcttctgtggccctgatgtctatgagcatgccccagcttgcagggggctgagtagccgggcaccaccaggaggctgcgtgccctgtgcttgggtgtacccatgccctgtcagcatcgttggtctgttagggtcagggacttcggcttcttgtttagtaccctccatcccttccagttgatcatcagaaacattctccttagatgcggctgcctgacccccgtgagggggcctgcctcccacttgccttccagcctcctctaagctgcactgagtcttaaaaataggaaggatagggctgggtgtggtggctcacgcctgtaatcccagcagtttgggagaccgaggcgggtagatcacttgaggccaggagttcaagaccagcctggccaacatggtaaaaccccatctctactaaaaagacaaaaattagatgggcatgttggcatacacccgtagtcccagctactcaggaggctgaggcatgagaatcgcttgaacccaggaggtagagattgcagt

SEQ ID NO: 118267 - DNA, 601 bp, Human
ttgtttagtaccctccatcccttccagttgatcatcagaaacattctccttagatgcggctgcctgaccccggtgagggggcctgcctcccacttgccttccagcctcctctaagctgcactgagtcttaaaaataggaaggatagggctgggtgtggtggctcacgcctgtaatcccagcagtttgggagaccgaggcgggtagatcacttgaggccaggagttcaagaccagcctggccaacatggtaaaaccccatctctactaaaaagacaaaaattagatgggcatgttggcatayacccgtagtcccagctactcaggaggctgaggcatgagaatcgcttgaacccaggaggtagagattgcagtgagctgagattgcgccacagcactccagcctgggtgacagagcgagactccttctcaaaaaaaaaaaaaggaaaaaaaagaataggaaggatagggcatggcatgttctccaggagacagagggacgggggcatcttgcttgcaggaagccaggcgacacaggcgtgtgtgcagggctcagagggtctgtgttcctggcctttcctgggagggcttgctcttgggctgc

SEQ ID NO: 118268 - DNA, 601 bp, Human
acgcctgtaatcccagcagtttgggagaccgaggcgggtagatcacttgaggccaggagttcaagaccagcctggccaacatggtaaaaccccatctctactaaaaagacaaaaattagatgggcatgttggcatacacccgtagtcccagctactcaggaggctgaggcatgagaatcgcttgaacccaggaggtagagattgcagtgagctgagattgcgccacagcactccagcctgggtgacagagcgagactccttctcaaaaaaaaaaaaaggaaaaaaaagaataggaaggatrgggcatggcatgttctccaggagacagagggacgggggcatcttgcttgcaggaagccaggcgacacaggcgtgtgtgcagggctcagagggtctgtgttcctggcctttcctgggagggcttgctcttgggctgcccaaagctcaaagagagactcgaggaaatcctgcatttatgggagcttttcttttcctgccactttcctgttctgggttgtatctgtgcacgtgattggaacgtagcagcctgagctcctgcctgaggagagcagccacgggtcacggaagccagggtccagct

SEQ ID NO: 118269 - DNA, 601 bp, Human
ggcgggtagatcacttgaggccaggagttcaagaccagcctggccaacatggtaaaaccccatctctactaaaaagacaaaaattagatgggcatgttggcatacacccgtagtcccagctactcaggaggctgaggcatgagaatcgcttgaacccaggaggtagagattgcagtgagctgagattgcgccacagcactccagcctgggtgacagagcgagactccttctcaaaaaaaaaaaaaggaaaaaaaagaataggaaggatagggcatggcatgttctccaggagacagagggrcgggggcatcttgcttgcaggaagccaggcgacacaggcgtgtgtgcagggctcagagggtctgtgttcctggcctttcctgggagggcttgctcttgggctgcccaaagctcaaagagagactcgaggaaatcctgcatttatgggagcttttcttttcctgccactttcctgttctgggttgtatctgtgcacgtgattggaacgtagcagcctgagctcctgcctgaggagagcagccacgggtcacggaagccagggtccagctggggcctttgggtctagctggcagatgaaggg

SEQ ID NO: 118270 - DNA, 601 bp, Human
aaacaatgtgtgtatcggccatgtacggtgtgtgtcggcgagtgctccgtggcagctgcggttctcctgaggtcagagctgcggccctgcaggtgtgtggagagagccccgacagccaggctgactctgcgcactgtcctttgttctgcttccccagaccttcacggcatggtgcaactcccacctgcggaaggcaggcacacagatcgagaacattgatgaggacttccgagacgggctcaagctcatgctgctcctggaggtcatatcaggtgagactcccagccacgcagtgcggccsagccctggcacaggtgctctgccacagcggtccccagagaccctgcccacccagctgtcccattgctcctggggaggagagggcaccccttaatagctgcacggtggtctgatgggtggggccagagtggcctggtgggccagcagaggaacctgcttttggagaacagaggagactctaaagcctctctccctctcgccctctctccctttctctctctctgtctcgccccctcttttctctttgtgcacttctcaggggagcggttacctaagccggagcgggggaagatgagagtgc

SEQ ID NO: 118271 - DNA, 601 bp, Human; identical to SEQ ID NO: 39492

SEQ ID NO: 118272 - DNA, 601 bp, Human; identical to SEQ ID NO: 39491

SEQ ID NO: 118273 - DNA, 601 bp, Human; identical to SEQ ID NO: 39490

SEQ ID NO: 118274 - DNA, 601 bp, Human; identical to SEQ ID NO: 39489

SEQ ID NO: 118275 - DNA, 601 bp, Human; identical to SEQ ID NO: 39488

SEQ ID NO: 118276 - DNA, 601 bp, Human; identical to SEQ ID NO: 39487

SEQ ID NO: 118277 - DNA, 601 bp, Human; identical to SEQ ID NO: 39486

SEQ ID NO: 118278 - DNA, 601 bp, Human; identical to SEQ ID NO: 39485

SEQ ID NO: 118279 - DNA, 601 bp, Human; identical to SEQ ID NO: 39484

SEQ ID NO: 118280 - DNA, 601 bp, Human; identical to SEQ ID NO: 39483

SEQ ID NO: 118281 - DNA, 601 bp, Human; identical to SEQ ID NO: 39482

SEQ ID NO: 118282 - DNA, 601 bp, Human; identical to SEQ ID NO: 39481

SEQ ID NO: 118283 - DNA, 601 bp, Human; identical to SEQ ID NO: 39480

SEQ ID NO: 118284 - DNA, 601 bp, Human; identical to SEQ ID NO: 39479

SEQ ID NO: 118285 - DNA, 601 bp, Human; identical to SEQ ID NO: 39478

SEQ ID NO: 118286 - DNA, 601 bp, Human; identical to SEQ ID NO: 39477

SEQ ID NO: 118287 - DNA, 601 bp, Human; identical to SEQ ID NO: 39476

SEQ ID NO: 118288 - DNA, 601 bp, Human; identical to SEQ ID NO: 39475

SEQ ID NO: 118289 - DNA, 601 bp, Human; identical to SEQ ID NO: 39474

SEQ ID NO: 118290 - DNA, 601 bp, Human; identical to SEQ ID NO: 39473

SEQ ID NO: 118291 - DNA, 601 bp, Human; identical to SEQ ID NO: 39472

SEQ ID NO: 118292 - DNA, 601 bp, Human; identical to SEQ ID NO: 39471

SEQ ID NO: 118293 - DNA, 601 bp, Human
cataatgaaaatgcgaacaaccttttctctggacactggggaatctagtctggtggataaagatggatggctgttaaacgatcacatcttgggctctgtgtgttcagtgaagcctcatttaccagatctctctgatgagaaaggtgaatggtggggacaaaatacatgctgttatcagaagtctggcgggggccctgtgcagtggcaagcacctgtagtcacagccactcgggaggcagaggtgggaagatcgcttgagcccaggaggttgaggctgcattgagctatgatggcaccattrtactccagcctggttgacagagtgagaccctgtctaaaaaaggaaaagaagtttagggggaaagcttttaggaggtggatgatggttaattttaattccacctaacattttaaactttggtatgtcaaaaggtgagaattgccagtgtcgaggcatggaaaccaaaggaaaactagagggttgagaaggtgggaagggccgcagtgtggcaggcggcagttactgggatggcttctactaaaggaactcatcgtccaccaccttcaggaaggaggctcctggggccctttaagagagcag

SEQ ID NO: 118294 - DNA, 601 bp, Human
gtggggacaaaatacatgctgttatcagaagtctggcgggggccctgtgcagtggcaagcacctgtagtcacagccactcgggaggcagaggtgggaagatcgcttgagcccaggaggttgaggctgcattgagctatgatggcaccattgtactccagcctggttgacagagtgagaccctgtctaaaaaaggaaaagaagtttagggggaaagcttttaggaggtggatgatggttaattttaattccacctaacattttaaactttggtatgtcaaaaggtgagaattgccagtgtcraggcatggaaaccaaaggaaaactagagggttgagaaggtgggaagggccgcagtgtggcaggcggcagttactgggatggcttctactaaaggaactcatcgtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataata

SEQ ID NO: 118295 - DNA, 601 bp, Human
agccactcgggaggcagaggtgggaagatcgcttgagcccaggaggttgaggctgcattgagctatgatggcaccattgtactccagcctggttgacagagtgagaccctgtctaaaaaaggaaaagaagtttagggggaaagcttttaggaggtggatgatggttaattttaattccacctaacattttaaactttggtatgtcaaaaggtgagaattgccagtgtcgaggcatggaaaccaaaggaaaactagagggttgagaaggtgggaagggccgcagtgtggcaggcggcagttwctgggatggcttctactaaaggaactcatcgtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataataacaagacctaaggcacttactgtgtgccaggcactgttctaagaactcagcacacttcagctcatttaatcc

SEQ ID NO: 118296 - DNA, 601 bp, Human
ctcgggaggcagaggtgggaagatcgcttgagcccaggaggttgaggctgcattgagctatgatggcaccattgtactccagcctggttgacagagtgagaccctgtctaaaaaaggaaaagaagtttagggggaaagcttttaggaggtggatgatggttaattttaattccacctaacattttaaactttggtatgtcaaaaggtgagaattgccagtgtcgaggcatggaaaccaaaggaaaactagagggttgagaaggtgggaagggccgcagtgtggcaggcggcagttactggkatggcttctactaaaggaactcatcgtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataataacaagacctaaggcacttactgtgtgccaggcactgttctaagaactcagcacacttcagctcatttaatccttaca

SEQ ID NO: 118297 - DNA, 601 bp, Human
agaaggtgggaagggccgcagtgtggcaggcggcagttactgggatggcttctactaaaggaactcatcgtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataataacaagacctaaggcacttactgtgtgccaggcactgttctaagaactcagcacacttcagctcatttaatccttacaactatacaaagtttgtagtcttttcgttataccttttgacaggtgagttacttgctggaattcacgtggctagtaaatactggagctgagatttgaaagcaggcaatctggctccagaatctgtgttttcaacccacatactatattgaccatcatgaaaagatggtggtgagcaggcttgtttctaaggatgggagggtcctcataatatttgtatttacagagaggagggagaggtgggttacttcctctcccaa

SEQ ID NO: 118298 - DNA, 601 bp, Human
gtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataataacaagacctaaggcacttactgtgtgccaggcactgttctaagaactcagcacacttcagctcatttaatccttacaactatacaaagtttgtagtcttttcrttataccttttgacaggtgagttacttgctggaattcacgtggctagtaaatactggagctgagatttgaaagcaggcaatctggctccagaatctgtgttttcaacccacatactatattgaccatcatgaaaagatggtggtgagcaggcttgtttctaaggatgggagggtcctcataatatttgtatttacagagaggagggagaggtgggttacttcctctcccaaccccagaaagccaggcatgttggctggcatccctgggacctcagatattcaagcaaccatggccttaca

SEQ ID NO: 118299 - DNA, 601 bp, Human
actctctgggcccttccaatgtttctggcactggtttgatgctgaggacatagagatgaataagaaatggtctctgtcccccagctgataaattatcattgatgatctaccgtgtgccagggactttacaaatgtgattaccatttcttacaacatagtaaggtagatagcatttttgtgttacaggtgaggagtaggaagttcaaaaagtttataaggtcaaagtcacacaactagtcagatgtagaactaacctttggatttgggactgttcaccatcaaatcctatatgcttttgatrcagacaggagacccagaaatactgggtagaagagggtggttccctggcaaaggccctaccctcaaacctggaaacctgcagccctaaatgggaagaggcattcctgttttcatgcccaaaagttgccttttggcccgtcatgtcccctatcctatacctgtataaaccccagaccccaggctccagaagcagatgaggagacaaacagaagagcagaagaatggcagaatggcacagcagagagaagaaaaggaacatctgaatgttgagaggaatttggctgggggcggttggagagga

SEQ ID NO: 118300 - DNA, 601 bp, Human
catgcccaaaagttgccttttggcccgtcatgtcccctatcctatacctgtataaaccccagaccccaggctccagaagcagatgaggagacaaacagaagagcagaagaatggcagaatggcacagcagagagaagaaaaggaacatctgaatgttgagaggaatttggctgggggcggttggagaggagattagccactggacagccaaactccaggggaagatcatcttcccactccatcccccttccagctccccatccatcctgctgagagccacctccaccactcagtgaaaccrctgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccagaaagtgcttgccctggctcctgcacctgcccgtctgcatgctccccctccggtaaggggtttgaggatgtggcggctgaacataagagctatgcccctgtcacac

SEQ ID NO: 118301 - DNA, 601 bp, Human
atggcacagcagagagaagaaaaggaacatctgaatgttgagaggaatttggctgggggcggttggagaggagattagccactggacagccaaactccaggggaagatcatcttcccactccatcccccttccagctccccatccatcctgctgagagccacctccaccactcagtgaaaccactgcattcatccttcaagtttatgtgtgacctgattcttcctggacattggacaaagacctaggtccagtgaactgtctaacacttaagtcatccacggacagcaaggctaacagaaygctgtaacatgtgcccacttggactctgggagttgcagacacccacccgtaggtgctgccatgggtccggagcccagaaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatcca

SEQ ID NO: 118302 - DNA, 601 bp, Human
gccactggacagccaaactccaggggaagatcatcttcccactccatcccccttccagctccccatccatcctgctgagagccacctccaccactcagtgaaaccactgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccaraaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagccaagtcagagtgaggctgatgtgataacaaaagtctgaatacaaggtggg

SEQ ID NO: 118303 - DNA, 601 bp, Human
cagccaaactccaggggaagatcatcttcccactccatcccccttccagctccccatccatcctgctgagagccacctccaccactcagtgaaaccactgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccagaaagtgctygccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagccaagtcagagtgaggctgatgtgataacaaaagtctgaatacaaggtgggagacaatta

SEQ ID NO: 118304 - DNA, 601 bp, Human
ctgagagccacctccaccactcagtgaaaccactgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccagaaagtgcttgccctggctcctgcacctgcccgtctgcatgctccccctccggtaaggggtttgaggatgtggcrgctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagccaagtcagagtgaggctgatgtgataacaaaagtctgaatacaaggtgggagacaattattctgactgaaagggaggcaagagttctgccataggcttgatgctgtgtgtccctggcttcctaa

SEQ ID NO: 118305 - DNA, 601 bp, Human
tttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagccaagtcagagtgaggctgatgtgataacaaaagtctgaatacaaggtgggagacaattattctgactgaaagggaggcaagagttctgccataggcttgatgctgtgtgyccctggcttcctaactcatttgcaaatggaaaatactattccattgtaggaaccttctttttccatttgtctggggaaggagaaagaatggctgggctgaatgaatttatcccttggtcctcttccaacaaagctcagctatgaaagataaatccagctctccccaccccctctcagtggagctggggagaaatcaaaagcccctctgccaataatgagaccaaagtttgcaagggcaggacgagcccgtgctaacagagaaagtgttgtttcctcaatttggttttagactgtcttgtc

SEQ ID NO: 118306 - DNA, 601 bp, Human
atggaaatttggcatgggaagagagggctcacctgtgggcaggatagactctatccaagaaggagaactgaaaaatgaaaacctatgagacaaggggtgatcctgaaggcaggcaggagaaagggctggagggagaggcactggggaatttttcctggtgaatactgaagttactagatgttttgtcttgcaaaactcaagggaaaactctcaaactctaatgtttgtctattctgtgtccaaactgtccttttgaaacggacccacctttcagtaaagaaacttgcattggcctgcccakcctggtgtgttagttctgtggaaactgactggctagggtggccacgggaggaagagcctggttctccctcaccagctccttgtgaagaagggacctggtcaataaggcaaacgacaccacttgccaacatttgatattgccaagtgcttttgtttggcactactatagattttaaaaatgtatctcacttttaaaatttgcattttcttgattacttgtgagattgaacatcttctcatacagcaactggccgttttcatctccttttctgtgaattctagctgttccctatttttccaa

SEQ ID NO: 118307 - DNA, 601 bp, Human
atgggttattcgctttacttactgatctgtaagagttcattacatatactggaaactaatactttgctatatattgttactatcttctcttactctggtcacttttaaaacttcatgtattgtcataagaagtcatacttttcggtggctcatacctgtaatcccagcactttgggaggctgaggcaggcagattacctgaggtcgggagttcgagaccaacctgaccaacacggagaaaccctgtctctactaaaaatacaaaattagctggtgtggtggcacgtgcctgtattcccagmtactcaggaggctgagacaggagaattgcttgaacccgggaagcggaggttatggtgaaccgagatggtgtcattgcactccagcctgggcaacaagaacaaaactccatctcaaaaaaaaaaaaaaaaaaaaaaaaaaagtcatacttttgctttgtttgtcatctttaagaagatcatccctatcgaaggtcataaacatattcttaatattttcacgtgtttattttccaaggttaggtcttagaaaattacaaaataaccatttgtaatttcatgttgtgaaaggtggaggaaagg

SEQ ID NO: 118308 - DNA, 601 bp, Human
tttcggtggctcatacctgtaatcccagcactttgggaggctgaggcaggcagattacctgaggtcgggagttcgagaccaacctgaccaacacggagaaaccctgtctctactaaaaatacaaaattagctggtgtggtggcacgtgcctgtattcccagctactcaggaggctgagacaggagaattgcttgaacccgggaagcggaggttatggtgaaccgagatggtgtcattgcactccagcctgggcaacaagaacaaaactccatctcaaaaaaaaaaaaaaaaaaaaaaaaaaagtcatacttttgctttgtttgtcatctttaagaagatcatccctatcgaaggtcataaacatattcttaatattttcacgtgtttattttccaaggttaggtcttagaaaattacaaaataaccatttgtaatttcatgttgtgaaaggtggaggaaaggaatttcatcttcttgcccccaaacctaaaacccttacttgaatctgagccgattctccttgttcctttcagttacactggaagaagagcccctccttccttcaagccaagtcatccccttgggctctcaccacttcagt

SEQ ID NO: 118309 - DNA, 601 bp, Human; identical to SEQ ID NO: 39492

SEQ ID NO: 118310 - DNA, 601 bp, Human; identical to SEQ ID NO: 39491

SEQ ID NO: 118311 - DNA, 601 bp, Human; identical to SEQ ID NO: 39490

SEQ ID NO: 118312 - DNA, 601 bp, Human; identical to SEQ ID NO: 39489

SEQ ID NO: 118313 - DNA, 601 bp, Human; identical to SEQ ID NO: 39488

SEQ ID NO: 118314 - DNA, 601 bp, Human; identical to SEQ ID NO: 39487

SEQ ID NO: 118315 - DNA, 601 bp, Human; identical to SEQ ID NO: 39486

SEQ ID NO: 118316 - DNA, 601 bp, Human; identical to SEQ ID NO: 39485

SEQ ID NO: 118317 - DNA, 601 bp, Human; identical to SEQ ID NO: 39484

SEQ ID NO: 118318 - DNA, 601 bp, Human; identical to SEQ ID NO: 39483

SEQ ID NO: 118319 - DNA, 601 bp, Human; identical to SEQ ID NO: 39482

SEQ ID NO: 118320 - DNA, 601 bp, Human; identical to SEQ ID NO: 39481

SEQ ID NO: 118321 - DNA, 601 bp, Human; identical to SEQ ID NO: 39480

SEQ ID NO: 118322 - DNA, 601 bp, Human; identical to SEQ ID NO: 39479

SEQ ID NO: 118323 - DNA, 601 bp, Human; identical to SEQ ID NO: 39478

SEQ ID NO: 118324 - DNA, 601 bp, Human; identical to SEQ ID NO: 39477

SEQ ID NO: 118325 - DNA, 601 bp, Human; identical to SEQ ID NO: 39476

SEQ ID NO: 118326 - DNA, 601 bp, Human; identical to SEQ ID NO: 39475

SEQ ID NO: 118327 - DNA, 601 bp, Human; identical to SEQ ID NO: 39474

SEQ ID NO: 118328 - DNA, 601 bp, Human; identical to SEQ ID NO: 39473

SEQ ID NO: 118329 - DNA, 601 bp, Human; identical to SEQ ID NO: 39472

SEQ ID NO: 118330 - DNA, 601 bp, Human; identical to SEQ ID NO: 39471

SEQ ID NO: 118331 - DNA, 601 bp, Human; identical to SEQ ID NO: 118293

SEQ ID NO: 118332 - DNA, 601 bp, Human; identical to SEQ ID NO: 118294

SEQ ID NO: 118333 - DNA, 601 bp, Human; identical to SEQ ID NO: 118295

SEQ ID NO: 118334 - DNA, 601 bp, Human; identical to SEQ ID NO: 118296

SEQ ID NO: 118335 - DNA, 601 bp, Human; identical to SEQ ID NO: 118297

SEQ ID NO: 118336 - DNA, 601 bp, Human; identical to SEQ ID NO: 118298

SEQ ID NO: 118337 - DNA, 601 bp, Human; identical to SEQ ID NO: 118299

SEQ ID NO: 118338 - DNA, 601 bp, Human; identical to SEQ ID NO: 118300

SEQ ID NO: 118339 - DNA, 601 bp, Human; identical to SEQ ID NO: 118301

SEQ ID NO: 118340 - DNA, 601 bp, Human; identical to SEQ ID NO: 118302

SEQ ID NO: 118341 - DNA, 601 bp, Human; identical to SEQ ID NO: 118303

SEQ ID NO: 118342 - DNA, 601 bp, Human; identical to SEQ ID NO: 118304

SEQ ID NO: 118343 - DNA, 601 bp, Human; identical to SEQ ID NO: 118305

SEQ ID NO: 118344 - DNA, 601 bp, Human; identical to SEQ ID NO: 118306

SEQ ID NO: 118345 - DNA, 601 bp, Human; identical to SEQ ID NO: 118307

SEQ ID NO: 118346 - DNA, 601 bp, Human; identical to SEQ ID NO: 118308

SEQ ID NO: 118347 - DNA, 601 bp, Human; identical to SEQ ID NO: 39492

SEQ ID NO: 118348 - DNA, 601 bp, Human; identical to SEQ ID NO: 39491

SEQ ID NO: 118349 - DNA, 601 bp, Human; identical to SEQ ID NO: 39490

SEQ ID NO: 118350 - DNA, 601 bp, Human; identical to SEQ ID NO: 39489

SEQ ID NO: 118351 - DNA, 601 bp, Human; identical to SEQ ID NO: 39488

SEQ ID NO: 118352 - DNA, 601 bp, Human; identical to SEQ ID NO: 39487

SEQ ID NO: 118353 - DNA, 601 bp, Human; identical to SEQ ID NO: 39486

SEQ ID NO: 118354 - DNA, 601 bp, Human; identical to SEQ ID NO: 39485

SEQ ID NO: 118355 - DNA, 601 bp, Human; identical to SEQ ID NO: 39484

SEQ ID NO: 118356 - DNA, 601 bp, Human; identical to SEQ ID NO: 39483

SEQ ID NO: 118357 - DNA, 601 bp, Human; identical to SEQ ID NO: 39482

SEQ ID NO: 118358 - DNA, 601 bp, Human; identical to SEQ ID NO: 39481

SEQ ID NO: 118359 - DNA, 601 bp, Human; identical to SEQ ID NO: 39480

SEQ ID NO: 118360 - DNA, 601 bp, Human; identical to SEQ ID NO: 39479

SEQ ID NO: 118361 - DNA, 601 bp, Human; identical to SEQ ID NO: 39478

SEQ ID NO: 118362 - DNA, 601 bp, Human; identical to SEQ ID NO: 39477

SEQ ID NO: 118363 - DNA, 601 bp, Human; identical to SEQ ID NO: 39476

SEQ ID NO: 118364 - DNA, 601 bp, Human; identical to SEQ ID NO: 39475

SEQ ID NO: 118365 - DNA, 601 bp, Human; identical to SEQ ID NO: 39474

SEQ ID NO: 118366 - DNA, 601 bp, Human; identical to SEQ ID NO: 39473

SEQ ID NO: 118367 - DNA, 601 bp, Human; identical to SEQ ID NO: 39472

SEQ ID NO: 118368 - DNA, 601 bp, Human; identical to SEQ ID NO: 39471

SEQ ID NO: 118369 - DNA, 601 bp, Human; identical to SEQ ID NO: 118293

SEQ ID NO: 118370 - DNA, 601 bp, Human; identical to SEQ ID NO: 118294

SEQ ID NO: 118371 - DNA, 601 bp, Human; identical to SEQ ID NO: 118295

SEQ ID NO: 118372 - DNA, 601 bp, Human; identical to SEQ ID NO: 118296

SEQ ID NO: 118373 - DNA, 601 bp, Human; identical to SEQ ID NO: 118297

SEQ ID NO: 118374 - DNA, 601 bp, Human; identical to SEQ ID NO: 118298

SEQ ID NO: 118375 - DNA, 601 bp, Human; identical to SEQ ID NO: 118299

SEQ ID NO: 118376 - DNA, 601 bp, Human; identical to SEQ ID NO: 118300

SEQ ID NO: 118377 - DNA, 601 bp, Human; identical to SEQ ID NO: 118301

SEQ ID NO: 118378 - DNA, 601 bp, Human; identical to SEQ ID NO: 118302

SEQ ID NO: 118379 - DNA, 601 bp, Human; identical to SEQ ID NO: 118303

SEQ ID NO: 118380 - DNA, 601 bp, Human; identical to SEQ ID NO: 118304

SEQ ID NO: 118381 - DNA, 601 bp, Human; identical to SEQ ID NO: 118305

SEQ ID NO: 118382 - DNA, 601 bp, Human; identical to SEQ ID NO: 118306

SEQ ID NO: 118383 - DNA, 601 bp, Human; identical to SEQ ID NO: 118307

SEQ ID NO: 118384 - DNA, 601 bp, Human; identical to SEQ ID NO: 118308

SEQ ID NO: 118385 - DNA, 601 bp, Human; identical to SEQ ID NO: 39492

SEQ ID NO: 118386 - DNA, 601 bp, Human; identical to SEQ ID NO: 39491

SEQ ID NO: 118387 - DNA, 601 bp, Human; identical to SEQ ID NO: 39490

SEQ ID NO: 118388 - DNA, 601 bp, Human; identical to SEQ ID NO: 39489

SEQ ID NO: 118389 - DNA, 601 bp, Human; identical to SEQ ID NO: 39488

SEQ ID NO: 118390 - DNA, 601 bp, Human; identical to SEQ ID NO: 39487

SEQ ID NO: 118391 - DNA, 601 bp, Human; identical to SEQ ID NO: 39486

SEQ ID NO: 118392 - DNA, 601 bp, Human; identical to SEQ ID NO: 39485

SEQ ID NO: 118393 - DNA, 601 bp, Human; identical to SEQ ID NO: 39484

SEQ ID NO: 118394 - DNA, 601 bp, Human; identical to SEQ ID NO: 39483

SEQ ID NO: 118395 - DNA, 601 bp, Human; identical to SEQ ID NO: 39482

SEQ ID NO: 118396 - DNA, 601 bp, Human; identical to SEQ ID NO: 39481

SEQ ID NO: 118397 - DNA, 601 bp, Human; identical to SEQ ID NO: 39480

SEQ ID NO: 118398 - DNA, 601 bp, Human; identical to SEQ ID NO: 39479

SEQ ID NO: 118399 - DNA, 601 bp, Human; identical to SEQ ID NO: 39478

SEQ ID NO: 118400 - DNA, 601 bp, Human; identical to SEQ ID NO: 39477

SEQ ID NO: 118401 - DNA, 601 bp, Human; identical to SEQ ID NO: 39476

SEQ ID NO: 118402 - DNA, 601 bp, Human; identical to SEQ ID NO: 39475

SEQ ID NO: 118403 - DNA, 601 bp, Human; identical to SEQ ID NO: 39474

SEQ ID NO: 118404 - DNA, 601 bp, Human; identical to SEQ ID NO: 39473

SEQ ID NO: 118405 - DNA, 601 bp, Human; identical to SEQ ID NO: 39472

SEQ ID NO: 118406 - DNA, 601 bp, Human; identical to SEQ ID NO: 39471

SEQ ID NO: 118407 - DNA, 601 bp, Human; identical to SEQ ID NO: 118293

SEQ ID NO: 118408 - DNA, 601 bp, Human; identical to SEQ ID NO: 118294

SEQ ID NO: 118409 - DNA, 601 bp, Human; identical to SEQ ID NO: 118295

SEQ ID NO: 118410 - DNA, 601 bp, Human; identical to SEQ ID NO: 118296

SEQ ID NO: 118411 - DNA, 601 bp, Human; identical to SEQ ID NO: 118297

SEQ ID NO: 118412 - DNA, 601 bp, Human; identical to SEQ ID NO: 118298

SEQ ID NO: 118413 - DNA, 601 bp, Human; identical to SEQ ID NO: 118299

SEQ ID NO: 118414 - DNA, 601 bp, Human; identical to SEQ ID NO: 118300

SEQ ID NO: 118415 - DNA, 601 bp, Human; identical to SEQ ID NO: 118301

SEQ ID NO: 118416 - DNA, 601 bp, Human; identical to SEQ ID NO: 118302

SEQ ID NO: 118417 - DNA, 601 bp, Human; identical to SEQ ID NO: 118303

SEQ ID NO: 118418 - DNA, 601 bp, Human; identical to SEQ ID NO: 118304

SEQ ID NO: 118419 - DNA, 601 bp, Human; identical to SEQ ID NO: 118305

SEQ ID NO: 118420 - DNA, 601 bp, Human; identical to SEQ ID NO: 118306

SEQ ID NO: 118421 - DNA, 601 bp, Human; identical to SEQ ID NO: 118307

SEQ ID NO: 118422 - DNA, 601 bp, Human; identical to SEQ ID NO: 118308

SEQ ID NO: 118423 - DNA, 601 bp, Human; identical to SEQ ID NO: 39492

SEQ ID NO: 118424 - DNA, 601 bp, Human; identical to SEQ ID NO: 39491

SEQ ID NO: 118425 - DNA, 601 bp, Human; identical to SEQ ID NO: 39490

SEQ ID NO: 118426 - DNA, 601 bp, Human; identical to SEQ ID NO: 39489

SEQ ID NO: 118427 - DNA, 601 bp, Human; identical to SEQ ID NO: 39488

SEQ ID NO: 118428 - DNA, 601 bp, Human; identical to SEQ ID NO: 39487

SEQ ID NO: 118429 - DNA, 601 bp, Human; identical to SEQ ID NO: 39486

SEQ ID NO: 118430 - DNA, 601 bp, Human; identical to SEQ ID NO: 39485

SEQ ID NO: 118431 - DNA, 601 bp, Human; identical to SEQ ID NO: 39484

SEQ ID NO: 118432 - DNA, 601 bp, Human; identical to SEQ ID NO: 39483

SEQ ID NO: 118433 - DNA, 601 bp, Human; identical to SEQ ID NO: 39482

SEQ ID NO: 118434 - DNA, 601 bp, Human; identical to SEQ ID NO: 39481

SEQ ID NO: 118435 - DNA, 601 bp, Human; identical to SEQ ID NO: 39480

SEQ ID NO: 118436 - DNA, 601 bp, Human; identical to SEQ ID NO: 39479

SEQ ID NO: 118437 - DNA, 601 bp, Human; identical to SEQ ID NO: 39478

SEQ ID NO: 118438 - DNA, 601 bp, Human; identical to SEQ ID NO: 39477

SEQ ID NO: 118439 - DNA, 601 bp, Human; identical to SEQ ID NO: 39476

SEQ ID NO: 118440 - DNA, 601 bp, Human; identical to SEQ ID NO: 39475

SEQ ID NO: 118441 - DNA, 601 bp, Human; identical to SEQ ID NO: 39474

SEQ ID NO: 118442 - DNA, 601 bp, Human; identical to SEQ ID NO: 39473

SEQ ID NO: 118443 - DNA, 601 bp, Human; identical to SEQ ID NO: 39472

SEQ ID NO: 118444 - DNA, 601 bp, Human; identical to SEQ ID NO: 39471

SEQ ID NO: 118445 - DNA, 601 bp, Human; identical to SEQ ID NO: 118293

SEQ ID NO: 118446 - DNA, 601 bp, Human; identical to SEQ ID NO: 118294

SEQ ID NO: 118447 - DNA, 601 bp, Human; identical to SEQ ID NO: 118295

SEQ ID NO: 118448 - DNA, 601 bp, Human; identical to SEQ ID NO: 118296

SEQ ID NO: 118449 - DNA, 601 bp, Human; identical to SEQ ID NO: 118297

SEQ ID NO: 118450 - DNA, 601 bp, Human; identical to SEQ ID NO: 118298

SEQ ID NO: 118451 - DNA, 601 bp, Human; identical to SEQ ID NO: 118299

SEQ ID NO: 118452 - DNA, 601 bp, Human; identical to SEQ ID NO: 118300

SEQ ID NO: 118453 - DNA, 601 bp, Human; identical to SEQ ID NO: 118301

SEQ ID NO: 118454 - DNA, 601 bp, Human; identical to SEQ ID NO: 118302

SEQ ID NO: 118455 - DNA, 601 bp, Human; identical to SEQ ID NO: 118303

SEQ ID NO: 118456 - DNA, 601 bp, Human; identical to SEQ ID NO: 118304

SEQ ID NO: 118457 - DNA, 601 bp, Human; identical to SEQ ID NO: 118305

SEQ ID NO: 118458 - DNA, 601 bp, Human; identical to SEQ ID NO: 118306

SEQ ID NO: 118459 - DNA, 601 bp, Human; identical to SEQ ID NO: 118307

SEQ ID NO: 118460 - DNA, 601 bp, Human; identical to SEQ ID NO: 118308

SEQ ID NO: 118461 - DNA, 601 bp, Human; identical to SEQ ID NO: 39492

SEQ ID NO: 118462 - DNA, 601 bp, Human; identical to SEQ ID NO: 39491

SEQ ID NO: 118463 - DNA, 601 bp, Human; identical to SEQ ID NO: 39490

SEQ ID NO: 118464 - DNA, 601 bp, Human; identical to SEQ ID NO: 39489

SEQ ID NO: 118465 - DNA, 601 bp, Human; identical to SEQ ID NO: 39488

SEQ ID NO: 118466 - DNA, 601 bp, Human; identical to SEQ ID NO: 39487

SEQ ID NO: 118467 - DNA, 601 bp, Human; identical to SEQ ID NO: 39486

SEQ ID NO: 118468 - DNA, 601 bp, Human; identical to SEQ ID NO: 39485

SEQ ID NO: 118469 - DNA, 601 bp, Human; identical to SEQ ID NO: 39484

SEQ ID NO: 118470 - DNA, 601 bp, Human; identical to SEQ ID NO: 39483

SEQ ID NO: 118471 - DNA, 601 bp, Human; identical to SEQ ID NO: 39482

SEQ ID NO: 118472 - DNA, 601 bp, Human; identical to SEQ ID NO: 39481

SEQ ID NO: 118473 - DNA, 601 bp, Human; identical to SEQ ID NO: 39480

SEQ ID NO: 118474 - DNA, 601 bp, Human; identical to SEQ ID NO: 39479

SEQ ID NO: 118475 - DNA, 601 bp, Human; identical to SEQ ID NO: 39478

SEQ ID NO: 118476 - DNA, 601 bp, Human; identical to SEQ ID NO: 39477

SEQ ID NO: 118477 - DNA, 601 bp, Human; identical to SEQ ID NO: 39476

SEQ ID NO: 118478 - DNA, 601 bp, Human; identical to SEQ ID NO: 39475

SEQ ID NO: 118479 - DNA, 601 bp, Human; identical to SEQ ID NO: 39474

SEQ ID NO: 118480 - DNA, 601 bp, Human; identical to SEQ ID NO: 39473

SEQ ID NO: 118481 - DNA, 601 bp, Human; identical to SEQ ID NO: 39472

SEQ ID NO: 118482 - DNA, 601 bp, Human; identical to SEQ ID NO: 39471

SEQ ID NO: 118483 - DNA, 601 bp, Human; identical to SEQ ID NO: 118293

SEQ ID NO: 118484 - DNA, 601 bp, Human; identical to SEQ ID NO: 118294

SEQ ID NO: 118485 - DNA, 601 bp, Human; identical to SEQ ID NO: 118295

SEQ ID NO: 118486 - DNA, 601 bp, Human; identical to SEQ ID NO: 118296

SEQ ID NO: 118487 - DNA, 601 bp, Human; identical to SEQ ID NO: 118297

SEQ ID NO: 118488 - DNA, 601 bp, Human; identical to SEQ ID NO: 118298

SEQ ID NO: 118489 - DNA, 601 bp, Human; identical to SEQ ID NO: 118299

SEQ ID NO: 118490 - DNA, 601 bp, Human; identical to SEQ ID NO: 118300

SEQ ID NO: 118491 - DNA, 601 bp, Human; identical to SEQ ID NO: 118301

SEQ ID NO: 118492 - DNA, 601 bp, Human; identical to SEQ ID NO: 118302

SEQ ID NO: 118493 - DNA, 601 bp, Human; identical to SEQ ID NO: 118303

SEQ ID NO: 118494 - DNA, 601 bp, Human; identical to SEQ ID NO: 118304

SEQ ID NO: 118495 - DNA, 601 bp, Human; identical to SEQ ID NO: 118305

SEQ ID NO: 118496 - DNA, 601 bp, Human; identical to SEQ ID NO: 118306

SEQ ID NO: 118497 - DNA, 601 bp, Human; identical to SEQ ID NO: 118307

SEQ ID NO: 118498 - DNA, 601 bp, Human; identical to SEQ ID NO: 118308

SEQ ID NO: 118499 - DNA, 601 bp, Human; identical to SEQ ID NO: 39503

SEQ ID NO: 118500 - DNA, 601 bp, Human; identical to SEQ ID NO: 39502

SEQ ID NO: 118501 - DNA, 601 bp, Human; identical to SEQ ID NO: 39501

SEQ ID NO: 118502 - DNA, 601 bp, Human; identical to SEQ ID NO: 39500

SEQ ID NO: 118503 - DNA, 601 bp, Human; identical to SEQ ID NO: 39499

SEQ ID NO: 118504 - DNA, 601 bp, Human; identical to SEQ ID NO: 39498

SEQ ID NO: 118505 - DNA, 601 bp, Human; identical to SEQ ID NO: 39497

SEQ ID NO: 118506 - DNA, 601 bp, Human; identical to SEQ ID NO: 39496

SEQ ID NO: 118507 - DNA, 601 bp, Human; identical to SEQ ID NO: 39495

SEQ ID NO: 118508 - DNA, 601 bp, Human; identical to SEQ ID NO: 39494

SEQ ID NO: 118509 - DNA, 601 bp, Human; identical to SEQ ID NO: 39493

SEQ ID NO: 118510 - DNA, 601 bp, Human; identical to SEQ ID NO: 39492

SEQ ID NO: 118511 - DNA, 601 bp, Human; identical to SEQ ID NO: 39491

SEQ ID NO: 118512 - DNA, 601 bp, Human; identical to SEQ ID NO: 39490

SEQ ID NO: 118513 - DNA, 601 bp, Human; identical to SEQ ID NO: 39489

SEQ ID NO: 118514 - DNA, 601 bp, Human; identical to SEQ ID NO: 39488

SEQ ID NO: 118515 - DNA, 601 bp, Human; identical to SEQ ID NO: 39487

SEQ ID NO: 118516 - DNA, 601 bp, Human; identical to SEQ ID NO: 39486

SEQ ID NO: 118517 - DNA, 601 bp, Human; identical to SEQ ID NO: 39485

SEQ ID NO: 118518 - DNA, 601 bp, Human; identical to SEQ ID NO: 39484

SEQ ID NO: 118519 - DNA, 601 bp, Human; identical to SEQ ID NO: 39483

SEQ ID NO: 118520 - DNA, 601 bp, Human; identical to SEQ ID NO: 39482

SEQ ID NO: 118521 - DNA, 601 bp, Human; identical to SEQ ID NO: 39481

SEQ ID NO: 118522 - DNA, 601 bp, Human; identical to SEQ ID NO: 39480

SEQ ID NO: 118523 - DNA, 601 bp, Human; identical to SEQ ID NO: 39479

SEQ ID NO: 118524 - DNA, 601 bp, Human; identical to SEQ ID NO: 39478

SEQ ID NO: 118525 - DNA, 601 bp, Human; identical to SEQ ID NO: 39477

SEQ ID NO: 118526 - DNA, 601 bp, Human; identical to SEQ ID NO: 39476

SEQ ID NO: 118527 - DNA, 601 bp, Human; identical to SEQ ID NO: 39475

SEQ ID NO: 118528 - DNA, 601 bp, Human; identical to SEQ ID NO: 39474

SEQ ID NO: 118529 - DNA, 601 bp, Human; identical to SEQ ID NO: 39473

SEQ ID NO: 118530 - DNA, 601 bp, Human; identical to SEQ ID NO: 39472

SEQ ID NO: 118531 - DNA, 601 bp, Human; identical to SEQ ID NO: 39471

SEQ ID NO: 118532 - DNA, 601 bp, Human; identical to SEQ ID NO: 39503

SEQ ID NO: 118533 - DNA, 601 bp, Human; identical to SEQ ID NO: 39502

SEQ ID NO: 118534 - DNA, 601 bp, Human; identical to SEQ ID NO: 39501

SEQ ID NO: 118535 - DNA, 601 bp, Human; identical to SEQ ID NO: 39500

SEQ ID NO: 118536 - DNA, 601 bp, Human; identical to SEQ ID NO: 39499

SEQ ID NO: 118537 - DNA, 601 bp, Human; identical to SEQ ID NO: 39498

SEQ ID NO: 118538 - DNA, 601 bp, Human; identical to SEQ ID NO: 39497

SEQ ID NO: 118539 - DNA, 601 bp, Human; identical to SEQ ID NO: 39496

SEQ ID NO: 118540 - DNA, 601 bp, Human; identical to SEQ ID NO: 39495

SEQ ID NO: 118541 - DNA, 601 bp, Human; identical to SEQ ID NO: 39494

SEQ ID NO: 118542 - DNA, 601 bp, Human; identical to SEQ ID NO: 39493

SEQ ID NO: 118543 - DNA, 601 bp, Human; identical to SEQ ID NO: 39492

SEQ ID NO: 118544 - DNA, 601 bp, Human; identical to SEQ ID NO: 39491

SEQ ID NO: 118545 - DNA, 601 bp, Human; identical to SEQ ID NO: 39490

SEQ ID NO: 118546 - DNA, 601 bp, Human; identical to SEQ ID NO: 39489

SEQ ID NO: 118547 - DNA, 601 bp, Human; identical to SEQ ID NO: 39488

SEQ ID NO: 118548 - DNA, 601 bp, Human; identical to SEQ ID NO: 39487

SEQ ID NO: 118549 - DNA, 601 bp, Human; identical to SEQ ID NO: 39486

SEQ ID NO: 118550 - DNA, 601 bp, Human; identical to SEQ ID NO: 39485

SEQ ID NO: 118551 - DNA, 601 bp, Human; identical to SEQ ID NO: 39484

SEQ ID NO: 118552 - DNA, 601 bp, Human; identical to SEQ ID NO: 39483

SEQ ID NO: 118553 - DNA, 601 bp, Human; identical to SEQ ID NO: 39482

SEQ ID NO: 118554 - DNA, 601 bp, Human; identical to SEQ ID NO: 39481

SEQ ID NO: 118555 - DNA, 601 bp, Human; identical to SEQ ID NO: 39480

SEQ ID NO: 118556 - DNA, 601 bp, Human; identical to SEQ ID NO: 39479

SEQ ID NO: 118557 - DNA, 601 bp, Human; identical to SEQ ID NO: 39478

SEQ ID NO: 118558 - DNA, 601 bp, Human; identical to SEQ ID NO: 39477

SEQ ID NO: 118559 - DNA, 601 bp, Human; identical to SEQ ID NO: 39476

SEQ ID NO: 118560 - DNA, 601 bp, Human; identical to SEQ ID NO: 39475

SEQ ID NO: 118561 - DNA, 601 bp, Human; identical to SEQ ID NO: 39474

SEQ ID NO: 118562 - DNA, 601 bp, Human; identical to SEQ ID NO: 39473

SEQ ID NO: 118563 - DNA, 601 bp, Human; identical to SEQ ID NO: 39472

SEQ ID NO: 118564 - DNA, 601 bp, Human; identical to SEQ ID NO: 39471

SEQ ID NO: 118565 - DNA, 601 bp, Human; identical to SEQ ID NO: 39503

SEQ ID NO: 118566 - DNA, 601 bp, Human; identical to SEQ ID NO: 39502

SEQ ID NO: 118567 - DNA, 601 bp, Human; identical to SEQ ID NO: 39501

SEQ ID NO: 118568 - DNA, 601 bp, Human; identical to SEQ ID NO: 39500

SEQ ID NO: 118569 - DNA, 601 bp, Human; identical to SEQ ID NO: 39499

SEQ ID NO: 118570 - DNA, 601 bp, Human; identical to SEQ ID NO: 39498

SEQ ID NO: 118571 - DNA, 601 bp, Human; identical to SEQ ID NO: 39497

SEQ ID NO: 118572 - DNA, 601 bp, Human; identical to SEQ ID NO: 39496

SEQ ID NO: 118573 - DNA, 601 bp, Human; identical to SEQ ID NO: 39495

SEQ ID NO: 118574 - DNA, 601 bp, Human; identical to SEQ ID NO: 39494

SEQ ID NO: 118575 - DNA, 601 bp, Human; identical to SEQ ID NO: 39493

SEQ ID NO: 118576 - DNA, 601 bp, Human; identical to SEQ ID NO: 39492

SEQ ID NO: 118577 - DNA, 601 bp, Human; identical to SEQ ID NO: 39491

SEQ ID NO: 118578 - DNA, 601 bp, Human; identical to SEQ ID NO: 39490

SEQ ID NO: 118579 - DNA, 601 bp, Human; identical to SEQ ID NO: 39489

SEQ ID NO: 118580 - DNA, 601 bp, Human; identical to SEQ ID NO: 39488

SEQ ID NO: 118581 - DNA, 601 bp, Human; identical to SEQ ID NO: 39487

SEQ ID NO: 118582 - DNA, 601 bp, Human; identical to SEQ ID NO: 39486

SEQ ID NO: 118583 - DNA, 601 bp, Human; identical to SEQ ID NO: 39485

SEQ ID NO: 118584 - DNA, 601 bp, Human; identical to SEQ ID NO: 39484

SEQ ID NO: 118585 - DNA, 601 bp, Human; identical to SEQ ID NO: 39483

SEQ ID NO: 118586 - DNA, 601 bp, Human; identical to SEQ ID NO: 39482

SEQ ID NO: 118587 - DNA, 601 bp, Human; identical to SEQ ID NO: 39481

SEQ ID NO: 118588 - DNA, 601 bp, Human; identical to SEQ ID NO: 39480

SEQ ID NO: 118589 - DNA, 601 bp, Human; identical to SEQ ID NO: 39479

SEQ ID NO: 118590 - DNA, 601 bp, Human; identical to SEQ ID NO: 39478

SEQ ID NO: 118591 - DNA, 601 bp, Human; identical to SEQ ID NO: 39477

SEQ ID NO: 118592 - DNA, 601 bp, Human; identical to SEQ ID NO: 39476

SEQ ID NO: 118593 - DNA, 601 bp, Human; identical to SEQ ID NO: 39475

SEQ ID NO: 118594 - DNA, 601 bp, Human; identical to SEQ ID NO: 39474

SEQ ID NO: 118595 - DNA, 601 bp, Human; identical to SEQ ID NO: 39473

SEQ ID NO: 118596 - DNA, 601 bp, Human; identical to SEQ ID NO: 39472

SEQ ID NO: 118597 - DNA, 601 bp, Human; identical to SEQ ID NO: 39471

SEQ ID NO: 118598 - DNA, 601 bp, Human; identical to SEQ ID NO: 39503

SEQ ID NO: 118599 - DNA, 601 bp, Human; identical to SEQ ID NO: 39502

SEQ ID NO: 118600 - DNA, 601 bp, Human; identical to SEQ ID NO: 39501

SEQ ID NO: 118601 - DNA, 601 bp, Human; identical to SEQ ID NO: 39500

SEQ ID NO: 118602 - DNA, 601 bp, Human; identical to SEQ ID NO: 39499

SEQ ID NO: 118603 - DNA, 601 bp, Human; identical to SEQ ID NO: 39498

SEQ ID NO: 118604 - DNA, 601 bp, Human; identical to SEQ ID NO: 39497

SEQ ID NO: 118605 - DNA, 601 bp, Human; identical to SEQ ID NO: 39496

SEQ ID NO: 118606 - DNA, 601 bp, Human; identical to SEQ ID NO: 39495

SEQ ID NO: 118607 - DNA, 601 bp, Human; identical to SEQ ID NO: 39494

SEQ ID NO: 118608 - DNA, 601 bp, Human; identical to SEQ ID NO: 39493

SEQ ID NO: 118609 - DNA, 601 bp, Human; identical to SEQ ID NO: 39492

SEQ ID NO: 118610 - DNA, 601 bp, Human; identical to SEQ ID NO: 39491

SEQ ID NO: 118611 - DNA, 601 bp, Human; identical to SEQ ID NO: 39490

SEQ ID NO: 118612 - DNA, 601 bp, Human; identical to SEQ ID NO: 39489

SEQ ID NO: 118613 - DNA, 601 bp, Human; identical to SEQ ID NO: 39488

SEQ ID NO: 118614 - DNA, 601 bp, Human; identical to SEQ ID NO: 39487

SEQ ID NO: 118615 - DNA, 601 bp, Human; identical to SEQ ID NO: 39486

SEQ ID NO: 118616 - DNA, 601 bp, Human; identical to SEQ ID NO: 39485

SEQ ID NO: 118617 - DNA, 601 bp, Human; identical to SEQ ID NO: 39484

SEQ ID NO: 118618 - DNA, 601 bp, Human; identical to SEQ ID NO: 39483

SEQ ID NO: 118619 - DNA, 601 bp, Human; identical to SEQ ID NO: 39482

SEQ ID NO: 118620 - DNA, 601 bp, Human; identical to SEQ ID NO: 39481

SEQ ID NO: 118621 - DNA, 601 bp, Human; identical to SEQ ID NO: 39480

SEQ ID NO: 118622 - DNA, 601 bp, Human; identical to SEQ ID NO: 39479

SEQ ID NO: 118623 - DNA, 601 bp, Human; identical to SEQ ID NO: 39478

SEQ ID NO: 118624 - DNA, 601 bp, Human; identical to SEQ ID NO: 39477

SEQ ID NO: 118625 - DNA, 601 bp, Human; identical to SEQ ID NO: 39476

SEQ ID NO: 118626 - DNA, 601 bp, Human; identical to SEQ ID NO: 39475

SEQ ID NO: 118627 - DNA, 601 bp, Human; identical to SEQ ID NO: 39474

SEQ ID NO: 118628 - DNA, 601 bp, Human; identical to SEQ ID NO: 39473

SEQ ID NO: 118629 - DNA, 601 bp, Human; identical to SEQ ID NO: 39472

SEQ ID NO: 118630 - DNA, 601 bp, Human; identical to SEQ ID NO: 39471

SEQ ID NO: 118631 - DNA, 601 bp, Human
tcagagccagatcacacaggctcttgaaagtcacaaaaataatcaaaaatagtaatacaaataatataataatcattattattattgctgctataaataagatgccattttccaaaacaccaagcttttctaacttaagaaacaccacgctgcccctctcctactgtttttccactgctctccaatttgtcatcttgctggagtggaaactgccaattccattttagtcgacagctataaaaagaacattggagctggtggtgccgatgaccaaactcggggctaagattagcccaggagrctgtcacctttccttaatgtgagaaacagctgggattccccttccttggaaaacttcaactgttccgccccgccccgcagagcccttgctggccaaatgtccatggagatgggaacggggatgagttttggaaaaaagaagttgagcaacagggattccccctgcagaaggcgtcccgggctgggaggtgagctcttgaggtcaaaagagcaggaccagcaaatgcaaggcgagccccctctctgcagagagccctcagagccagacatcccccgcagagaagcccaccgtgtccctaac

SEQ ID NO: 118632 - DNA, 601 bp, Human
gtgggtaagtgatgggctccagcccggggggccactgacaccagggacatgagtcacagagggcaaaggtccggagagccttagtcatgccccagccctgtctggagtctgacatttcccagagggaagccccatctagagactcccataccaggtctattgtttcagagaacatcacgccgggtacaaccaaacccagggagagaaacaggtgggaagagcaggtgtctgctctaagatggttccgattgttccagggcacaaattcacggaaaaatacttaatttagaaaaaaaaaaaattattttaagcatatgcatttatatttattaaacaaagctcaaaatacaacctttggggacctccaagtaataaaatgactcatgtcaggatatgatgactcagtgggaaagagggaattccaccacccacgcgtcctttctaaaaaatcaatttgtcctctggacaggtgatgggagcctctgccatcagaccgttccaagaaaatcgtccagcaaaacaaaacaaaaaattctcttcaaacaatttaagtttcaaagctgagtaatctgatgcaggccagtttccaacctacgccccc

SEQ ID NO: 118633 - DNA, 601 bp, Human
caagtcttagtcagaggggaagagaaaggagccaaccactttgggcaaaagggttaggtctagagaagacttagcacaactctgcaagttaaaaaaaaaaacaaaaaaaatagggtggggggatggctaaagtaacatcatagcctttgttttgtgtttgtttgtttttgaaacagggtctcacttcattgcccaggcaggagtccatggcgcgatctcagctcactgcaacctccacttcccaggttcaagagattctcctgcctcagcctcccaagtagctgggattacaggcacatgmcaccacggccggctaatttttgcatttcaagtagagatggagtttcaccatgttggccaggctggtcttgaactcctgacctcaggtgatccgcccgccttggcctcccaaagtgctgggattacaggcatgagccaccacgcccacctgacattatagcctctgctttatcttcactgcagagtcaactccagaagaaaacccctactagatgcaagaagaatgggcatcgctaaccagcccgtttgctgatgtatggcccctatactttcgttggtttcctggtttctctttgcaggc

SEQ ID NO: 118634 - DNA, 601 bp, Human
tctctgctttatccttagctctacagcatctggcacataatagttgctcaattaatactggctgaataaacaaacaaattgacctcaggatcctccagtgtgcaccctacagccagggtccaggaaacatctgaccactgacctctccagccgcaggaccctgcaaggaggaatcaccaagcccttattacgggatcctttgtgggaatcagctgatgaggaaggagctgggaatatgggtgcagacaaggaatcaaacacaatcagagcaacacagcccagacagcattcccagtgccaytgaccagaagttccgtataatccacctcccaacccacaccttgggtctgggactctgggcagacctacccccgtggaacaggactgagaagaccaagtatgcttctaccgctctgggctgagatgaaataaaggacttcggtctcttgagcagatgttcaggcaaaattaccccatccaaaattaacaaggactggcagccggtgtgaaaacagcccttccaagtcttagtcagaggggaagagaaaggagccaaccactttgggcaaaagggttaggtctagagaagacttagcacaac

SEQ ID NO: 118635 - DNA, 601 bp, Human
atgccttccagccctccggggcccccaaacagggaggcagggccgaacattccacccaggctcaagagagacatggactcagggttgcttatgtctactgaggtggggacccagcctctctacccagctttcctcccctgattccattagacacactggccttctctctccctccaacagccacacctgcctatctccaggccttggaacttgctgttgccacctctcaagatgcttttcttcagctcttctgtgaccatccccttcccatccttcaggtgcagctcagggagacccccccttcatcctacaccatccccttataactttctactcctcccttccagcctgaaatcattttagctacctattggtttgctatctccacccagcctcaggctgtgagttaccccagagcagggctatagctatctcattctctgctttatccttagctctacagcatctggcacataatagttgctcaattaatactggctgaataaacaaacaaattgacctcaggatcctccagtgtgcaccctacagccagggtccaggaaacatctgaccactgacctctccagccgcaggaccctgc

SEQ ID NO: 118636 - DNA, 601 bp, Human
gcctctgcctcaaaaaaataaagtaaaataaaataaaataaaaagcagattttaaaaaaatgctgcagaccagtatgtaccgcatgatgccgctttgtaagtctattcttaagtctgcttaaacttagaaagcctgtgccccaagctactcatatggttgtacctccagggctgggcctgaatgcgtgaggtgagaccttcatgcctttcttcactgattcaagaaacatgtaacatcacagtgactttaatttgtttatatttttattatttttaaataaagtttgttttttttttttttcttaagaaaaaggcacattgcaactgcctgttgactttcctgtctcttgggagccctccggggccacagcctgagagggaggctgggcatggaccatcagctctgactcagctccggcacagctgtaccccaggccgagagatggaccatgtatgccttccagccctccggggcccccaaacagggaggcagggccgaacattccacccaggctcaagagagacatggactcagggttgcttatgtctactgaggtggggacccagcctctctacccagctttcctcccctgattccatt

SEQ ID NO: 118637 - DNA, 601 bp, Human
gggcgacaaagtgagcctctgcctcaaaaaaataaagtaaaataaaataaaataaaaagcagattttaaaaaaatgctgcagaccagtatgtaccgcatgatgccgctttgtaagtctattcttaagtctgcttaaacttagaaagcctgtgccccaagctactcatatggttgtacctccagggctgggcctgaatgcgtgaggtgagaccttcatgcctttcttcactgattcaagaaacatgtaacatcacagtgactttaatttgtttatatttttattatttttaaataaagtttkttttttttttttttcttaagaaaaaggcacattgcaactgcctgttgactttcctgtctcttgggagccctccggggccacagcctgagagggaggctgggcatggaccatcagctctgactcagctccggcacagctgtaccccaggccgagagatggaccatgtatgccttccagccctccggggcccccaaacagggaggcagggccgaacattccacccaggctcaagagagacatggactcagggttgcttatgtctactgaggtggggacccagcctctctacccagctttcct

SEQ ID NO: 118638 - DNA, 601 bp, Human
caaatacaaaaattagcgaggcatggtggcgggcacttgcaatcccagctactcgggaggctgaggcaggagaatcacttgaacctgggaggtggaggttgcagtgagccgagatcgcaccactgcactccagcctgggtgacagagcaagacttcatctcaaaaataaaaaataaatgctgatggagttttctcagcctgatgtcactctgcccaggttcaagttctgtccccaaagtttactcactgtgtggccttcgagtggcagctctctgtgcctcagtttcctcataagcaaaartgataaagtttggccaggttcggtggctcatgactgtaatcccagcactttgggaggccaaggtaggtggaccacctgaggtcaggagttcgagacccacctgaccaacatggtgaaaccctgtctctactaaaaatacaaaaaattagctgggcgtggtagtgggcgcctgtaatcctagctacttgggaggctgaggcaggagaatcgcttgaaccggggaggcggaggttgcagtgagccgagatcacaccattgcactccagcctggacaacaagagcaaaactccatctcaaaaa

SEQ ID NO: 118639 - DNA, 601 bp, Human
ggaggctggtctctaagggaagtgtgcggtttgcaaggtaccttggggtcattttcccaggctcctcctccccactccaccccgcatccacgggtgcacaagtcctgggctttcgcctggagaacccaataatcccaacctctgaattgcactcccatggggcagtagaattcaaaacaaatgctgatggggccaggtgttgtggttcacacctgtaatcccagcactttgggaggccgaggcgagtggatcacttgaggtcaggagttcaagaccagcctggccaacgtggcgaaacccsatctctactacaaatacaaaaattagcgaggcatggtggcgggcacttgcaatcccagctactcgggaggctgaggcaggagaatcacttgaacctgggaggtggaggttgcagtgagccgagatcgcaccactgcactccagcctgggtgacagagcaagacttcatctcaaaaataaaaaataaatgctgatggagttttctcagcctgatgtcactctgcccaggttcaagttctgtccccaaagtttactcactgtgtggccttcgagtggcagctctctgtgcctcagtttcctc

SEQ ID NO: 118640 - DNA, 601 bp, Human
agacacactccaggaggctggtctctaagggaagtgtgcggtttgcaaggtaccttggggtcattttcccaggctcctcctccccactccaccccgcatccacgggtgcacaagtcctgggctttcgcctggagaacccaataatcccaacctctgaattgcactcccatggggcagtagaattcaaaacaaatgctgatggggccaggtgttgtggttcacacctgtaatcccagcactttgggaggccgaggcgagtggatcacttgaggtcaggagttcaagaccagcctggccaacrtggcgaaacccgatctctactacaaatacaaaaattagcgaggcatggtggcgggcacttgcaatcccagctactcgggaggctgaggcaggagaatcacttgaacctgggaggtggaggttgcagtgagccgagatcgcaccactgcactccagcctgggtgacagagcaagacttcatctcaaaaataaaaaataaatgctgatggagttttctcagcctgatgtcactctgcccaggttcaagttctgtccccaaagtttactcactgtgtggccttcgagtggcagctctctgtgc

SEQ ID NO: 118641 - DNA, 601 bp, Human
acaagagcaaaactccatctcaaaaaaaaaaaaaaaaaatgttcaacagaagatacctgttacgattatggctagtggcaacagattatttcaacactgtcttctttatcatttgttgcatatattccacaatgtgtcaatactgagaaaaacacaagcattttaaaatcagaaaataataaacattttccaagtgcattttatgattgcaatacttctgcctacaggtttgggctggagggaatttatgaagcgacgaagtctgttatgggagactgcagcatggtgcctgattttcctwtgctttccaaagtgggtcttttcaccattaactttaaaaacacacacagagaaaaagacctcagaggaataagaaatcaaaacttaaactatgagccaagggtccatcttctttcttttgcacccttttggtaccagaagctccaagggcagccaaggaatctggcctgacctgtactttctcatggaaggtctgcactcggttctggacaaacaagtccccaacaggaagtgaaagcccacatccgttgtctttcttgattttatgcagcacgtgcaagacacactccaggaggctggt

SEQ ID NO: 118642 - DNA, 601 bp, Human
gggccgggcaaagtggctcacgcctgtgatcccagcactttgggaggccaaggcgggcggatcacctgaggtcaagagtttgggactagccaggccaacatggtaaaaccccatctctactaaaaatacaaaaaattagtcagcatggtggcatgcacctgtaatcccagctacttggggagctgaggcaggaggatctcttgaacccagagatggaggttgcagtgagctgagagcatgccattgcactccagcctgggcaacaagagcaaaactccatctcaaaaaaaaaaaaaaaaaatgttcaacagaagatacctgttacgattatggctagtggcaacagattatttcaacactgtcttctttatcatttgttgcatatattccacaatgtgtcaatactgagaaaaacacaagcattttaaaatcagaaaataataaacattttccaagtgcattttatgattgcaatacttctgcctacaggtttgggctggagggaatttatgaagcgacgaagtctgttatgggagactgcagcatggtgcctgattttcctttgctttccaaagtgggtcttttcaccattaactttaaa

SEQ ID NO: 118643 - DNA, 601 bp, Human
agaccacccaacagagacacatgtccccttttcaggtagaggtcaccaccaggagcgtgactgtacaggccaacctagggtcttcatcaaaaagtgggtcctcatccacacctgcaaagtgagcttgaagcctgaagactgagtaagaaatgaacagcggaaatggcaacatgttgatgtttggtttgtcaccctcccccatagcctctccttgcctgaattgaattcttgaattctgctaccaacagcatcatttctttttccacttatatgagcttgctttgaaaaaaaaaaaaaaaaagatcattttcagaagttcataatggggaagaaagggagaaaatagtagctggaaatgtggtcaggaagtattaagtaggatccataaagcttccattcccagctgtcttccaggctcacaccaataagtggcagatgaaacagaaaatacaaaatggcggtccaacaaaaagggcatcaccaagaggagagttctcatggactgtcctctccgggtcaagggacgcaacacgaagaaggagaccttttcccacctctggtgggtgtgcatggcagacaaaactctacccactgacagcca

SEQ ID NO: 118644 - DNA, 601 bp, Human
aagaacaggcagtttgtttactgactctcactctagtgtcccttggtccctgctgaagggaccaagtcatatttatcaccatctccccaacacgcacaaatgcctaatcaacatctcatgactgaacagacagaagtgtcagcagctccaaaggctgctggtgaggccaagaaaaggccaaaggctaacatcacccatgcccccttgatgagggcagaatacttcggccccctgttttctcagacaactgagcaggcatgtctatgctcaaaaggaagcaagggaagatcgctggatggayatcgaggaattggaagtgaagtcatcaagacctgagtcctttcagtgtgcaaagtcctgtacagaactagtcagggacaatcctcatttctttgtcaaagacaagtcaaagaccacccaacagagacacatgtccccttttcaggtagaggtcaccaccaggagcgtgactgtacaggccaacctagggtcttcatcaaaaagtgggtcctcatccacacctgcaaagtgagcttgaagcctgaagactgagtaagaaatgaacagcggaaatggcaacatgttgatgtttggtttgtca

SEQ ID NO: 118645 - DNA, 601 bp, Human; identical to SEQ ID NO: 70829

SEQ ID NO: 118646 - DNA, 601 bp, Human; identical to SEQ ID NO: 70830

SEQ ID NO: 118647 - DNA, 601 bp, Human; identical to SEQ ID NO: 70831

SEQ ID NO: 118648 - DNA, 601 bp, Human; identical to SEQ ID NO: 70832

SEQ ID NO: 118649 - DNA, 601 bp, Human
aattaaaaaagaaatctgtggtgtgaatactggtacgtggtgtacacagtgagctcttaataagtatttgaattaacaaatgagacaatgattgaataattggatgaacaaagagaatgcaggtttttaaaaggtttctttagaaatattgtcggcccggcacggtggctcctgcctgtaatcccaccattttgggaggccggggcaggtgaatcacctgaggtcaggagttcaagacaagcctgaccaacttggagaaaccccgtctctactaaaaatacaaaaaaaaaaaaaaaaaaaatagcaggatgtggtggcacatgcctgtaatcccagctactcggaggctgaggcaggagaatcgcttgaacctgggaagcagaggttgcagtgagccaagatcgcgccactgcactccagcctgatgacagtgtgagatgctgtctccaaaaaaaaaaaaaaaaaattaaaaagaatgttttaattctttagttccctgtctgagattcactggtaagaagaaagttaaagaatctcctttgactttttttgatatagatatttaaattctattactttatagtaaggttggggtttattt

SEQ ID NO: 118650 - DNA, 601 bp, Human
aatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtggaagaggacggctagcatccccatacctgcatccatacagtttgtaatatwaaaaaaaaaaaagtaaaaaaaactccctctctcttctagtgtctatatatcagtttcctagaagaaaacgttttgccctacttggccatgtgaatggagttccctgattacatgagtcaaatatgtcttattgtagcatatttgatggtcttcttgtagaatattatcttactatacacagaactcttgaccagtgctaccattgtaattaatgggccatgagtttttgttgcaagtcatttgaattcatattctatagttttctaccaagtgtagtcattctgcaagctgttcttgtca

SEQ ID NO: 118651 - DNA, 601 bp, Human
atgcagagaaagaagagtgatagagtaggtaatttggggaaagtcagtgatacacagctcttaaccatgaacagtgattcttcactcttgaatgtttgtgacattcatgaaggtattaaaagctgacttttaaaaaattgtttcagagaactggaaaaaaattcagttgccacattcttccttaggtcatctttgaactctactcatgcacttacgtgtttaaggcaaagttttactaaacgcacacttgttcttgctggcttattgacttttactgctagcttcttattcttagcaattrtacctcacattacatagtattgtgaaactcactatattcagtgttttgcctgacaaacatggtatgttataggatgtgtattcagttatagctaaaaataaattattctcgtttttcaaaatttgctggcctacctgttaagcttttgctttaagacctgctaatgtttctcaaacttctgtggttaaatcacctgagtgtctagttgctctatggattcccagggacccattcgccagagattctgatttggtaattttgggatggaactcagggatctgtaaattttacaagcactca

SEQ ID NO: 118652 - DNA, 601 bp, Human
ccttatatataatcagggctcaaagatttgttgagaggctcaacaccaattctggaccaggaaagattttatttatatcactagtcaggaataatctaaaaacaaaaagcacattcttcttacaagtaatatttcaatacacattaatgtaaacacatggaaaagtattagctacttaataaattaacatgtaaatgaaaaatttacacattatggctatttcagatgtgatatagatttcattttcagaaggaaccctccaatgtaaaacagtgattcttttccccgtttattttactgyattagaaaatcacatttaaagtaagcattttggtgaggtttggaaggtgaataaatccatcttttctttaattatggatatttaagagagatgttgttgtgccgtttagataataatgatctaaaccaagaaatttagttgctttcaaaaataaaataagtgtatgcattctgaacatttttctttagaaacaaaccatttcatctgtttttttgaatttcaaattaattatacagaattttcaaaatttgaaaattaggttagcatgagaaactgaagatactgaattatattgcctgt

SEQ ID NO: 118653 - DNA, 601 bp, Human
cctggaatgattgtggcatttgaactaatattcaggtttaacaagagataattgaccatcactctattttagaggctttatttgaaccagatagaaatctatttcccacagctatcactgcctgtcacctacaacttaagggggttggggaggaagtgagagattttctgttagggccaatagggacctgctagatacccccccatcctgggaatggtgtatggaactccagtgtatgctggagttattatcatcatacttgtttttttattttactcttctgcttatacagatcaagtcwtacgttttatttttaagtttaaattgaaaacatttacagagaacaatgcagtgaaatgaaaaaattacagactgctggcatttgcattttcatgtagcctcagtgactaatttttttttattgtacagcattgagaaaatcctagttcatataactagttatagttcatatagattcatataactagttttaagtgataatagtttcttcctttttttcctccaccatctaaccagatgaagataatagtttttaatagctcaccgtaaatttcaaggtactcaagttaaattgatctag

SEQ ID NO: 118654 - DNA, 601 bp, Human
aacctatttacaggttgtgagagaactaggcacctagtacagggtaatgttggcacatggtaacctttaataaactgttgctattcaacaagctattagatgtcactaggcagttaagcaaaggaagacagcttttgcttggtgtgacaatgaaaatctttctgatttccttcttggaagagttccctgaagatatgtcattgtattgacacctttatttttgctaacctatccctctaaattctggatattgtgtgtgccacagctttttttcttccatattcctgcatttatttggcayctgttgtgccagtaatagataaggggctgctaagggaggaggcaacctgcactggcttatagctgctaatgtcagttcctatagcttatcgtcagtgttattcatgtggtaaaagggtgagaaagtactggagtctaaagaaacaagtagaaatcagtttgtagctattaccgttctacctgctaacaactcctgttttcaagttattatgtacaactttaggtagtttctctagccttaatcgtggtttctctgtattgagactacttttgaattctatgaagtacagccttagatgta

SEQ ID NO: 118655 - DNA, 601 bp, Human; identical to SEQ ID NO: 22560

SEQ ID NO: 118656 - DNA, 601 bp, Human; identical to SEQ ID NO: 22561

SEQ ID NO: 118657 - DNA, 601 bp, Human; identical to SEQ ID NO: 22562

SEQ ID NO: 118658 - DNA, 601 bp, Human
ccctcagggccattgctttcccggtgtagtgtttcgctcagttcttttctcagcaagggagtgggaacgtgggctagccaggccttgagccccacgtttacctttctcctttcccgggtccctgttcccttcccagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtgaggcccaggggagcctggggagatctgcctgtgycaggagagtttgtgggggctgcctgggcctcccaatttccctgccgatcaaactaacatcctccccacaacctggtgggcccaggagcctctcccccaccctccacagaaatgggaggaagacacacctcttgtggggctcaccacacccaacgcggactggctgagtggatgagagggtggggccctctacggagatgagatcttacctatgtaaaaccacgctccagagttcctaaaccacaaccctacctgggaagcacccagggctgagagttggtctttaaaacattcttagcct

SEQ ID NO: 118659 - DNA, 601 bp, Human
cctccgaatcttctgatgcaggtgaggcccaggggagcctggggagatctgcctgtgtcaggagagtttgtgggggctgcctgggcctcccaatttccctgccgatcaaactaacatcctccccacaacctggtgggcccaggagcctctcccccaccctccacagaaatgggaggaagacacacctcttgtggggctcaccacacccaacgcggactggctgagtggatgagagggtggggccctctacggagatgagatcttacctatgtaaaaccacgctccagagttcctaaaccayaaccctacctgggaagcacccagggctgagagttggtctttaaaacattcttagcctataacctcttctttaaaaatctgttgtctcttctagaacaaattattttaaaccagttcaagaaaaatgcttagtgagcattgtggtttaaagacgcatatgaaggaatttccatagtaaacagggagtggagccctgtaccgtctgggggacgatgtgtcagctctcagggtccatggttgggtttttgtttcattttctaatgtgtcaaagtccaaactagaaactgtttttttttttttt

SEQ ID NO: 118660 - DNA, 601 bp, Human
atgcaggtgaggcccaggggagcctggggagatctgcctgtgtcaggagagtttgtgggggctgcctgggcctcccaatttccctgccgatcaaactaacatcctccccacaacctggtgggcccaggagcctctcccccaccctccacagaaatgggaggaagacacacctcttgtggggctcaccacacccaacgcggactggctgagtggatgagagggtggggccctctacggagatgagatcttacctatgtaaaaccacgctccagagttcctaaaccacaaccctacctgggargcacccagggctgagagttggtctttaaaacattcttagcctataacctcttctttaaaaatctgttgtctcttctagaacaaattattttaaaccagttcaagaaaaatgcttagtgagcattgtggtttaaagacgcatatgaaggaatttccatagtaaacagggagtggagccctgtaccgtctgggggacgatgtgtcagctctcagggtccatggttgggtttttgtttcattttctaatgtgtcaaagtccaaactagaaactgttttttttttttttttttttttcatattg

SEQ ID NO: 118661 - DNA, 601 bp, Human
gggctcagggccagggatagtggggacagtggccactgggagagcagatactagactacagcccatgtcttgcaggaatacaagcccagcgtatgtcccgtttttctttcttgcctatacccatttttttctgtgaaatattacaatttaaaaatatgatccaactaattcaaaactttaactcactctaggccaaacaaaacacagttgcctgcagattgatttggctcttggccgatcagcaacctctgacttcgatgacactttaccctctggccagccctggtctaggccctttctrcaagggaatggagagagagttggtgggctctggcctggacagaccatccccttggctgtgggcatgggtggtgtcttccagagcacagctgttcccatccagttgttaaagcccaagcagcggggcagctgccagccattagtagggacagctgggcatctctggcctgtgctggggactgtggctttgggtttaggatagtgacttgtcttacctcccattgcctttgatcagactgggttgggctgcagattggttcacaaacaggaaatggggagaggattgggtggggttggggga

SEQ ID NO: 118662 - DNA, 601 bp, Human
ctagggccacctgccagctgccagcctgacctgccggaaccaacccccatgacctcctacagatggtggccctattgacgggcaagttcagcaacatcgtggataagtttgtgattgtagactgcagatacccctatgaatatgaaggcgggcacatcaaggtaagatggggcaatggggagaggccctgaagatcccacctggtttaggtccttgctttgccaagagggtgaatgggtggaggacgggtgccccctctcatggggagggttcctactaagagaaggacagcgactgcacrgggagggccctgactcctggacccggggctgtgcctgacctctggctcctctgacagactgcggtgaacttgcccctggaacgcgacgccgagagcttcctactgaagagccccatcgcgccctgtagcctggacaagagagtcatcctcattttccactgtgaattctcatctgagcgtgggccccgcatgtgagtcccagctccgcccagccagctagtgtctgccctggccttccctgcccaggctcacaggtgctggcaccattgagatggccaggggtgcaagtccaggtcctcc

SEQ ID NO: 118663 - DNA, 601 bp, Human
tagactgcagatacccctatgaatatgaaggcgggcacatcaaggtaagatggggcaatggggagaggccctgaagatcccacctggtttaggtccttgctttgccaagagggtgaatgggtggaggacgggtgccccctctcatggggagggttcctactaagagaaggacagcgactgcacggggagggccctgactcctggacccggggctgtgcctgacctctggctcctctgacagactgcggtgaacttgcccctggaacgcgacgccgagagcttcctactgaagagccccatygcgccctgtagcctggacaagagagtcatcctcattttccactgtgaattctcatctgagcgtgggccccgcatgtgagtcccagctccgcccagccagctagtgtctgccctggccttccctgcccaggctcacaggtgctggcaccattgagatggccaggggtgcaagtccaggtcctcctctgtcccatctgatggcctagagctgacctcagccccacttcactgtgcatggtacccgcctcccatctccctcactgtcctgcctatcaagcctcatgtccaccccacatccatt

SEQ ID NO: 118664 - DNA, 601 bp, Human
ctctgtcccatctgatggcctagagctgacctcagccccacttcactgtgcatggtacccgcctcccatctccctcactgtcctgcctatcaagcctcatgtccaccccacatccattactgccaccctcagaaaatttagttccaagtctctagcggtgtcttttctcgaaatctaagggccgcgtgtcagtccccagtacacggaccctccccatgttcagtgctgttaggtctccattagaacctcttccattggcatccacagcacctgggcctccctggctgagctccttctgtcrctattcctgttctgcctggccatctgtcctcccacccctgcctcctcctgggttgccactggtccatatgactgctagtggctccccagcctggcctcacccatgtggtgggaatctgcacccagacgccccttacagagtcgcatccctgcggccctcccaacttctccaggcatcccagcatatggcacccacctccacctgggcaccgggcctgggcactggcttcagtcttgggtcctcctcctcccttctccccaccactgatcctcaccaggtcttgtccaggagtggcccgaa

SEQ ID NO: 118665 - DNA, 601 bp, Human
tcgcatccctgcggccctcccaacttctccaggcatcccagcatatggcacccacctccacctgggcaccgggcctgggcactggcttcagtcttgggtcctcctcctcccttctccccaccactgatcctcaccaggtcttgtccaggagtggcccgaatggatcccttgaatttggcccacttgtctcctctcctgcttctcctttcctggtccaggcacagatatctctaacaaagattgtgcaactgccttctagaaacggagagttcatccccttgattttacctccttccttccrcctccccaccctcttctgtagccagagtgacctaaaagtgttcttgtggttacattcctgtgctctaaagctttctgtggctccccaaggccctcaaaggaggggacgtgggggataggtcccatgatgtacaagccactgcatgccccactctgaccacaccctgcccatgacgccccaggtgccgtttcatcagggaacgagaccgtgctgtcaacgactaccccagcctctactaccctgagatgtatatcctgaaaggcggctacaaggagttcttccctcagcacccggtagcgt

SEQ ID NO: 118666 - DNA, 601 bp, Human; identical to SEQ ID NO: 118658

SEQ ID NO: 118667 - DNA, 601 bp, Human; identical to SEQ ID NO: 118659

SEQ ID NO: 118668 - DNA, 601 bp, Human; identical to SEQ ID NO: 118660

SEQ ID NO: 118669 - DNA, 601 bp, Human; identical to SEQ ID NO: 118661

SEQ ID NO: 118670 - DNA, 601 bp, Human; identical to SEQ ID NO: 118662

SEQ ID NO: 118671 - DNA, 601 bp, Human; identical to SEQ ID NO: 118663

SEQ ID NO: 118672 - DNA, 601 bp, Human; identical to SEQ ID NO: 118664

SEQ ID NO: 118673 - DNA, 601 bp, Human; identical to SEQ ID NO: 118665

SEQ ID NO: 118674 - DNA, 601 bp, Human; identical to SEQ ID NO: 118658

SEQ ID NO: 118675 - DNA, 601 bp, Human; identical to SEQ ID NO: 118659

SEQ ID NO: 118676 - DNA, 601 bp, Human; identical to SEQ ID NO: 118660

SEQ ID NO: 118677 - DNA, 601 bp, Human; identical to SEQ ID NO: 118661

SEQ ID NO: 118678 - DNA, 601 bp, Human; identical to SEQ ID NO: 118662

SEQ ID NO: 118679 - DNA, 601 bp, Human; identical to SEQ ID NO: 118663

SEQ ID NO: 118680 - DNA, 601 bp, Human; identical to SEQ ID NO: 118664

SEQ ID NO: 118681 - DNA, 601 bp, Human; identical to SEQ ID NO: 118665

SEQ ID NO: 118682 - DNA, 601 bp, Human; identical to SEQ ID NO: 118658

SEQ ID NO: 118683 - DNA, 601 bp, Human; identical to SEQ ID NO: 118659

SEQ ID NO: 118684 - DNA, 601 bp, Human; identical to SEQ ID NO: 118660

SEQ ID NO: 118685 - DNA, 601 bp, Human; identical to SEQ ID NO: 118661

SEQ ID NO: 118686 - DNA, 601 bp, Human; identical to SEQ ID NO: 118662

SEQ ID NO: 118687 - DNA, 601 bp, Human; identical to SEQ ID NO: 118663

SEQ ID NO: 118688 - DNA, 601 bp, Human; identical to SEQ ID NO: 118664

SEQ ID NO: 118689 - DNA, 601 bp, Human; identical to SEQ ID NO: 118665

SEQ ID NO: 118690 - DNA, 601 bp, Human
ggccacccgctcctccctcgggtgtgggcagctccgaaactcacaccggggaggcgtggagagagccccgtcgcccgctaacccaggccagtggggcgaaacgcccggagacaagccttaccctagggcgtgcgggctcccaagccgccacaggtggtccagtcctccctccccacctacacgtgaagaagctaaggcccagaaaggctgaggcctggccggggcggcgcaacaccgggaaggtctctgggaggcagcggctttaagagccccatacggggaaagctttgcacgcgcggcrgggccgagggatgctccatcccgcagccccggccacaaccagagcacgcaccgactttgatctcgttggggtcgaacttcggcggcatggtggaggcggctggtgtcggatgaacccggattcgggacgaccgaaggaagttgcaccttggcctcctccgagccgaaagccgagaggccggaaatcgcgcggacaagccagatataggcaggaaaacgcggctatcgcgagaactgtcgtcactgcccggccttccagagacgcccttgtcgccatgtttgttgtgggcaggcgcctgag

SEQ ID NO: 118691 - DNA, 601 bp, Human
ccccgagccacagccctctcagcgtctttccggggttggacacgccaccctctgcctcttctcgaaacagcacagagcgcgaggcgggccacccgctcctccctcgggtgtgggcagctccgaaactcacaccggggaggcgtggagagagccccgtcgcccgctaacccaggccagtggggcgaaacgcccggagacaagccttaccctagggcgtgcgggctcccaagccgccacaggtggtccagtcctccctccccacctacacgtgaagaagctaaggcccagaaaggctgaggcytggccggggcggcgcaacaccgggaaggtctctgggaggcagcggctttaagagccccatacggggaaagctttgcacgcgcggcggggccgagggatgctccatcccgcagccccggccacaaccagagcacgcaccgactttgatctcgttggggtcgaacttcggcggcatggtggaggcggctggtgtcggatgaacccggattcgggacgaccgaaggaagttgcaccttggcctcctccgagccgaaagccgagaggccggaaatcgcgcggacaagccagatataggcaggaa

SEQ ID NO: 118692 - DNA, 601 bp, Human
ctaattacaatttaaaggcaccaggttcgatttttcacacacgaccttcctaaggtacctagtactagttcagtggctcaggcctactgagggtgacagtccaagccacgagggcacctctggcacaggcgtgactccacgagccggcgcttaaagtgaaacaaatgtgaaaaaaatgccccttggaggggataacgtaccagacccagggggccgatcttgggggccagggcagaagtggcaccgacttcacctccggtgcacctcaggtatactgggggaaaagaagagttagtgtctstgcagagggagccccgagccacagccctctcagcgtctttccggggttggacacgccaccctctgcctcttctcgaaacagcacagagcgcgaggcgggccacccgctcctccctcgggtgtgggcagctccgaaactcacaccggggaggcgtggagagagccccgtcgcccgctaacccaggccagtggggcgaaacgcccggagacaagccttaccctagggcgtgcgggctcccaagccgccacaggtggtccagtcctccctccccacctacacgtgaagaagctaaggcccaga

SEQ ID NO: 118693 - DNA, 601 bp, Human
gcatgagacacagcctgccacattaactgctaggtttacatctacaacacagctggaaacgctcactggatcttcacccacaccccgtttaatctcccaacaacgccatgcccacttcctgacgaggaaatacagatgttggctgcccaatgtctctaagccagtcctaacttcaaaactcccccttgggcccacccctcaggtacactaaagcagcagtggagacacatggagctaattacaatttaaaggcaccaggttcgatttttcacacacgaccttcctaaggtacctagtactwgttcagtggctcaggcctactgagggtgacagtccaagccacgagggcacctctggcacaggcgtgactccacgagccggcgcttaaagtgaaacaaatgtgaaaaaaatgccccttggaggggataacgtaccagacccagggggccgatcttgggggccagggcagaagtggcaccgacttcacctccggtgcacctcaggtatactgggggaaaagaagagttagtgtctctgcagagggagccccgagccacagccctctcagcgtctttccggggttggacacgccaccctctgc

SEQ ID NO: 118694 - DNA, 601 bp, Human
gcatctgtcgagcaatgttgacaatctcatcaaaagtgatattcccactgtgtttaactgcagaagaggaaacagcaaaagctcttttaaagtctgaagccaaagcagatcatgtgtccttcatttcatttctaggctgttcccatgctttcggcacagagtcatccacatgaagaacaaccctgtttcctaagctggggtttactatcagctcaccactggattgcaccagccaacagagacctggtcaggtgcagtggcgggtggctgagggcaaaaccaagccttcacaaatctgacrtggcagaaactgttttagagaaatgacaagcttaaattgccagggagttaaactgcccagtacctgccacctgtatgtggtctcctgattataggtcattattgctgacatcttcctcccacatgcactgattggggcctgccccacacagggactacatggcacttttttttttttttttgagacggagtctcactgttacccaggctggagtgcagtggcacaatcttggctcactgctacaacctccacctcctgggttcgagtgattctcctgcctcagccgtctgagtagccagg

SEQ ID NO: 118695 - DNA, 601 bp, Human
tgagctcagcccagcccatacagggcagttttgttacccaccacaaggtgcttgttacttctccacaggttctgccaccctgaccccactgaccaccccacaaaggagctagctccctcaaggaagacgccacaccagaaaatccaccagttgtcaaatgatcctttattgaaatgttttcctttgtgcttaactctgtgggaaagaaaaaaaaaatcagtaaaaagtttaaaaggattatcccaccccaccagtaaccatttccaaaacttcccagcttatctctgtgaatacactgggyggcccccctttcacccctactgtaacaatgaaaatgtcacttacggctgggcattccacagcaccactgttgatgtcatcgatgatgtcatgaggatggcggccatcaacattacagcccactgactgggcagtccccaggatctctttaatggttcctttaagtaaagaaatggtggcattggaggtgctggctcagtccctcacaatctgcagatactggggaatactgaaggggttcatagcaggcaatggaaggaatgaggttcctgctcccctaatatagaatatagagttccat

SEQ ID NO: 118696 - DNA, 601 bp, Human; identical to SEQ ID NO: 118690

SEQ ID NO: 118697 - DNA, 601 bp, Human; identical to SEQ ID NO: 118691

SEQ ID NO: 118698 - DNA, 601 bp, Human; identical to SEQ ID NO: 118692

SEQ ID NO: 118699 - DNA, 601 bp, Human; identical to SEQ ID NO: 118693

SEQ ID NO: 118700 - DNA, 601 bp, Human; identical to SEQ ID NO: 118694

SEQ ID NO: 118701 - DNA, 601 bp, Human; identical to SEQ ID NO: 118695

SEQ ID NO: 118702 - DNA, 601 bp, Human; identical to SEQ ID NO: 45251

SEQ ID NO: 118703 - DNA, 601 bp, Human; identical to SEQ ID NO: 45252

SEQ ID NO: 118704 - DNA, 601 bp, Human; identical to SEQ ID NO: 45253

SEQ ID NO: 118705 - DNA, 601 bp, Human; identical to SEQ ID NO: 45254

SEQ ID NO: 118706 - DNA, 601 bp, Human; identical to SEQ ID NO: 45255

SEQ ID NO: 118707 - DNA, 601 bp, Human; identical to SEQ ID NO: 45256

SEQ ID NO: 118708 - DNA, 601 bp, Human; identical to SEQ ID NO: 45257

SEQ ID NO: 118709 - DNA, 601 bp, Human; identical to SEQ ID NO: 45258

SEQ ID NO: 118710 - DNA, 601 bp, Human; identical to SEQ ID NO: 45259

SEQ ID NO: 118711 - DNA, 601 bp, Human; identical to SEQ ID NO: 45260

SEQ ID NO: 118712 - DNA, 601 bp, Human; identical to SEQ ID NO: 45261

SEQ ID NO: 118713 - DNA, 601 bp, Human; identical to SEQ ID NO: 45262

SEQ ID NO: 118714 - DNA, 601 bp, Human; identical to SEQ ID NO: 45263

SEQ ID NO: 118715 - DNA, 601 bp, Human; identical to SEQ ID NO: 45264

SEQ ID NO: 118716 - DNA, 601 bp, Human; identical to SEQ ID NO: 45265

SEQ ID NO: 118717 - DNA, 601 bp, Human; identical to SEQ ID NO: 45266

SEQ ID NO: 118718 - DNA, 601 bp, Human; identical to SEQ ID NO: 45267

SEQ ID NO: 118719 - DNA, 601 bp, Human; identical to SEQ ID NO: 45268

SEQ ID NO: 118720 - DNA, 601 bp, Human; identical to SEQ ID NO: 45269

SEQ ID NO: 118721 - DNA, 601 bp, Human; identical to SEQ ID NO: 45270

SEQ ID NO: 118722 - DNA, 601 bp, Human; identical to SEQ ID NO: 45271

SEQ ID NO: 118723 - DNA, 601 bp, Human; identical to SEQ ID NO: 45272

SEQ ID NO: 118724 - DNA, 601 bp, Human; identical to SEQ ID NO: 45273

SEQ ID NO: 118725 - DNA, 601 bp, Human; identical to SEQ ID NO: 45274

SEQ ID NO: 118726 - DNA, 601 bp, Human; identical to SEQ ID NO: 45275

SEQ ID NO: 118727 - DNA, 601 bp, Human; identical to SEQ ID NO: 45276

SEQ ID NO: 118728 - DNA, 601 bp, Human; identical to SEQ ID NO: 45277

SEQ ID NO: 118729 - DNA, 601 bp, Human; identical to SEQ ID NO: 45278

SEQ ID NO: 118730 - DNA, 601 bp, Human; identical to SEQ ID NO: 45279

SEQ ID NO: 118731 - DNA, 601 bp, Human; identical to SEQ ID NO: 45280

SEQ ID NO: 118732 - DNA, 601 bp, Human; identical to SEQ ID NO: 45281

SEQ ID NO: 118733 - DNA, 601 bp, Human; identical to SEQ ID NO: 45282

SEQ ID NO: 118734 - DNA, 601 bp, Human; identical to SEQ ID NO: 45283

SEQ ID NO: 118735 - DNA, 601 bp, Human; identical to SEQ ID NO: 45284

SEQ ID NO: 118736 - DNA, 601 bp, Human; identical to SEQ ID NO: 45285

SEQ ID NO: 118737 - DNA, 601 bp, Human; identical to SEQ ID NO: 45286

SEQ ID NO: 118738 - DNA, 601 bp, Human; identical to SEQ ID NO: 45287

SEQ ID NO: 118739 - DNA, 601 bp, Human; identical to SEQ ID NO: 45288

SEQ ID NO: 118740 - DNA, 601 bp, Human; identical to SEQ ID NO: 45289

SEQ ID NO: 118741 - DNA, 601 bp, Human; identical to SEQ ID NO: 45290

SEQ ID NO: 118742 - DNA, 601 bp, Human; identical to SEQ ID NO: 45291

SEQ ID NO: 118743 - DNA, 601 bp, Human; identical to SEQ ID NO: 45292

SEQ ID NO: 118744 - DNA, 601 bp, Human; identical to SEQ ID NO: 45293

SEQ ID NO: 118745 - DNA, 601 bp, Human; identical to SEQ ID NO: 45294

SEQ ID NO: 118746 - DNA, 601 bp, Human; identical to SEQ ID NO: 45295

SEQ ID NO: 118747 - DNA, 601 bp, Human; identical to SEQ ID NO: 45296

SEQ ID NO: 118748 - DNA, 601 bp, Human; identical to SEQ ID NO: 45297

SEQ ID NO: 118749 - DNA, 601 bp, Human; identical to SEQ ID NO: 45298

SEQ ID NO: 118750 - DNA, 601 bp, Human; identical to SEQ ID NO: 45299

SEQ ID NO: 118751 - DNA, 601 bp, Human; identical to SEQ ID NO: 45300

SEQ ID NO: 118752 - DNA, 601 bp, Human; identical to SEQ ID NO: 45301

SEQ ID NO: 118753 - DNA, 601 bp, Human; identical to SEQ ID NO: 45302

SEQ ID NO: 118754 - DNA, 601 bp, Human; identical to SEQ ID NO: 45303

SEQ ID NO: 118755 - DNA, 601 bp, Human; identical to SEQ ID NO: 45304

SEQ ID NO: 118756 - DNA, 601 bp, Human; identical to SEQ ID NO: 45305

SEQ ID NO: 118757 - DNA, 601 bp, Human; identical to SEQ ID NO: 45306

SEQ ID NO: 118758 - DNA, 601 bp, Human; identical to SEQ ID NO: 45307

SEQ ID NO: 118759 - DNA, 601 bp, Human; identical to SEQ ID NO: 45308

SEQ ID NO: 118760 - DNA, 601 bp, Human; identical to SEQ ID NO: 45309

SEQ ID NO: 118761 - DNA, 601 bp, Human; identical to SEQ ID NO: 45310

SEQ ID NO: 118762 - DNA, 601 bp, Human; identical to SEQ ID NO: 45311

SEQ ID NO: 118763 - DNA, 601 bp, Human; identical to SEQ ID NO: 45312

SEQ ID NO: 118764 - DNA, 601 bp, Human; identical to SEQ ID NO: 45313

SEQ ID NO: 118765 - DNA, 601 bp, Human; identical to SEQ ID NO: 45314

SEQ ID NO: 118766 - DNA, 601 bp, Human; identical to SEQ ID NO: 45315

SEQ ID NO: 118767 - DNA, 601 bp, Human; identical to SEQ ID NO: 45316

SEQ ID NO: 118768 - DNA, 601 bp, Human; identical to SEQ ID NO: 45317

SEQ ID NO: 118769 - DNA, 601 bp, Human; identical to SEQ ID NO: 45318

SEQ ID NO: 118770 - DNA, 601 bp, Human; identical to SEQ ID NO: 45319

SEQ ID NO: 118771 - DNA, 601 bp, Human; identical to SEQ ID NO: 45320

SEQ ID NO: 118772 - DNA, 601 bp, Human; identical to SEQ ID NO: 45321

SEQ ID NO: 118773 - DNA, 601 bp, Human; identical to SEQ ID NO: 45251

SEQ ID NO: 118774 - DNA, 601 bp, Human; identical to SEQ ID NO: 45252

SEQ ID NO: 118775 - DNA, 601 bp, Human; identical to SEQ ID NO: 45253

SEQ ID NO: 118776 - DNA, 601 bp, Human; identical to SEQ ID NO: 45254

SEQ ID NO: 118777 - DNA, 601 bp, Human; identical to SEQ ID NO: 45255

SEQ ID NO: 118778 - DNA, 601 bp, Human; identical to SEQ ID NO: 45256

SEQ ID NO: 118779 - DNA, 601 bp, Human; identical to SEQ ID NO: 45257

SEQ ID NO: 118780 - DNA, 601 bp, Human; identical to SEQ ID NO: 45258

SEQ ID NO: 118781 - DNA, 601 bp, Human; identical to SEQ ID NO: 45259

SEQ ID NO: 118782 - DNA, 601 bp, Human; identical to SEQ ID NO: 45260

SEQ ID NO: 118783 - DNA, 601 bp, Human; identical to SEQ ID NO: 45261

SEQ ID NO: 118784 - DNA, 601 bp, Human; identical to SEQ ID NO: 45262

SEQ ID NO: 118785 - DNA, 601 bp, Human; identical to SEQ ID NO: 45263

SEQ ID NO: 118786 - DNA, 601 bp, Human; identical to SEQ ID NO: 45264

SEQ ID NO: 118787 - DNA, 601 bp, Human; identical to SEQ ID NO: 45265

SEQ ID NO: 118788 - DNA, 601 bp, Human; identical to SEQ ID NO: 45266

SEQ ID NO: 118789 - DNA, 601 bp, Human; identical to SEQ ID NO: 45267

SEQ ID NO: 118790 - DNA, 601 bp, Human; identical to SEQ ID NO: 45268

SEQ ID NO: 118791 - DNA, 601 bp, Human; identical to SEQ ID NO: 45269

SEQ ID NO: 118792 - DNA, 601 bp, Human; identical to SEQ ID NO: 45270

SEQ ID NO: 118793 - DNA, 601 bp, Human; identical to SEQ ID NO: 45271

SEQ ID NO: 118794 - DNA, 601 bp, Human; identical to SEQ ID NO: 45272

SEQ ID NO: 118795 - DNA, 601 bp, Human; identical to SEQ ID NO: 45273

SEQ ID NO: 118796 - DNA, 601 bp, Human; identical to SEQ ID NO: 45274

SEQ ID NO: 118797 - DNA, 601 bp, Human; identical to SEQ ID NO: 45275

SEQ ID NO: 118798 - DNA, 601 bp, Human; identical to SEQ ID NO: 45276

SEQ ID NO: 118799 - DNA, 601 bp, Human; identical to SEQ ID NO: 45277

SEQ ID NO: 118800 - DNA, 601 bp, Human; identical to SEQ ID NO: 45278

SEQ ID NO: 118801 - DNA, 601 bp, Human; identical to SEQ ID NO: 45279

SEQ ID NO: 118802 - DNA, 601 bp, Human; identical to SEQ ID NO: 45280

SEQ ID NO: 118803 - DNA, 601 bp, Human; identical to SEQ ID NO: 45281

SEQ ID NO: 118804 - DNA, 601 bp, Human; identical to SEQ ID NO: 45282

SEQ ID NO: 118805 - DNA, 601 bp, Human; identical to SEQ ID NO: 45283

SEQ ID NO: 118806 - DNA, 601 bp, Human; identical to SEQ ID NO: 45284

SEQ ID NO: 118807 - DNA, 601 bp, Human; identical to SEQ ID NO: 45285

SEQ ID NO: 118808 - DNA, 601 bp, Human; identical to SEQ ID NO: 45286

SEQ ID NO: 118809 - DNA, 601 bp, Human; identical to SEQ ID NO: 45287

SEQ ID NO: 118810 - DNA, 601 bp, Human; identical to SEQ ID NO: 45288

SEQ ID NO: 118811 - DNA, 601 bp, Human; identical to SEQ ID NO: 45289

SEQ ID NO: 118812 - DNA, 601 bp, Human; identical to SEQ ID NO: 45290

SEQ ID NO: 118813 - DNA, 601 bp, Human; identical to SEQ ID NO: 45291

SEQ ID NO: 118814 - DNA, 601 bp, Human; identical to SEQ ID NO: 45292

SEQ ID NO: 118815 - DNA, 601 bp, Human; identical to SEQ ID NO: 45293

SEQ ID NO: 118816 - DNA, 601 bp, Human; identical to SEQ ID NO: 45294

SEQ ID NO: 118817 - DNA, 601 bp, Human; identical to SEQ ID NO: 45295

SEQ ID NO: 118818 - DNA, 601 bp, Human; identical to SEQ ID NO: 45296

SEQ ID NO: 118819 - DNA, 601 bp, Human; identical to SEQ ID NO: 45297

SEQ ID NO: 118820 - DNA, 601 bp, Human; identical to SEQ ID NO: 45298

SEQ ID NO: 118821 - DNA, 601 bp, Human; identical to SEQ ID NO: 45299

SEQ ID NO: 118822 - DNA, 601 bp, Human; identical to SEQ ID NO: 45300

SEQ ID NO: 118823 - DNA, 601 bp, Human; identical to SEQ ID NO: 45301

SEQ ID NO: 118824 - DNA, 601 bp, Human; identical to SEQ ID NO: 45302

SEQ ID NO: 118825 - DNA, 601 bp, Human; identical to SEQ ID NO: 45303

SEQ ID NO: 118826 - DNA, 601 bp, Human; identical to SEQ ID NO: 45304

SEQ ID NO: 118827 - DNA, 601 bp, Human; identical to SEQ ID NO: 45305

SEQ ID NO: 118828 - DNA, 601 bp, Human; identical to SEQ ID NO: 45306

SEQ ID NO: 118829 - DNA, 601 bp, Human; identical to SEQ ID NO: 45307

SEQ ID NO: 118830 - DNA, 601 bp, Human; identical to SEQ ID NO: 45308

SEQ ID NO: 118831 - DNA, 601 bp, Human; identical to SEQ ID NO: 45309

SEQ ID NO: 118832 - DNA, 601 bp, Human; identical to SEQ ID NO: 45310

SEQ ID NO: 118833 - DNA, 601 bp, Human; identical to SEQ ID NO: 45311

SEQ ID NO: 118834 - DNA, 601 bp, Human; identical to SEQ ID NO: 45312

SEQ ID NO: 118835 - DNA, 601 bp, Human; identical to SEQ ID NO: 45313

SEQ ID NO: 118836 - DNA, 601 bp, Human; identical to SEQ ID NO: 45314

SEQ ID NO: 118837 - DNA, 601 bp, Human; identical to SEQ ID NO: 45315

SEQ ID NO: 118838 - DNA, 601 bp, Human; identical to SEQ ID NO: 45316
